United States Patent 9,061,059 (MODIFIED POLYNUCLEOTIDES FOR TREATING PROTEIN DEFICIENCY) - sequence listing, part 129

SEQ ID NO: 249859 - DNA, 1845 bp, Artificial Sequence
  Description of Artificial Sequence: Synthetic coding sequence
atgagagcacttctccttctcggctttcttcttgtttcgcttgaatcgactctttcgattccgccctgggaagcaccaaaggaacataagtacaaggccgaagagcatactgtggtcttgaccgtgaccggagaaccgtgccactttccttttcaataccatcgtcaactgtaccacaaatgcactcataagggccggcctgggcctcaaccatggtgcgcaactacccctaacttcgatcaagatcagagatgggggtattgtcttgaaccgaaaaaagtgaaggatcactgcagcaaacattcaccttgtcagaagggcgggacctgcgtgaacatgccttcgggccctcactgcctgtgtccacagcacctgactggtaaccattgccaaaaggaaaaatgttttgaacctcagctgctccgcttctttcacaaaaatgaaatttggtaccggactgagcaggcagccgtggcaagatgtcagtgtaagggaccagacgcccactgtcaaagacttgcatcgcaggcatgtcgcaccaatccctgtctccacggaggccgctgtctggaggtcgagggtcatagattgtgtcattgccctgtcgggtacaccggcgccttctgtgacgtggacactaaggcctcgtgttacgatggaagaggattgagctatcggggtctggccagaaccactctgtcaggagccccgtgccagccctgggcctccgaagccacctaccgcaacgtcaccgccgaacaggcacgcaactggggccttggaggacatgcgttttgccggaaccctgacaacgatatacggccttggtgttttgtcctgaatagagacagactgagctgggaatactgcgaccttgcacaatgtcaaacgccaactcaggcggcaccgcctacccctgtgtctcctcgtttgcatgtgccccttatgccagcacagcccgcccctcctaaacctcagcctaccactcgcactcctccccaatcccaaacccctggagcactcccagcgaaacgggaacagccacccagcctgaccaggaatggcccgctctcctgtgggcagagactgcgcaagagcctgtcatcaatgactcgagtcgtgggcggtctggtggcgctgcgtggtgcgcatccctacattgcagccctctactggggtcatagcttctgtgctggatccctcatagcaccctgttgggtcctgaccgcggcccattgcttgcaagatagacccgcaccagaagatctgactgtggtgctgggacaagagcggaggaaccattcctgtgagccttgccaaaccctggccgtgaggagctacagactgcatgaagcctttagcccggtgagctatcagcatgatcttgcactgcttcgactccaggaagatgccgatggttcgtgtgcactcctttccccatacgtgcagcccgtttgcctcccttccggtgctgcgaggcctagcgaaaccactctgtgtcaagtggcagggtggggccaccagtttgaaggggcagaggaatacgcttcgtttctgcaagaagcccaggtgccttttctttctctggaacggtgctccgcaccagacgttcatgggtcaagcatcctgcccggaatgctttgcgcaggctttctggaaggaggaaccgacgcttgccagggagattcgggcggacctctcgtctgtgaggaccaagcagccgaacggaggctgacccttcaggggataatctcttgggggtcgggatgcggcgatcgcaacaaaccaggcgtctacactgatgtggcctactacctggcctggatcagagagcacacggtgtcc

SEQ ID NO: 249860 - DNA, 1845 bp, Artificial Sequence
  Description of Artificial Sequence: Synthetic coding sequence
atgcgcgctcttctgctcctcggattcctgctcgtatcacttgagtcaaccctgtctattccgccgtgggaagcgccgaaggagcacaagtacaaggcagaagaacatactgtggtactcaccgtcaccggcgaaccatgccacttcccgttccagtaccatcggcagctgtaccacaaatgcactcataaaggacgaccggggcctcagccgtggtgcgcgacgacccccaacttcgaccaggatcagcgctggggttactgtctggagcccaagaaggtgaaggaccactgctccaagcactcgccctgccagaagggcggcacgtgtgtcaacatgcctagcggaccacattgtctgtgcccgcaacacctgaccggaaaccactgtcagaaagaaaagtgctttgagccacagctcctgagattctttcacaaaaatgaaatatggtaccgaaccgagcaggccgcagtggcacgctgtcagtgtaaggggcctgatgcgcactgccaacgacttgcatcacaggcatgccgcaccaacccttgcctccacggaggccgctgcttggaagtggaaggtcatagactctgccactgcccggtcgggtacactggagccttctgtgatgtggacaccaaggcttcgtgttatgacggacgaggactttcttaccgtggactggcccgtacgactctctccggagccccatgtcagccctgggcctcggaagctacttacagaaatgtcaccgcagaacaagcacgcaattggggacttgggggtcatgccttctgccgcaatccggataacgatatccgtccttggtgcttcgttctgaacagggaccggctttcctgggaatactgcgacctcgcgcagtgtcagaccccaacgcaggctgcaccgcctactccggtgtccccgaggctgcacgtgcccctcatgccggcccagccggccccaccgaaacctcaaccaactacccggacgccgccgcagtcgcagaccccgggggctttgccggccaagcgggaacaaccaccatctctgacccgcaacggcccgctgtcgtgtggccaaaggcttcgcaagtcactgtcaagcatgactcgcgtcgtgggaggactggtggcgctgcggggcgctcacccctacatcgccgccctgtactggggacacagcttttgcgctgggtcactcatcgcgccttgctgggtcttgactgccgcacattgcctgcaagaccggccagccccagaggacctgaccgtggtcctggggcaggagcggagaaatcactcctgcgagccctgccaaactctggccgtgcgcagttaccgcctgcacgaggccttctctccagtctcataccaacatgaccttgcacttctcagactccaagaagatgccgatggatcttgcgctctgctgagcccatatgttcagccagtgtgcctcccttcgggcgccgcgcggccctcggaaactactctgtgccaagtcgcaggatgggggcaccaatttgagggcgctgaagaatatgcctcgttcctccaagaggcccaggtgccgtttctctccctcgaaaggtgctcggcaccggatgtgcatggctcctcgatcctgcctggaatgctctgcgcgggattccttgagggcggaactgacgcctgccagggtgattccggaggccctctcgtgtgcgaggaccaggctgccgagcggcggctgaccttgcagggtatcatctcctggggatccggatgtggtgacaggaacaaacctggagtgtacactgacgtggcttactacttggcgtggattagagaacataccgttagc

SEQ ID NO: 249861 - DNA, 1845 bp, Artificial Sequence
  Description of Artificial Sequence: Synthetic coding sequence
atgagggcgctgctcctgctcggttttctgttggtcagcctggaaagcactctgtcaattcccccctgggaggcgccaaaagaacataagtacaaagcagaagaacacactgtggtcctcaccgtgaccggagagccttgtcatttcccattccagtaccataggcagctctaccataagtgcactcataaaggaaggcctggcccacaaccatggtgtgccaccactcccaatttcgatcaagatcaacgttgggggtactgcctggaacccaagaaggtgaaggatcattgttccaagcattcaccatgtcaaaaggggggaacgtgtgttaacatgccttcgggtccccattgtctctgtccccagcatctcaccggtaaccactgtcagaaagagaagtgtttcgagccccaactgctgcgctttttccataagaacgagatttggtaccgtactgagcaagcggccgtggctcggtgccagtgtaagggtccggacgcacattgtcaaagactggcgagccaagcctgtagaacgaacccgtgcttgcatgggggccgctgtcttgaagtcgagggacatagattgtgtcactgcccagtggggtacaccggagcattctgtgacgtggacactaaggcaagctgctacgacggtcgagggctgtcttataggggtctggcccgcaccactctttccggggcaccatgtcagccatgggcgtccgaggccacctaccgtaacgtgaccgccgaacaggcgagaaactggggtcttggaggtcatgccttttgtagaaaccctgacaacgatatacgaccctggtgttttgttcttaacagggatcgattgtcgtgggaatactgcgatcttgctcagtgtcagaccccaacccaagccgcaccgcctaccccagttagccctagacttcacgtcccactgatgcccgcgcaacctgcaccgccaaagccgcaaccaaccacccgaacgcctccacaatcccagacgcctggggcacttccagcaaagcgggaacagcctcctagccttacccgcaatggacccctgtcatgtggtcagagactgagaaagagcctttcctccatgactagagtcgttggaggacttgtcgcgcttaggggagcacatccttacatagcagcactttattggggccacagcttttgtgcaggatccttgattgctccatgctgggtgctgactgccgcacattgtttgcaggacagacccgctcctgaagatcttaccgtggtgcttggccaggaacgaaggaatcattcctgtgagccatgccaaactctcgctgtgagatcatatagactgcacgaagcgttttcgcctgtgagctaccagcatgacctcgcccttcttaggctgcaggaagatgcagatggcagctgtgcccttctgtcaccatacgtgcagcccgtctgtctcccttcgggagcggcaagacccagcgaaactactctgtgccaagtggccggttggggacatcagtttgaaggagcagaagaatacgcatcctttctccaagaagcgcaagtgccatttctgtccctcgaaagatgctccgcacctgacgtccatggatcgtctatccttccagggatgctgtgtgctgggtttctcgaaggaggaactgacgcctgtcagggagattccggtggcccactggtctgtgaagatcaggcggcagaacgaaggctgactcttcagggaattatctcgtgggggagcggctgtggcgatcgcaataagcccggcgtgtacaccgacgtggcatactacctcgcatggattcgtgaacataccgtgtcg

SEQ ID NO: 249862 - DNA, 1845 bp, Artificial Sequence
  Description of Artificial Sequence: Synthetic coding sequence
atgagagcacttcttctgctgggattccttcttgtctcacttgaatcaaccttgtcgataccaccatgggaggcaccgaaggaacataagtacaaggctgaagagcatactgttgtgcttaccgtgaccggagaaccttgccattttccctttcaataccaccgacaactgtaccataagtgtactcataaggggcgccctggtccccaaccgtggtgtgcaaccacccctaactttgaccaagatcagagatggggatactgtctcgaaccaaaaaaggtgaaagaccattgctctaaacactccccctgtcagaagggaggaacttgtgtgaacatgccctccggacctcattgtctttgccctcagcatcttactggaaaccattgccaaaaagaaaagtgctttgagccacaactcctgcgctttttccacaaaaacgaaatttggtaccggacggagcaagcggccgtggcaagatgtcaatgcaaaggtcctgatgcacactgtcaacgcctggcatcacaggcatgtcgtacgaacccatgtctgcacggcgggcggtgcctcgaggtggaagggcatcgactttgtcattgtcccgtcggatacacgggagcattttgtgatgtggataccaaggcctcgtgttacgatggcagagggctgtcctataggggactggcccggaccaccctgtccggtgcaccctgccagccatgggcctcggaggcaacctacagaaatgtgactgcagaacaggcccggaattggggcctcggtggtcacgcattctgtaggaacccagacaatgatattcgcccttggtgtttcgtgttgaatagggatcgcctgtcatgggagtattgtgatcttgcgcaatgccagacccctacccaagcagcccctcctacccctgtcagccctagactccatgttccacttatgcctgcacaaccagcgcctccaaagcctcaacctaccactcggacgccccctcagtcacaaactccgggagctttgcctgcaaagagagaacagccccctagccttactcggaacggtcctctctcctgcggccaaaggctgcggaagtcactcagcagcatgactcgtgtcgtaggcggactggtggcgcttcgcggagcccatccatacatcgctgcactctactgggggcacagcttctgtgcagggagccttattgccccatgttgggtgctcaccgccgcacattgccttcaggatcgccccgcacctgaagatctcaccgtggtgctgggacaggaaaggcgaaatcactcctgtgaaccatgtcagacgctggcagtgagaagctacaggctgcatgaagcattctcgcctgtgagctatcagcatgaccttgcacttcttagattgcaagaagatgcagatggctcctgcgcactcctgtccccatacgtgcaacctgtctgccttccaagcggtgcagcacggccatccgaaaccactctgtgtcaggtggcggggtggggccaccagtttgagggagccgaggaatacgcctcctttctgcaggaggctcaagttccgtttctgtcactggaacgatgttcggccccagacgtacatggttcgtccattctgccgggtatgctctgcgccggatttcttgaggggggcactgacgcttgtcaaggggacagcggaggaccacttgtctgtgaagatcaagccgcagagcggagactcactcttcagggtattatctcttggggaagtggctgcggggaccggaacaagccgggagtatacactgatgttgcctactacctggcatggataagagagcacactgtgagc

SEQ ID NO: 249863 - DNA, 1845 bp, Artificial Sequence
  Description of Artificial Sequence: Synthetic coding sequence
atgcgcgcattgcttctgctcggattcttgctggtgtcccttgaatcgactctgagcatacccccgtgggaagccccaaaagagcataagtacaaggcagaagaacacactgtcgtcctgaccgttaccggagagccatgtcactttccattccagtaccatcggcagctgtaccacaaatgcacccacaagggccgcccgggccctcagccgtggtgcgctaccacgcccaatttcgatcaggaccagcggtggggttactgcctggagccaaagaaggttaaggaccattgctctaagcatagcccatgccagaagggagggacctgcgtgaatatgccgagcggaccccattgcctctgcccacaacacctcactggcaaccactgccagaaagaaaagtgcttcgagccacagctgctgagattcttccacaaaaatgagatctggtacaggaccgagcaagcggcggtcgcccgctgccaatgtaaaggtccggacgcccactgccagaggctggcctcacaagcctgccgcaccaacccttgcctccacggaggaagatgtctggaagtcgaggggcaccgtctttgccattgcccggtgggatataccggtgctttttgcgacgttgataccaaggcatcgtgttacgatggacggggactgagctacagaggcttggcgcggactaccctgtctggagcgccgtgtcagccgtgggcgtcagaagcaacctatcgcaacgtgactgcagagcaggctcgcaattggggccttggagggcacgccttctgtcggaacccggacaacgacatcagaccttggtgctttgtgctgaaccgcgaccgcttgagctgggagtactgcgatttggcccagtgccagacccctactcaggcggccccgccgactccggtgtcgccccgactccatgtgccattgatgccagctcagccggcgccaccaaagccgcaaccaaccacccgcactccgccgcaatcgcagactccgggggccctcccagctaaaagggagcagccgccgtccctgactagaaatggaccgctgtcgtgcggacagcgcctcagaaagtcactgagctcgatgactagagtggttggtggactggtggcccttcggggagcgcacccttacatcgcagccctgtactggggacattcgttttgtgccggatccctcatagcaccgtgttgggtgctgactgcagctcactgcctccaagaccgccctgcaccagaagatctgaccgtggtgctgggacaagaacggagaaaccacagctgtgaaccgtgccaaaccctcgccgttcggtcgtaccgcttgcacgaggcattttcacccgtgtcctatcagcacgatctcgctcttctgcggctccaggaggatgccgacggaagctgtgcgttgctgtcaccttacgtgcaaccggtctgcctcccatcgggggcggccaggccttccgaaacgaccctgtgccaggtcgcaggatggggtcaccaattcgagggagccgaagaatacgcctccttcctccaagaagctcaagtgccgtttttgtcgctggaacgctgctcggcgccagacgtgcatggatcgagcatcctgccaggaatgctctgtgcggggttcctcgaaggtggaacggatgcctgtcagggcgactccggtgggcccctggtgtgcgaagatcaggcggcggaacgccggttgacgctgcaaggtattatctcgtggggcagcggttgcggggacaggaacaagccaggcgtgtacacggacgtggcgtactacctcgcgtggatccgcgaacatacggtgtcc

SEQ ID NO: 249864 - DNA, 1845 bp, Artificial Sequence
  Description of Artificial Sequence: Synthetic coding sequence
atgcgcgcactccttcttctggggtttcttctggtgtcgctggaatcaactctctcgattcccccctgggaagcacctaaggaacacaagtacaaggcagaagaacacactgtggtcctcaccgtgaccggagaaccttgccacttcccatttcagtaccatcggcagctttaccataagtgtactcataagggtcgtccaggtccccaaccatggtgtgccaccaccccgaatttcgatcaggatcagcggtgggggtattgtctggaacctaagaaagtcaaggaccattgtagcaaacatagcccttgccaaaagggaggtacttgcgtgaacatgccatccggtccacattgcctgtgtccacaacatctcaccggaaaccattgtcagaaggaaaaatgttttgagccgcaactccttcggttctttcataagaacgagatatggtaccgcaccgaacaggcagcagttgcacggtgtcaatgcaaaggccctgatgcacactgtcaacgcctggcaagccaggcctgcagaaccaacccatgcctccatggcgggcgttgtctggaagtggaaggccatcggctttgtcattgtccagtgggttacaccggtgctttctgcgacgtggataccaaggcctcctgctatgacgggcgcggcctttcgtacagaggcctggcccgtactactctgtccggtgccccttgtcagccatgggcaagcgaagcgacgtatagaaatgtcaccgcagaacaggcacgaaactggggtcttggaggacacgcattttgccgtaaccctgataatgatattcggccttggtgtttcgtgctcaaccgcgacagattgtcatgggaatactgtgacttggcccagtgccagactcccacccaagcagccccgcctactccagtgtcgccccgtctccatgtgccgctgatgccagcacaacctgcgcctccaaagcctcagccaaccactaggacccctcctcagtcgcaaacccctggcgcactgcctgccaaaagagagcaaccaccgtcgttgaccagaaatggtccactttcgtgcggccaacgactgaggaaatccctctccagcatgacccgggtggtgggaggtcttgtagcactgcggggagcccacccctacatagcagcgttgtactggggacactccttctgcgctggtagcttgattgccccctgctgggtcctgaccgccgcacattgtttgcaagaccgccctgcccccgaggatcttaccgtagtgcttgggcaagagcgtaggaatcactcttgtgaaccgtgtcaaactctggcggtgagatcgtaccgcctccatgaggctttctccccggttagctaccaacacgatctcgctttgctgcgcctgcaagaagatgcagacggaagctgtgcactgctctctccatacgtccagcctgtgtgtctgccctcaggtgcggctcggccatcggaaactacgctgtgtcaggtggcaggatgggggcaccaattcgagggcgccgaggaatacgcatcgtttctccaagaggcccaagtcccctttctgtcacttgaaagatgttccgccccagatgtccacgggtcaagtattctccctggaatgctgtgcgctggctttcttgagggcggaaccgatgcgtgtcaaggagactccggtggtcctcttgtctgcgaagatcaggcggcagagcgacggcttaccctccagggaatcatttcgtggggttcaggttgtggcgaccgcaacaagcctggagtgtacacggatgtagcatactacttggcttggattagagagcatactgtgtcg

SEQ ID NO: 249865 - DNA, 1845 bp, Artificial Sequence
  Description of Artificial Sequence: Synthetic coding sequence
atgagggctctcctactgttgggattcctccttgtctccctggaatctacgctatcaatcccaccatgggaggccccaaaagaacataaatacaaagcggaggagcatacggtggtcttgactgtgacgggagaaccctgtcattttccgtttcaataccatcggcaattatatcataagtgtacccataaaggtcgaccaggcccccaaccttggtgtgctacgactccaaatttcgatcaggaccagcggtggggctattgtcttgagccaaagaaagtgaaagaccactgctccaagcatagcccatgccaaaagggtggtacgtgtgtaaatatgccctcgggtccacactgcttgtgcccgcaacatcttacgggtaaccattgccaaaaggagaagtgtttcgagccacagctgctacggttcttccacaaaaacgaaatatggtacaggacagagcaggcagccgttgcccgttgtcagtgcaaaggccccgatgcccactgccagcgtctcgcctctcaggcatgcagaactaacccttgcctgcatggtggtagatgtttggaagtcgaagggcaccgcctttgtcactgtccggtagggtacaccggtgccttctgtgacgtagataccaaagcgagttgctatgatggacgcggtctttcctatcgtggactcgctcgcaccacattatcaggagcaccttgccagccctgggcctctgaagcaacttaccgcaacgtcacagcagaacaagcacgtaattggggactgggaggtcatgccttctgtcgcaacccagacaatgatattagaccgtggtgttttgtgctaaatcgtgatagactgtcgtgggagtactgtgatctggctcagtgtcagaccccgacccaggctgcaccgcccaccccagtatcgccccgcttacacgtccctctcatgcccgcacaaccggccccgcccaagccacagccgaccacacgtacgcccccccagtcccagaccccgggtgcccttcctgccaaacgggagcagccgccttctctcacccgtaatggcccactcagttgtggacagcgcctcagaaaatcactcagctccatgacccgggtggttggcggcttggttgctttgaggggcgcacacccttatattgcagctctttactgggggcattcgttctgcgcaggatcgttgatcgcgccttgttgggtgttgacggccgcgcattgtctccaggacaggccggccccagaggatttgacggtggtgcttggtcaagaacgacgcaatcactcatgtgagccctgtcagacacttgctgtacgcagttaccgtctgcacgaagcattctcgccagtatcctatcagcacgatctggccttgttgagactgcaggaggatgcggacgggtcctgtgccttactctcaccttatgttcagccggtctgtctgccttcgggcgctgcaagaccaagcgaaaccacgctgtgtcaagttgctggttggggtcaccagttcgaaggcgcggaagagtacgcctcctttttgcaagaagcgcaggttcctttcctcagcctcgagcgctgctcagccccagatgttcatgggagctccatcctgcccggcatgttgtgcgccggcttcttggagggtggaacagatgcctgccagggggactctggaggacctctggtctgtgaggatcaggctgctgaacgtcgcctgactctacaggggatcatttcgtgggggagtggatgtggagatcggaataaaccgggcgtctacactgacgtggcttattacctcgcctggatccgtgagcatactgttagc

SEQ ID NO: 249866 - DNA, 1845 bp, Artificial Sequence
  Description of Artificial Sequence: Synthetic coding sequence
atgcgagctttgctgctgcttggctttctactcgtgagcctggagtccacattgtctatacctccgtgggaagcgcctaaagaacataaatacaaggccgaggagcacacagtggtcctcaccgtcactggggagccctgccactttccctttcaataccatagacagctctaccacaagtgcacacataagggcagacccggcccacagccatggtgcgcaactacacctaatttcgaccaggaccagcgctggggctactgcctggagccaaaaaaagtaaaagaccactgctcaaaacattctccgtgtcagaaagggggcacatgtgttaatatgccttccggaccacattgcctgtgtcctcagcacctgacaggcaaccactgtcaaaaggagaaatgttttgagccccagttgttgaggtttttccacaaaaacgagatctggtatcgcactgagcaggctgccgtcgctcgctgtcagtgtaaaggccccgacgctcactgccaacggctcgcctcacaggcctgtagaacaaacccttgtctgcacggggggcggtgccttgaggttgaaggacaccgcctctgccattgccccgtggggtatacgggcgccttttgcgatgtggacacaaaggcttcctgttacgatggccgcggactgtcgtatcgaggactggcccggactaccttgtcaggagccccctgccaaccgtgggcttctgaggcaacctacaggaatgttactgccgaacaggctaggaactggggcctgggtggccacgccttttgtcggaatcccgacaacgacatcagaccatggtgcttcgtgcttaatcgcgacaggttgtcatgggagtattgcgacctggcccagtgccagacccccacccaggccgcaccccctacccccgtgagtccgcgcctgcacgtgccattaatgccagcgcagccggctccacccaaaccgcagcccactactcgtacaccaccacagagtcagacccctggggcgctccccgctaagcgtgaacaacctccttcactcaccaggaacggcccactgtcttgtggtcagcggttgcggaagagcttgtcttcaatgacgcgggtcgttggaggacttgtcgcgctgagaggcgctcatccctatatagctgccctgtactggggccattctttctgtgcggggagtttgatcgccccttgctgggtcctgacagcagcgcactgtctgcaggatcggccagcccccgaggaccttaccgtagtcctgggacaagagaggaggaatcactcgtgtgagccatgtcagacactcgctgtgcgctcctaccggctccacgaggctttcagcccggttagttatcagcacgatctggcccttttgcgattacaggaagacgcagatggctcctgtgcattgctctctccgtacgtgcagccggtctgtctaccgtctggcgcagcccggccttccgagacgaccctttgccaggtggctgggtggggacaccagttcgaaggggccgaggaatacgccagctttttacaggaggcccaagtgccattcctaagtcttgagcgctgcagtgccccagacgtgcatggaagcagcattctacctggcatgctgtgtgctggatttctcgagggcggcactgacgcctgccagggagattcaggtggaccactggtatgtgaagatcaggctgcagagcgtagattgactctgcagggaatcatctcttggggcagtggctgcggggatcggaacaagccaggggtctacacagacgtcgcctactatctggcctggattcgggaacacacagtgtct

SEQ ID NO: 249867 - DNA, 1845 bp, Artificial Sequence
  Description of Artificial Sequence: Synthetic coding sequence
atgcgcgcacttctgcttctgggattcctgttggtgtcactggagtccactctttccataccaccttgggaagcccccaaggaacataagtataaggcagaggaacacaccgtcgtgctgacggtgacgggagaaccatgtcactttccctttcagtatcatcgccaactgtaccacaagtgtactcacaagggtaggcctggaccacagccatggtgcgcaaccactccaaactttgaccaagatcagagatgggggtattgtctggaacctaagaaagtgaaggatcactgttcgaagcatagcccttgccagaaaggtggaacctgtgtgaacatgccgtcgggacctcactgcctgtgtcctcaacatttgactggcaatcactgtcaaaaagaaaagtgtttcgaaccccagttgctgcggttcttccacaaaaatgagatttggtaccgaacggagcaggccgcagtggcaaggtgtcagtgtaagggacccgatgcacattgccagcggcttgcgtcgcaagcatgtaggaccaatccttgtctgcacggaggccggtgtctcgaagtcgaaggtcatcgcctttgtcactgccccgtgggttacactggagcgttttgtgatgtggataccaaagcctcatgttacgacggtcgtggactcagctacaggggcctggccaggaccaccctttccggggccccgtgccagccatgggcaagcgaagcaacttacaggaatgtcactgcagaacaagcccgaaattggggactgggcggccatgcgttttgccggaatccagataacgacatacggccttggtgttttgtcctgaacagagatcggctctcgtgggaatactgtgatctcgcccagtgccaaaccccaactcaagccgccccacccactcccgtgtcccccagacttcatgtgcctctcatgcctgcacagcctgccccacccaagcctcaacctaccactcgcacccctccccagtcccaaacccctggcgcactgcctgcgaagagagagcaaccaccttcgctgaccagaaacgggcctctgagctgtggacaaagactccgcaagtcgctctcgtccatgacccgtgtggtgggcggacttgtggcacttagaggtgcacatccctacattgcagccctgtactggggacatagcttctgcgccggctcccttatagcaccatgttgggtcctgactgccgcacactgcctgcaagatcgacctgcaccagaggaccttacggttgtgctcggacaggaaagacgtaatcattcgtgcgaaccatgccaaactctcgccgtccggtcctaccgtctgcatgaggccttttcaccggtaagttaccagcacgacctggcgctgcttcggctccaggaggacgccgacggttcgtgcgcactcctttccccttacgtccaaccagtgtgtctcccttcaggagccgccagacccagcgaaaccaccctttgccaagtggcaggttggggccatcaatttgagggagcagaggaatacgcgtcatttctccaagaggcgcaagtgcctttcctttcgctggaacgttgctcggcacctgacgtgcacgggtcgtcgatactgcccggtatgctttgtgcaggatttcttgaaggtggtaccgatgcatgtcaaggagacagcggggggcccctcgtctgtgaagatcaggcagcagagcgcagacttactctgcagggtatcatttcctggggtagcggatgtggagatagaaacaaaccgggagtgtacaccgatgtcgcatactacctcgcatggataagagaacatactgtgagc

SEQ ID NO: 249868 - DNA, 1845 bp, Artificial Sequence
  Description of Artificial Sequence: Synthetic coding sequence
atgagggccctcctattgctcgggttccttttagtctcactcgagtcgaccttgtcaatccccccctgggaagcaccaaaagaacacaagtataaagctgaagaacataccgtcgtgctgaccgtcacaggggagccctgtcacttcccctttcagtaccatagacaactatatcacaagtgcacgcacaagggaaggccagggccccaaccatggtgtgctacaacacctaatttcgatcaggaccagcgatgggggtactgtctggagcctaaaaaagtcaaagatcactgttcaaagcacagcccatgccagaaggggggcacctgtgttaatatgccgagtggtccacactgtttgtgtccccaacacctgacaggtaaccattgccagaaagagaaatgcttcgagccccaactgctgaggttctttcacaaaaacgaaatctggtatcgaactgaacaagctgctgtggcccgctgccagtgtaagggtcccgacgcccattgccagcgactggcgtcccaggcgtgtagaacgaatccatgtctccacggcggtcgctgcctggaggtggagggccatcgcctctgccactgccccgtgggctatacaggcgccttctgcgacgtcgataccaaggcctcatgctatgacggccgggggttgtcatataggggcctagccagaacaacgctgagtggtgccccatgccaaccatgggcatctgaggctacatatcgcaacgtaaccgccgagcaagccagaaattgggggctggggggtcatgccttctgccgtaatccagacaacgacatcagaccctggtgcttcgtactcaaccgagatagactgagctgggagtactgcgacctggctcagtgtcagaccccaacccaggcggcaccacccacacctgtgtccccgcgactgcacgtgcctttgatgcctgcacaaccagctccgcccaagcctcagccaacaacgcgcacccccccacagtcccagacgccgggtgccttgccggctaagcgcgagcagccgccttctctgacacgcaacgggccactaagctgcggtcagcggttgcgaaagagcctgtcttctatgaccagggtcgtgggggggctggtcgccctgagaggggcccacccctacatcgccgcactgtattggggacacagtttttgcgccgggtctttaattgccccatgctgggtgctgactgcagctcactgtctgcaagaccgtcccgctcctgaagatctgacagtcgttctgggacaggagcgccgcaatcactcttgcgaaccctgtcagacgctggccgtcagatcctacaggctgcacgaggcattctctccagtatcgtaccagcacgatttggctctcctgcggctgcaggaagatgccgacggatcatgtgccctcctctccccctatgtgcaacctgtgtgtctaccctccggtgccgcccgccctagtgaaactacattgtgccaggtcgcagggtggggccaccagtttgaaggcgccgaggaatatgcctcattcctgcaggaagcccaagtcccattcctgtccctcgaaaggtgttctgcccctgacgtgcacggatcctctatcctgccaggaatgctctgtgctggctttctcgaaggaggcacggatgcttgtcagggagatagcggggggcccctggtctgcgaagatcaagctgccgagagaaggttgaccctgcagggaatcatttcctggggcagcggctgcggtgacaggaacaagcccggtgtgtacacagatgtcgcgtattaccttgcttggatacgggaacataccgttagc

SEQ ID NO: 249869 - DNA, 1512 bp, Artificial Sequence
  Description of Artificial Sequence: Synthetic coding sequence
atgatgacgacgtcgttaatatggggtatagcgatagcggcgtgttgttgtctatggctaatactaggtatacgtcgacgtcaaacgggtgaaccgccgctagaaaatggtttaataccgtatttaggttgtgcgttacaatttggtgcgaatccgctagaatttctacgagcgaatcaacgaaaacatggtcatgtttttacgtgtaaactaatgggtaaatatgttcattttataacgaatccgctatcgtatcataaagtactatgtcatggtaaatattttgattggaaaaaatttcattttgcgacgtcggcgaaagcgtttggtcatcgttcgatagatccgatggatggtaatacgacggaaaatataaatgatacgtttataaaaacgttacaaggtcatgcgttaaattcgctaacggaatcgatgatggaaaatctacaacgaataatgcgtccgccggtatcgtcgaattcgaaaacggcggcgtgggtaacggaaggtatgtattcgttttgttatcgtgttatgtttgaagcgggttatctaacgatatttggtcgtgatctaacgcgtcgagatacgcaaaaagcgcatatactaaataatttagataattttaaacaatttgataaagtttttccggcgctagtagcgggtttaccgatacatatgtttcgtacggcgcataatgcgcgagaaaaactagcggaatcgctacgtcatgaaaatttacaaaaacgagaatcgatatcggaattaatatcgttacgaatgtttctaaatgatacgctatcgacgtttgatgatttagaaaaagcgaaaacgcatctagtagtattatgggcgtcgcaagcgaatacgataccggcgacgttttggtcgctatttcaaatgatacgtaatccggaagcgatgaaagcggcgacggaagaagtaaaacgtacgctagaaaatgcgggtcaaaaagtttcgttagaaggtaatccgatatgtttatcgcaagcggaattaaatgatttaccggtattagattcgataataaaagaatcgttacgtttatcgtcggcgtcgttaaatatacgaacggcgaaagaagattttacgctacatttagaagatggttcgtataatatacgaaaagatgatataatagcgttatatccgcaactaatgcatttagatccggaaatatatccggatccgttaacgtttaaatatgatcgttatctagatgaaaatggtaaaacgaaaacgacgttttattgtaatggtttaaaactaaaatattattatatgccgtttggttcgggtgcgacgatatgtccgggtcgtttatttgcgatacatgaaataaaacaatttttaatactaatgctatcgtattttgaactagaattaatagaaggtcaagcgaaatgtccgccgttagatcaatcgcgagcgggtctaggtatactaccgccgttaaatgatatagaatttaaatataaatttaaacattta

SEQ ID NO: 249870 - DNA, 1512 bp, Artificial Sequence
  Description of Artificial Sequence: Synthetic coding sequence
atgatgaccacgtctctcatttggggcatcgctatagccgcctgctgttgtctgtggctgatcctgggaattagacggagacaaacaggcgagccacccctggaaaatggcctgattccgtatctggggtgcgcgctgcagtttggcgccaatcctctcgagttccttagagcaaatcaacgcaaacacggccatgtgttcacctgtaaacttatgggcaagtacgtccattttatcactaatcccttgtcctatcacaaggttttatgtcacggaaaatacttcgattggaaaaaatttcattttgcaacttcggccaaagctttcggccaccgcagcatcgacccaatggacggaaacaccaccgagaacatcaatgacacctttattaagacactgcaagggcacgctctgaactcactgacagagtccatgatggaaaatcttcaacgcatcatgagaccacctgtgtcgtctaacagcaaaaccgcggcctgggtgaccgaaggcatgtacagcttttgttaccgggtaatgttcgaggccggatacctgaccattttcggcagggacctgacaagacgcgacacacagaaagctcacatcctgaacaatctggacaatttcaagcagttcgacaaggtgttccctgccctggtggcaggcctacctattcatatgtttcgcactgctcataatgcgagggagaagctcgccgagtcactgagacatgaaaacctacagaaacgagagtctatctcagagctgatttcactccgtatgtttctgaacgacaccctgtcgacttttgacgatctggagaaagccaagacacacctggtggttctatgggcatcgcaggcgaacacaattcctgccacattttggtcactgtttcaaatgatcaggaatccggaggccatgaaggcagctacagaagaggttaagaggactctggaaaacgcaggacaaaaggtctctttagagggcaacccgatctgcctgagccaggccgagcttaatgacctgcctgtgctggactccataatcaaggaatcgctgcgtttgagcagtgcctctctcaacatcaggactgccaaagaggatttcacactgcacttggaggatggaagctataacatccgcaaggacgatataatcgctctgtatccccaactgatgcatctggacccagaaatctatccggatccgctcacgttcaaatatgacaggtacttggacgaaaacggaaagaccaaaacgacgttttactgtaatggactcaagttgaagtattattatatgcccttcggctctggcgccactatctgtcccggcaggttgtttgcgattcacgagatcaaacagttcctgatcctaatgctctcatacttcgagctggaacttatcgagggtcaagctaaatgcccacccttggatcagagtcgggccgggttggggatcttgcctcctctgaatgacatcgagtttaaatataagttcaagcattta

SEQ ID NO: 249871 - DNA, 1512 bp, Artificial Sequence
  Description of Artificial Sequence: Synthetic coding sequence
atgatgactacctccttgatctgggggattgccatcgctgcctgttgctgtctgtggctgatactggggattaggcgcagacaaaccggcgaacccccgctcgagaacggactgatcccttacctgggttgtgctctgcaattcggtgcaaatcctctcgaatttcttcgcgccaatcagcggaaacacggccacgtgttcacgtgcaagctgatgggaaagtacgtgcacttcatcaccaacccattgtcctaccacaaggtcctgtgtcacgggaagtacttcgattggaagaagttccattttgcgactagcgcaaaggcgttcggccacagaagcatcgatccaatggacggtaacaccaccgaaaacatcaatgacacgttcatcaagaccctccaaggccatgcgctcaattcacttactgaatccatgatggaaaacctgcagcggattatgcggccacccgtctcctcgaacagcaagactgccgcgtgggtgactgagggcatgtactcgttctgctatcgggtcatgttcgaagccgggtacctgaccattttcggaagagatctgaccagacgcgacactcagaaggcgcatatcctgaacaatctggacaactttaagcagtttgataaggtgtttcccgctctcgtggccggactgccgatccacatgttccgcaccgcccacaacgcaagggagaagctggctgagtccttgaggcacgaaaacctccaaaaacgagaatcgatctccgaactgatctccctccgcatgttcctcaacgacaccctctcgactttcgatgatctcgaaaaagcaaaaacccaccttgtggttctttgggcgtcgcaggctaacaccataccggctactttctggtcattgttccagatgatccggaacccggaggccatgaaggccgcgactgaagaagttaaacgcactttggagaatgcaggccaaaaggtcagcctcgaaggcaatccgatctgcctctcgcaagcggaactgaacgacctccctgtgctcgattcgatcatcaaggaatcgctgagactgtcatcggcatcattgaacattcgcacggccaaggaggacttcactttgcatctggaggatggttcatacaatattcggaaagacgacataatcgcgctgtacccccagttgatgcacctggacccggaaatctacccagacccactgacctttaagtacgatcgctacctggatgagaatggaaagactaaaactactttctactgcaatggcctgaagctgaaatactactatatgccgttcggatccggagctaccatctgcccgggccggctgttcgccatccacgaaatcaaacaattcctcatccttatgctgtcctactttgagctggaattgatcgagggacaggcgaaatgtccgccactcgatcagtcacgggcaggactgggcatccttcctcctctcaacgacatcgaattcaagtacaaattcaaacatctg

SEQ ID NO: 249872 - DNA, 1512 bp, Artificial Sequence
  Description of Artificial Sequence: Synthetic coding sequence
atgatgaccactagcttgatctgggggatcgcaattgcggcatgttgttgtctgtggctgattctgggaattcgcagacggcagaccggggaacccccacttgaaaatggtctgatcccatacctcgggtgtgccctccaattcggtgccaaccctctggaatttctccgcgctaatcagcgaaaacacgggcacgtgttcacgtgcaaactgatgggcaaatatgtgcactttatcaccaaccctctctcgtaccataaagtgctttgccacggcaaatacttcgattggaagaagttccatttcgcgacttccgccaaagcattcgggcatcgttcgattgaccccatggatggcaacactacggagaacatcaatgacacttttatcaaaaccctgcaggggcacgcattgaattcgctgactgaaagcatgatggaaaatcttcagcggatcatgcgcccgccggtcagctcaaacagcaagaccgccgcttgggtgaccgaaggaatgtactccttctgctaccgtgtgatgtttgaagcgggctacctgactatcttcggtcgcgaccttactaggagagacactcaaaaagcgcacatcctcaacaacctggataactttaagcaattcgacaaggtgttccccgcccttgtcgccggactgcccattcatatgtttcgcactgcccataatgccagagaaaaactcgcggaatcactcaggcatgagaatctccagaagcgggaatcgatctccgagctgatctcgctgaggatgtttctcaacgacacgctgtctacctttgatgacctggaaaaggcaaagactcacttggtggtgctgtgggcctcacaggccaataccatcccggccaccttttggagcctgttccagatgatccgcaacccggaagcaatgaaggctgccaccgaagaggtgaagaggactctcgaaaacgcgggccagaaggtgagcctcgagggcaatccgatatgcctgtcccaagccgaactgaatgacttgccagttcttgatagcatcatcaaagagtccctccggttgtcatcagccagcctgaacatccggaccgcaaaagaggacttcactctgcatctcgaagatggaagctacaatatccggaaggacgatatcatagcgttgtacccgcaactgatgcacctggaccccgagatctaccccgacccgcttacgtttaagtatgatagatacctggatgagaatggaaagactaagacgaccttttactgcaacggactgaagctgaagtactattacatgccatttggaagcggagctactatctgcccgggacgcctctttgccatccacgagatcaagcagtttctcatcctcatgctgtcatacttcgagttggagttgatcgaaggacaagctaagtgccctcctctcgatcagagccgcgcaggactgggcatcctgcctcctctgaacgatatcgaattcaagtacaagttcaagcacctc

SEQ ID NO: 249873 - DNA, 1512 bp, Artificial Sequence
  Description of Artificial Sequence: Synthetic coding sequence
atgatgactacgagcctgatttggggtatcgcaattgccgcctgttgctgtctctggcttatcctgggcattcggcggcggcaaactggagaacccccactcgagaatggcttgattccatacctcggatgtgctctccaatttggagctaacccccttgagtttttgcgagcaaaccaacggaagcacggacacgtgtttacttgtaaacttatgggaaagtacgtgcatttcatcactaacccccttagctaccataaagtcctgtgtcatgggaagtactttgattggaagaagtttcattttgccacttccgcaaaagcatttggacatcgatcgattgatcccatggacggtaataccaccgaaaacatcaatgacaccttcataaagaccttgcagggacatgcccttaacagcctcactgagtcaatgatggaaaatctgcagagaattatgcggcctccggtgtcctccaattcgaaaactgctgcgtgggtgactgaggggatgtacagcttctgttaccgtgtcatgtttgaagcaggttacctgaccatttttggtagagatctcactcggagggacacccagaaggcacacattctcaacaatttggacaactttaagcaatttgataaggtgtttccagcactcgtcgcaggacttccaattcacatgttcagaaccgcacataacgcgagggaaaagttggctgagtccctgcgtcacgagaaccttcaaaagcgtgaatcaatttccgaacttatatcgctgcgcatgttcctgaacgataccctgtcaaccttcgatgatctggagaaggcaaagacgcacctggtggtgctgtgggcaagccaggcaaacactatcccagcaaccttttggtccctttttcaaatgatacggaaccctgaagcgatgaaggcagcaaccgaagaagtcaagcgcaccctggagaatgcaggccaaaaagtgtctctggagggaaaccctatttgcctgtcccaagcggaactgaacgatcttccggtccttgactccatcatcaaagagtcccttaggctctcctccgcctcgcttaacattcggaccgccaaagaagattttactttgcatctggaggacggatcatacaacattcgaaaagatgacatcattgccctgtacccacaactgatgcatcttgaccctgaaatctacccagacccactgacttttaagtacgatcgctaccttgatgaaaatggtaagacgaaaaccaccttttactgtaatgggcttaaactcaaatactactacatgccgtttggttcgggagcaactatttgcccaggtcgcctttttgctatccacgagattaagcaattccttatcctgatgctttcgtacttcgagctggaacttatcgagggtcaagcaaagtgtcctcctcttgatcaatcacgtgccgggctggggattctgcctcctctcaatgacattgagttcaaatacaaattcaagcatctg

SEQ ID NO: 249874 - DNA, 1512 bp, Artificial Sequence
  Description of Artificial Sequence: Synthetic coding sequence
atgatgaccacttctctcatttggggaattgcaatcgctgcttgctgctgcctgtggctgattctgggcattcgcaggagacagacgggagaacccccgcttgagaacggattgatcccatacctgggctgcgcgcttcaatttggagctaatcctctcgagttcctcagggctaaccagcgcaaacatggccacgttttcacctgtaagctgatggggaagtacgtccatttcattactaatccgctgtcatatcacaaagtgctgtgccacggaaagtacttcgactggaagaagttccatttcgccacctcggcgaaggcattcggccatcggtccatcgatcccatggatggaaatactaccgagaacattaatgacactttcatcaagaccctgcagggccacgcactgaactcacttactgagtccatgatggaaaacttgcagcgaatcatgcgcccgcctgtgtccagcaactccaagacggctgcatgggtcactgagggaatgtactccttctgctatcgggttatgtttgaagcggggtacctcactatcttcggaagagacttgactcgccgggatactcaaaaggcccatatcctgaacaacttggataactttaaacaattcgacaaggtgttcccggccttggtcgctggactgccaatccacatgttcagaaccgcccataacgcaagggaaaagctcgcagagagcctcaggcacgagaatctccaaaaacgcgaatcaatcagcgagctgatctcgctgagaatgttcctgaatgataccctgtcgaccttcgacgatcttgagaaggcaaagacccacttggtggtcctgtgggcttcccaagccaacaccatcccggccaccttctggtccctctttcagatgatccgcaatcctgaagccatgaaggccgccacggaagaggtgaagcgcactctggagaacgccggacaaaaagtctccttggaagggaaccctatctgcctgtcgcaagctgaactgaacgatctgccagtgctggatagcattatcaaggagtccctgaggttgtcgtcagcttccctgaatatccggaccgccaaggaagatttcaccctgcacctcgaggacggctcatacaatatccggaaggacgatatcatcgcactgtatccacagcttatgcaccttgacccggaaatctatccggatccccttacctttaagtacgatcggtacctggacgagaacggaaaaactaagaccaccttctactgcaacggactgaagctgaagtactactacatgccattcggatccggcgccaccatctgcccgggacgcctctttgcaatccatgagatcaaacagttcctgatcctgatgctgtcctacttcgaattggaacttatcgaaggtcaagcaaagtgcccaccgttggatcagagccgggccggccttggaatcctgcctccgctcaacgatatcgaattcaagtataagtttaagcacctc

SEQ ID NO: 249875 - DNA, 1512 bp, Artificial Sequence
  Description of Artificial Sequence: Synthetic coding sequence
atgatgactacttctctcatttggggcattgccatcgcagcctgctgctgcctatggctgattctagggatcagacgtcggcagacaggagagccccccctggagaatgggttgataccttacctggggtgtgctctgcagtttggagctaacccgctggaattcctgcgcgcaaatcagcgaaagcatggacacgtgtttacatgtaagctcatgggaaaatacgtccactttattaccaatccactgtcctaccataaggtcctgtgccacggcaaatattttgattggaaaaagttccactttgcaacttctgctaaagctttcggacatcgctctatcgatccaatggacgggaataccaccgagaatatcaatgacactttcattaagacgttgcaagggcacgcattaaattctctgactgaaagtatgatggagaaccttcaacggattatgcgcccccctgtgtcaagcaactccaagactgctgcttgggtgacagagggcatgtactcattctgctatcgagtgatgttcgaggcggggtaccttactatattcgggagagacctgactagacgggatacccagaaggcacacatcttaaataaccttgataattttaagcagttcgataaggtttttccggccttggtggccggtctgcctatacacatgttcagaacggctcacaatgccagggagaaattggcagaaagtcttcgccatgagaacctgcagaagagggagtctatttctgagctcatcagtttacgcatgtttctcaatgatactttatccacttttgacgatcttgaaaaggcaaaaacacaccttgttgttctctgggcgagtcaggccaacaccattccggcaacgttctggagcctctttcagatgatccgcaacccagaggctatgaaggcggccaccgaggaagtcaaaagaacactcgagaacgctggccagaaggtaagtctggaggggaacccgatatgcctcagtcaggccgagttaaacgatttacccgtgttggactcgatcataaaggagtctcttaggctgagttctgccagtcttaatatcaggacagcaaaagaggatttcacgctgcaccttgaggatggatcgtacaacatccgcaaggatgatatcattgcactttatccccagcttatgcacctggaccccgagatatatccagacccactgacattcaaatacgaccgctacctcgatgagaacggaaaaactaagacaaccttctactgcaatggccttaaactgaagtattattacatgcccttcggctctggcgccactatatgccctgggaggctcttcgctattcacgaaataaaacagttcttaatattgatgcttagttactttgaattggagttgattgagggccaggcaaaatgtcctccattggaccaatctagggcaggtctgggcatcctgcccccccttaacgacatcgaatttaagtacaagttcaagcatcta

SEQ ID NO: 249876 - DNA, 1512 bp, Artificial Sequence
  Description of Artificial Sequence: Synthetic coding sequence
atgatgaccacttcgctcatctggggcatcgcaatcgcggcctgctgctgcttgtggttgatcctgggcattaggaggcgccagaccggagagccacccttggaaaacggtctgatcccttatcttggatgtgcactgcagttcggagcgaaccctctggaatttctgcgggcgaatcaacgcaaacacggccatgtgttcacgtgcaaactgatgggcaaatacgtccacttcataaccaacccactgtcctaccacaaggtgctgtgccatggaaagtacttcgactggaagaaatttcacttcgccaccagcgccaaggcctttggccatcggtcgatcgatccaatggacgggaacactaccgaaaacataaatgacaccttcatcaagactctgcaaggacacgccctcaattcgctgactgaatcaatgatggaaaacctgcaacgtatcatgcggccgccagtgtcctccaactccaagaccgccgcttgggtgaccgagggaatgtacagcttctgctacagggtcatgttcgaggcaggatacctgaccatcttcggacgggacctgacgcgcagagatacccagaaggcccatattctcaacaacctcgacaacttcaaacaattcgacaaggtctttccagccctggtggcgggacttccgatccacatgttccgcaccgcccataacgcccgtgaaaaacttgccgagtcgctccggcatgagaatctgcaaaagcgggaatcaatttcagagctcatctccctccggatgttcctgaacgacacccttagcaccttcgacgacctcgagaaagccaagacccacctcgtggtcctgtgggcctcgcaagcgaataccatcccagcaactttttggtcgctgttccagatgatccgaaacccagaggccatgaaggcggcaaccgaggaggtcaaacgcacccttgaaaacgccgggcagaaggtgtcgctcgaggggaatccgatttgtctgtcgcaggctgagctgaatgacctgccggtcctggactcgatcatcaaggagtcattgcggctgagctcggccagcttgaacattcggaccgccaaggaagatttcactctccacctggaggacggatcctacaacatccggaaggacgacatcatcgcgctctacccgcagctgatgcatctggatccggaaatctacccagacccgctcactttcaaatacgatcgctatctggatgaaaacgggaaaactaaaacgaccttttactgcaatggacttaaactcaagtactactacatgccattcggtagcggagctaccatctgtcccggccggcttttcgccattcatgagattaagcagttcctgatcctgatgttgtcctactttgaactcgaacttatcgaggggcaggcgaagtgcccgcctctggatcagtcacgggcaggactcggaatcctcccgccgctcaatgatatcgagttcaagtacaaattcaagcatctg

SEQ ID NO: 249877 - DNA, 1512 bp, Artificial Sequence
  Description of Artificial Sequence: Synthetic coding sequence
atgatgactacttcactgatttggggcattgcaattgcagcctgttgttgcctttggctgattctgggaattcggcgcagacaaactggcgaacctccgcttgagaatgggctgatcccttacttgggatgtgcccttcagtttggagcaaaccctcttgagttcctcagagccaatcagcgtaaacacggtcatgtgtttacgtgcaagctcatgggcaagtacgttcactttatcaccaaccctctgtcctaccacaaggtcctgtgtcacggaaagtactttgactggaagaaattccattttgcaaccagcgcaaaggcattcggacaccgttcaattgacccaatggacggtaacaccaccgagaatatcaacgacaccttcataaagacgctgcaaggacacgctcttaacagcctcaccgaatcgatgatggaaaatctgcagagaatcatgcggccaccggtgagctccaactcgaaaaccgccgcatgggtgaccgaaggaatgtactccttctgctaccgcgtgatgtttgaagccggatatctgacgatctttgggagggatttgacccgtcgcgacacgcagaaggctcatattctcaacaacctggacaatttcaagcaattcgataaagtttttcctgcactggtcgcaggtttgccaattcatatgttcagaaccgcacataatgccagagaaaagctggcggagtcgctgaggcatgagaatctgcagaagcgggagtctatttcggaactgatttcccttcgcatgtttcttaacgacaccctcagcactttcgatgatctggaaaaggctaagactcatctcgtcgtgctttgggcatcccaagccaacaccatacccgccactttttggtcgctttttcaaatgattcgaaaccctgaggccatgaaggcggccactgaggaggtcaaacgcactcttgaaaacgcaggccaaaaagtctctttggaaggaaaccccatctgcctctcgcaagcagaacttaatgatctccccgtgttggattccatcatcaaggaatcacttcggctctcttccgcatcgcttaacattagaaccgcaaaggaagatttcactctgcacttggaggacggctcgtacaacatccgtaaggatgacattatagcgctctaccctcagcttatgcatcttgatccagaaatctaccctgatccccttactttcaagtacgataggtaccttgatgaaaacggcaaaaccaagactaccttttactgcaatggactgaagctgaagtactactacatgccattcggctcgggagcaaccatctgcccaggacgcctgtttgcaatccatgagatcaagcaatttctgatcctgatgttgtcctactttgaacttgaactcattgaaggtcaggcaaagtgtcccccgcttgaccaatcacgtgctgggcttggaatccttcctcctcttaacgacattgaattcaagtacaaattcaaacatctg

SEQ ID NO: 249878 - DNA, 1512 bp, Artificial Sequence
  Description of Artificial Sequence: Synthetic coding sequence
atgatgaccacttccctgatctggggaatcgccatcgcagcctgctgctgcctgtggctgatcctgggaatcaggagacgccagacgggggagccaccactggaaaacggactgatcccctacctcggctgcgccctgcagtttggtgctaacccactggagtttctgagggcaaatcagcgaaagcacggacacgtgttcacctgcaaacttatgggaaagtatgtccactttatcaccaacccactctcgtatcacaaggtcttgtgccacggtaagtacttcgactggaagaagttccacttcgcgacctcagccaaggccttcggacatcgaagcatcgatccgatggacggaaacactactgagaatatcaacgacacgttcatcaaaaccctgcaggggcatgcactgaacagcctgactgaatctatgatggaaaacctgcagagaatcatgaggccgccagtctccagcaattcaaagactgctgcgtgggtcaccgaaggtatgtacagcttctgctaccgggtgatgttcgaagcgggttacctcactattttcggaagggatctgacccgccgcgatacccaaaaagctcatatccttaacaatttggacaactttaaacaattcgacaaagtgttcccagctctcgtcgcgggactgcccatccatatgttcagaaccgcccacaatgctcgcgaaaagttggcggaatccctgagacacgagaaccttcagaagagagagagcatctcggagctgataagcctgcgcatgttcctcaatgacacgctctcaaccttcgatgatctggaaaaggccaaaacccatcttgtcgtcttgtgggcatcgcaagctaatactattccggcaaccttttggtccctgttccaaatgatccgcaatccggaggcgatgaaggcagccactgaagaagtgaagcggaccctggagaacgcaggtcagaaggtgtcattggagggaaacccgatctgcttgtcccaggccgaattgaacgatctcccggtgctcgactcaataatcaaagaatcccttcggctgagctcggcctcgctgaatatcaggacggcgaaggaggattttacgctccaccttgaggacggctcatacaacattcgcaaggacgatatcatcgccctgtatccgcaactgatgcatctggaccctgaaatctacccggatccactcactttcaagtacgaccgctaccttgatgagaatggaaagaccaagactaccttctactgcaacggactcaagctgaagtactactacatgccgttcggctcgggtgctaccatatgcccgggaagattgttcgcgatccacgaaatcaagcagtttcttatcctgatgctttcatactttgagctggaacttatcgaaggacaggcaaagtgtccacctctggatcagagccgggcgggcttgggtattctccctcccctcaacgacattgagttcaagtacaagtttaaacacctg

SEQ ID NO: 249879 - DNA, 1512 bp, Artificial Sequence
  Description of Artificial Sequence: Synthetic coding sequence
atgatgactacttcccttatctggggaatcgccatcgctgcctgctgttgtctgtggctgatcctcggaattcgcaggcgccagaccggtgagcctccacttgagaacgggctcattccatacctcggctgcgccttacaattcggagctaatcccttggaattcctgcgagcaaatcagcgtaaacacggacacgtcttcacctgtaagcttatggggaaatacgtgcactttataacgaatcccctgtcttaccacaaggtcctgtgccacggaaaatactttgactggaagaaattccactttgctaccagcgcaaaggcctttggccacaggtccatagaccccatggacgggaataccacggaaaacatcaacgataccttcattaagaccctgcaggggcatgcgctgaactccctgaccgagtcaatgatggagaatctgcaaaggataatgcgacctcccgtgtcttccaacagcaaaacggcggcctgggtgactgagggaatgtacagcttttgctaccgggtcatgttcgaagccggttatctgactatcttcggcagagacctcacaaggcgcgacactcagaaggcccacattttgaataacctagacaacttcaaacagtttgataaggtcttcccagcactcgtggcgggccttcctatccacatgttcaggacagcccacaacgcaagggagaaattagctgaaagtcttaggcacgaaaacctgcagaaacgcgagagcatatctgagcttataagtctgcgcatgtttttaaacgacacccttagcaccttcgatgatttggaaaaggctaagacccatttggttgttctgtgggcctctcaagccaacactatccccgctaccttctggtccctcttccagatgattaggaacccagaagccatgaaggccgcaaccgaagaggttaagagaacgttggaaaatgctggacagaaagtgtctctcgaaggcaacccaatctgtctaagccaagctgagctcaatgacctgccagtgctggattccataatcaaagagtcccttagactgtctagcgcgtctctgaatatccggaccgctaaggaagatttcaccttgcatctggaggatggctcatacaacatccgaaaggatgatattatcgccctatacccccagctgatgcacctggaccctgaaatttaccccgatcctctgaccttcaaatatgatcgttatttggatgaaaacggcaaaacaaaaaccactttttactgcaatggccttaaactgaagtactattacatgccgtttggatcaggggccactatatgcccgggcaggttgttcgccattcatgagatcaagcagtttcttatcctcatgctgagctatttcgaactggaactgatagaggggcaggcgaagtgcccccccctcgaccagtcacgtgcagggctaggaatcctgccacctttaaatgatattgagttcaaatacaagttcaagcactta

SEQ ID NO: 249880 - DNA, 1512 bp, Artificial Sequence
  Description of Artificial Sequence: Synthetic coding sequence
atgatgacgacctccctgatatggggaattgcaatcgccgcctgttgttgcctttggctgatcttaggcatcaggcgacgtcagactggcgaaccaccactcgaaaatggacttattccatatctcggatgcgccctgcagttcggcgcaaatcccttggagttcctgcgggcaaaccagcgaaagcacggacacgtgttcacgtgtaagcttatgggcaagtatgtgcactttattacgaacccactgtcatatcacaaggtgttgtgtcatggaaagtacttcgattggaaaaagtttcatttcgcaacaagtgctaaggctttcggacacaggtcaattgatcccatggacgggaatacgacagagaacataaacgacaccttcatcaaaacgttgcaaggacatgccctgaattcactgactgagtcaatgatggagaatttgcaaaggattatgcgtccaccagtgtcttcgaattcaaagacggctgcttgggtgactgaaggaatgtatagcttttgctatcgtgtgatgttcgaagccggatatttgactatcttcgggagagatctcacacggcgggacacgcaaaaagctcacattctgaacaacctcgacaattttaagcagttcgataaggtgttcccagctctggtggctggcttgcccattcatatgtttcgtacagctcacaatgccagggaaaagttagctgaatccctgcgtcacgaaaacctccagaaacgggagagcatttcagaactgataagcttgcgaatgttcctgaacgatacactctctacttttgacgatcttgaaaaggcaaagacccacctggtggtgctgtgggcaagtcaggcaaataccatccccgctacattttggagcctgtttcagatgatcaggaaccccgaggcaatgaaagccgctacggaagaagtcaaaagaacacttgaaaatgctggccagaaggtctccttggaaggaaatccgatctgcctgtcccaggctgagctaaacgacttgcccgtgctggacagcataatcaaggagtcgctgcgattgtcgagcgctagcctaaatatccggaccgctaaagaggacttcaccttacacctggaggacggaagctataatatcagaaaggacgacatcatagctctatatccccagctgatgcacctcgatcctgagatctacccagatcccctgacttttaagtatgataggtacttggatgagaatggcaagactaagacaaccttctactgcaacggccttaaactaaagtattactatatgccctttgggagtggagccaccatttgtccaggcaggctcttcgccatccatgaaattaagcaatttctaatcctgatgttatcctactttgaacttgaacttattgaggggcaagccaagtgccccccactcgatcagtcaagagccggcttaggtattctacctccactgaacgatatcgagttcaaatataaatttaagcacctc

SEQ ID NO: 249881 - DNA, 1512 bp, Artificial Sequence
  Description of Artificial Sequence: Synthetic coding sequence
atgatgaccacaagccttatttgggggatagcgatcgccgcatgctgttgcctgtggctcatccttggcatcagacgcaggcagacaggcgagccgcctcttgaaaatggcctgatcccgtatctgggatgtgcacttcagttcggggcgaaccccctcgagttcctgcgcgcgaatcagagaaaacacggccatgtatttacatgcaagcttatgggaaagtatgtgcacttcattacgaatcctctgtcttatcataaggtactttgtcacgggaaatattttgattggaagaaattccactttgcgacaagtgccaaagccttcggccaccgcagtatcgaccctatggatggaaatacgacagagaacatcaacgacacttttattaaaactctgcagggtcacgctttgaactctttgactgagagtatgatggagaacctgcagagaatcatgaggccgcccgtctctagcaatagtaagactgctgcatgggtcacggaaggcatgtattctttttgctaccgggtcatgtttgaagctggctacctgacgatctttggtagggatcttacccggagggacacacagaaggctcacatactgaataacctggacaactttaagcagtttgataaggtctttcctgccctggtggcggggttgcctatacatatgttccgaacggcccataacgctagagagaagttggctgagagtctgagacatgaaaatctgcagaaaagggagtcaatatctgaacttataagcctgaggatgttcttgaacgacactctgtcaaccttcgacgatctggaaaaagccaaaacacatcttgtagtactgtgggcttcccaggctaatacgatccccgccacattttggtctctcttccagatgatccggaacccggaagcgatgaaagccgccactgaggaagtgaagagaacccttgagaacgccggccagaaggtgtcccttgaagggaatcccatttgtctttcacaagccgagctcaacgacctgcccgtcctggactccattattaaagaatccttgcgcctttccagtgctagtctgaacatcagaacggccaaagaagacttcaccctgcacctcgaagacgggtcatacaacatccggaaagacgacattatcgctctctacccccagctcatgcatctggaccctgaaatataccctgacccactgacctttaaatacgatcgctacctggacgaaaatggaaaaacaaaaacaacgttttactgtaatgggctcaagctgaaatactactatatgcccttcggctccggagcgacaatatgtccaggccggctcttcgcaatacatgagattaagcagttcctcatcctcatgctgtcctatttcgagctcgagttgattgagggtcaggccaagtgccctccccttgaccaaagcagggccggattgggcatactgccacctctgaacgatattgaattcaagtacaagttcaaacacctc

SEQ ID NO: 249882 - DNA, 1512 bp, Artificial Sequence
  Description of Artificial Sequence: Synthetic coding sequence
atgatgaccaccagcttaatatgggggattgcaatcgctgcctgttgctgcctgtggcttatactgggaatccgtcgccggcagaccggggagcctccattagagaacggactgatcccttacctgggttgtgcattgcagttcggcgccaatccgctggaattcctgagggcaaatcagcgcaaacacgggcatgtgtttacctgcaaactcatgggtaaatatgtccactttatcaccaaccctctgagctaccataaagttctgtgtcatggcaagtattttgactggaagaaatttcacttcgcaaccagcgcaaaggccttcggacaccgcagcatagacccaatggatggtaataccacggagaatatcaatgatacgttcatcaagactttgcaaggacatgccctcaactcattgaccgaaagcatgatggagaacttgcagcggattatgcgaccgcctgttagcagcaattctaagaccgcggcgtgggttactgagggcatgtatagtttttgctatcgcgtcatgttcgaagcgggttacctgaccatcttcggtcgcgacttgacgcgtcgggacacgcagaaggcgcacatattgaataacctggacaacttcaagcaattcgataaggtttttccagcccttgtggcgggtctgcccattcacatgtttaggacggcacacaatgcccgcgaaaagctagctgaatccctgcggcatgaaaacctgcagaagcgtgagagcatcagcgagctcatctctctccggatgtttctgaacgacaccctctccactttcgacgatctggagaaagccaagacacacctggtggtgctgtgggcatcgcaagcaaatactatcccggccactttctggtctctgttccagatgatccggaatcctgaggcgatgaaagcggccaccgaggaagtaaagcgtaccttagaaaatgcaggccaaaaggttagcttggagggcaacccaatttgtctgagccaggctgagctgaatgatctgcctgttttagattcaattatcaaggagagcctgcgtctgtcctccgcctcccttaacattagaaccgcgaaggaggattttactctgcatctggaggatggtagctacaatatccgcaaagacgacatcatcgcactttatccccaactgatgcacttggaccctgagatctatccggacccgctgacgtttaaatacgaccgttacttggatgaaaatggtaaaaccaaaactacattctattgcaatggtcttaaactgaaatactattacatgccttttggtagcggtgcaacgatctgtccgggtcgtctgttcgcaatacatgaaatcaaacaatttctgatcttaatgctatcctacttcgagcttgagctgattgagggtcaggcgaagtgcccgccactggaccagtcccgggctggtctgggcattctgcctcctttgaatgatattgagtttaaatacaagtttaagcatttg

SEQ ID NO: 249883 - DNA, 1512 bp, Artificial Sequence
  Description of Artificial Sequence: Synthetic coding sequence
atgatgacaacaagtttgatctggggtattgctattgcagcctgttgttgtttgtggctgatattagggattagacggaggcagaccggagaacctccacttgagaatgggttgatcccatacttaggttgtgctcttcagttcggcgccaatccactcgagttcctgagagccaaccagcggaaacacggacacgtgttcacctgcaaactaatggggaagtacgttcattttataaccaacccgctctcataccacaaggttttgtgtcacggcaagtattttgattggaagaaattccacttcgctacatccgccaaagcctttggtcatcgctcaattgatccaatggatggtaacaccaccgagaatataaatgatacattcattaaaactctacaaggtcacgcactgaactctttgaccgagtctatgatggaaaatctccagaggatcatgcgccctcccgtgtcatctaattcaaaaacagccgcttgggtcaccgaggggatgtattcgttttgttaccgggttatgtttgaagctggctacctcaccatcttcgggcgggacctgacaaggagagacactcaaaaggcacatattctaaataacttggacaatttcaagcagttcgacaaggtgttcccggctctagtcgccgggctccccatacatatgtttcgcacagcacacaacgctcgtgagaagttagccgaaagtctgcggcacgagaacctccagaagcgcgagagtatttctgagttgatttcgctgaggatgtttctcaacgatacactgagcacgtttgacgacttggagaaggccaaaacgcacttggtggttctctgggcaagccaagccaatacaatcccagccaccttctggtccctgtttcagatgatcaggaatcctgaagcaatgaaagccgctactgaagaagtgaaacggaccctggagaatgccggacagaaagtgagcctggagggcaatcccatttgtttaagccaagcggagttaaacgacttgcccgtgctggatagcatcattaaggaaagtcttcgtctgtcaagcgctagtcttaacatccgtacagcgaaagaggatttcactttgcacctcgaggatgggagttacaatattcggaaagatgatataattgcactttatccgcagctcatgcacctggaccctgaaatttaccctgacccgttaactttcaaatacgaccggtatctggacgagaatggcaaaactaaaaccacgttttactgtaatgggctgaaattaaagtactactatatgcctttcggctccggcgccacaatttgtccgggtaggctgtttgctatccatgaaatcaaacagttcttgatcttgatgctatcttactttgaacttgagctcatagaaggtcaggctaagtgtccaccattggaccagtcgagagccggacttggcatactgccgcccctgaatgatatcgagttcaagtataaatttaaacattta

SEQ ID NO: 249884 - DNA, 1512 bp, Artificial Sequence
  Description of Artificial Sequence: Synthetic coding sequence
atgatgaccacctcgctcatctggggcatagccattgccgcgtgctgttgtctgtggttgatcctcggcatcagacgacgacagaccggggaaccaccccttgagaacggacttattccctacctcggctgtgccctgcagttcggagcaaacccccttgagtttcttcgtgccaaccagcgcaagcatgggcatgtgttcacctgtaagctcatgggcaagtacgtgcactttatcaccaatcctttgtcataccataaagtgctgtgccacggaaaatactttgattggaaaaagtttcatttcgcaacgagcgcaaaggcattcggacatcggtccattgatccgatggacggcaataccactgaaaacataaacgacacgtttatcaaaacgcttcaggggcacgcactcaactcccttaccgaaagcatgatggagaaccttcaaagaatcatgcggccgccagtgagcagcaattctaagactgcggcctgggtgaccgagggtatgtactcattttgttacagagtgatgttcgaagcgggttaccttacgatttttggcagggaccttacccgccgggatacccaaaaggctcatatccttaacaaccttgacaactttaagcagtttgacaaagtgtttcccgcccttgtcgccggactcccaattcacatgtttagaactgctcataatgcacgcgagaagttggccgaaagcctccggcatgagaatctgcagaagagggaatccataagcgaactgatctcgctgcgcatgtttcttaacgatactctgtcaacctttgatgaccttgaaaaagctaagactcacttggtggtcctctgggcatcgcaagctaacaccatacctgcaaccttttggtcgctttttcaaatgattaggaatccagaggcaatgaaagcagctacggaagaagtgaagcggacccttgaaaacgccggacaaaaagtgtcacttgaaggaaaccctatttgtctttcacaagcagagctgaatgatctgcctgtgttggactcgattatcaaggaatccctgagacttagctccgcatcactcaacattcgtactgcaaaggaagattttactcttcatctggaagatgggtcatacaacatcaggaaggatgacattattgccctctacccccagcttatgcatctggatcctgagatctaccccgacccactgacgttcaaatacgatcgctacctggacgagaacggcaaaaccaagactaccttttactgtaatggtctgaagctgaaatactactacatgcctttcggcagcggcgcgacgatctgtccagggcgcctgtttgcaattcacgagattaaacaattcttgattctcatgctcagctacttcgagctggagctgatagaaggacaagcgaaatgtcctccactcgatcagtccagagcaggacttggtattcttccaccacttaacgatattgaattcaaatacaagtttaaacatctt

SEQ ID NO: 249885 - DNA, 1512 bp, Artificial Sequence
  Description of Artificial Sequence: Synthetic coding sequence
atgatgaccacgtcactgatctggggcatcgctatagcagcatgttgctgcctgtggctgatcctggggatacgccggaggcagactggcgagcccccactggagaacggactgatcccctacctgggatgtgccctccagtttggggccaaccccttggagttcttgagagccaaccagaggaagcacggtcacgtgttcacttgtaagttgatgggcaagtatgtgcacttcatcaccaatccactttcctaccataaagtcctctgccatggcaagtactttgattggaagaaattccactttgctacctctgctaaagctttcggccatagatctatcgaccccatggatgggaatacaacagagaatattaacgatactttcattaaaacactgcagggccatgccttgaactcattgactgagtctatgatggagaaccttcaaaggattatgcggccaccagtctctagcaactccaaaacagctgcctgggtaacagagggcatgtactccttctgctacagggtgatgttcgaagcaggttacctgaccattttcggccgggatctgaccagacgcgatactcagaaggcccatatactcaataacctggacaacttcaagcagtttgataaagtattccccgctctggttgcgggactgccgattcatatgttccgaaccgcccacaatgcacgggagaagcttgctgaatctctccgacatgagaatcttcagaagcgcgagagcatttccgagttgatcagcctcagaatgttcttgaacgacacactctcaaccttcgatgatctcgagaaggcaaagacccatttggtcgtgttgtgggcctcccaagctaacacaattcctgccaccttttggagtcttttccagatgatccgaaatcccgaagccatgaaagccgccactgaagaagtcaagcgaactcttgagaatgcaggacaaaaggtgtccctcgaggggaatcccatctgtttgagtcaggccgaactcaacgacctgcccgtcttggatagcatcatcaaagagagcctgcgcctgagttcagctagtctgaacattcgcaccgccaaagaggacttcacactgcatctggaagacggatcctataacatacgcaaagacgacatcatcgctctctatccccagcttatgcacctggacccagagatctaccctgacccactgacctttaaatatgaccgctacctggatgaaaatggcaagaccaaaacaacgttctattgtaatggtctgaagctgaagtattactatatgcccttcgggtccggagccactatttgcccaggacggctctttgccattcacgagatcaagcagttcttgatactgatgctcagttatttcgaactggaactgattgaagggcaagccaaatgtcctccactggatcagtctcgagccggactgggtatacttccgcctctgaatgacatcgagttcaaatacaaattcaaacatctg

SEQ ID NO: 249886 - DNA, 1512 bp, Artificial Sequence
  Description of Artificial Sequence: Synthetic coding sequence
atgatgactacttcactaatatggggaattgcaattgcagcatgttgttgtttgtggttaattttagggattcgaagaagacaaacaggtgaacctccacttgaaaatggacttattccatatctaggatgcgctttacaatttggagctaatccattagaatttcttagagcaaaccagagaaaacatggacatgtttttacatgtaaacttatgggtaaatatgtacattttattaccaatcctcttagttatcataaagttttatgtcatggaaaatattttgattggaaaaaatttcattttgctacttctgcaaaagcattcggacatagaagtatagatccaatggatggaaatactacagaaaatattaatgatacatttattaaaacacttcaaggtcatgctttaaattcacttacagaatcaatgatggaaaatcttcaaagaattatgagacctccagtatcttcaaatagtaaaacagcagcttgggttactgaaggtatgtattccttttgttatagagttatgtttgaagcaggatatcttacaatttttggaagagatttaacaagaagagatacacagaaggcacatattctcaataatttagataattttaaacaatttgataaagtatttccagcattagttgctggattaccaatacatatgtttagaacagctcataatgctagagaaaaacttgcagaatctttaagacatgaaaatctccaaaaaagagaatctatttcagaacttatttctttaagaatgtttcttaatgatacattgtcaacatttgatgatttagaaaaagcaaaaacacatttagtagtattatgggcatcacaagctaatactattcctgccacattttggagtttatttcaaatgattagaaatccagaagctatgaaggcagctacagaagaagttaaaagaactttagaaaatgctggtcaaaaagttagtcttgaaggaaatcctatttgtctttcacaagcagaattaaatgatcttccagttcttgatagtataattaaagaatctcttaggttaagtagtgcatctttaaatattagaacagctaaagaagactttacattacatttagaagacggaagttataatattagaaaagatgatattattgcactttatccacaattaatgcatcttgatccagaaatctatccagatccacttacttttaaatatgatagatatttagatgaaaatggaaaaacaaaaacaacattctactgtaatggacttaaacttaaatattattatatgccttttggatctggtgcaactatttgtccaggaagattattcgcaattcatgaaattaaacaatttcttattttaatgctttcatactttgaacttgaattgattgaaggacaagcaaagtgtccacctttagatcaatcaagagcaggattaggaattcttccaccacttaatgatatagaatttaagtataagtttaagcatctt

SEQ ID NO: 249887 - DNA, 1512 bp, Artificial Sequence
  Description of Artificial Sequence: Synthetic coding sequence
atgatgactacctcgctgatttggggtattgccattgccgcctgctgttgtctgtggcttattctcggaattcggagacggcagactggtgagccaccccttgaaaatgggctgattccttatttggggtgtgcactgcaatttggcgccaacccactggaattcctccgggcaaaccaacggaaacacggacacgtgtttacttgcaagctgatggggaagtacgtccatttcattactaacccactgtcctaccataaggtgctttgtcacggcaagtactttgactggaaaaagtttcattttgcaaccagcgcaaaggcattcggtcatcggagcattgacccaatggacggcaatacgaccgaaaacatcaacgatacctttatcaagaccctgcaaggacatgcacttaattcgcttacggaatccatgatggaaaaccttcaaagaataatgcgcccccctgtgtcgtcgaattcaaagactgcagcttgggtgacggaagggatgtactctttctgttaccgtgtgatgtttgaagcaggctatctgactatcttcggacgggatctgaccagacgtgatacccagaaggcccatattctgaacaatcttgataactttaaacagttcgataaagtgtttcctgcactcgtcgcaggacttcctatccatatgtttagaactgcccataatgcccgggaaaaacttgctgagtcccttagacatgaaaacctgcagaagagggagtcaatttccgaactcatttccctgagaatgtttctgaatgacactctgagcaccttcgacgatctcgagaaagcaaagactcatttggtggtcctttgggcatcccaagcgaataccatcccagccactttctggtccctctttcaaatgatcaggaatccagaagcgatgaaggcagcaaccgaggaagtgaagcgcaccttggaaaatgcaggccaaaaggtgtcgctcgaaggaaatcccatctgtctttcgcaggcggagctcaacgacttgccagtgctcgattccatcatcaaggaatcccttcggctctcttcagcgtctctgaacataagaactgcaaaagaggacttcactcttcacctggaagatggttcgtacaacatcaggaaagatgacatcattgctctctaccctcaactgatgcatcttgatcctgaaatctaccctgatccactcactttcaagtacgacagatacctcgatgaaaacggtaagacgaaaactaccttctactgtaacggacttaagttgaagtactactacatgcctttcggatccggcgcaactatttgtcctgggagactttttgccatacatgaaatcaaacaatttctgattcttatgcttagctactttgaactggagctcattgagggacaagcaaaatgtccgccgctggatcaatcgcgcgctgggctggggattctgcctccactgaatgatatcgagtttaagtacaagtttaagcacctg

SEQ ID NO: 249888 - DNA, 1512 bp, Artificial Sequence
  Description of Artificial Sequence: Synthetic coding sequence
atgatgaccacatctctgatttggggcatcgcaatcgccgcgtgctgttgtttgtggttgatactgggaattaggcgccgccagacgggtgaaccgccgctggaaaacggtctcatcccctacctcggctgtgccctccagttcggagctaacccactcgagttccttagagcgaaccaaagaaagcatggtcacgtgtttacctgtaaattgatgggcaagtatgttcattttatcaccaatcccctttcttatcacaaggtgctgtgtcacggcaagtatttcgactggaaaaagttccacttcgccacctcagctaaggctttcggacacagaagtatagaccctatggacggaaatactaccgagaacatcaatgacaccttcattaagaccttgcagggccatgctcttaactctttgacagagagtatgatggagaacctgcagcgcataatgaggccacccgtatcttctaattccaaaacagccgcctgggtgacagagggcatgtatagcttctgttacagagtgatgttcgaagcgggctatctgaccattttcggtagggacctgacgaggagggacacccagaaagctcatatcctgaataatttggacaattttaaacagttcgacaaggtgttcccggcgctcgtcgccggcctcccgattcatatgttcaggaccgctcacaatgctagagagaagctggccgaaagtcttagacatgaaaacctgcagaaacgcgagtcaatttccgaactgatctcccttcgcatgttcctgaacgataccctcagcaccttcgatgacttggaaaaggcgaaaactcacctggtagtcctgtgggcctctcaggctaacactataccggcgaccttttggtctctgttccagatgatcagaaacccagaggcgatgaaggccgctacagaagaagtgaagcgcacccttgaaaacgctggacagaaggtttcactggaaggcaacccaatctgccttagtcaggcagaactgaatgacctcccagttttggattctattatcaaagaatcattgagactctcctccgccagcttgaacatccgcaccgccaaggaggacttcacccttcacctcgaagacggtagttataacatcaggaaggacgatataattgccttgtacccacaactcatgcacttggatccagagatttaccctgatccccttacttttaagtacgacaggtacctcgacgagaatggcaagactaagactactttttactgcaacggactcaagctcaaatactactacatgccgttcggttctggagcgactatctgtcctggcagactgtttgccattcacgagatcaagcagtttctgattctcatgctgtcatattttgagctcgaactgatagagggacaggcgaagtgtccaccgcttgaccagtccagggccggtcttggtattttgccacctctgaatgatatcgagttcaaatataagttcaaacacttg

SEQ ID NO: 249889 - DNA, 1512 bp, Artificial Sequence
  Description of Artificial Sequence: Synthetic coding sequence
atgatgacaacgagcttaatttggggtatcgcgatagctgcatgctgttgcctgtggttaatcttgggtatccgtagaagacaaacaggcgagccgccgttagaaaatggtcttatcccgtacctaggatgcgccctccaatttggtgctaatccgcttgaattcttacgcgcgaatcaacgaaaacatggacatgtgttcacgtgtaaattgatgggaaaatacgttcattttatcacaaaccctttatcataccacaaagttctttgccatggaaaatactttgattggaagaaattccattttgcaacatcagcaaaagcgtttggccatcgtagcatcgaccctatggacggtaacacaacagaaaatataaatgatacttttatcaaaacactccaaggacatgccctgaattcccttacagaaagcatgatggaaaacttacagagaattatgcgacctccggtgagctctaacagtaaaaccgctgcgtgggtgaccgaaggaatgtatagcttttgctaccgagttatgttcgaggccggatacttaacaattttcgggcgagatcttacacgccgcgatacccagaaagcccatatcttgaataatcttgacaacttcaaacagtttgacaaagtatttcctgccttggtcgccgggctgccgatccatatgtttcgtacagcgcataacgctagagagaaattagcagaatcactgagacatgaaaatcttcaaaaaagagaatctatttccgaacttatcagcttacgtatgtttcttaatgacactttatctacgtttgatgacctggaaaaagccaagacacacttagtcgtgctttgggcatctcaagctaatacaatcccggctactttttggtccctttttcagatgatccggaatccggaagccatgaaggcggcgactgaagaagtgaagagaacacttgagaatgccggccaaaaagttagcttggagggaaatccaatttgcctttcgcaggcggagctgaatgatttacccgtgctagacagtattatcaaagagtcactccgtctgagtagcgcttctttgaacattcgcactgctaaagaagatttcaccttacacctcgaggatgggtcttataacatccggaaagacgatattatagcactttatcctcaacttatgcaccttgacccggaaatttaccccgatccgttaacgtttaaatatgaccgatacctggatgagaacggcaaaacgaagacgacgttttactgtaatggattaaagctgaagtattattacatgccgtttggcagtggtgcaacgatctgtcccgggcgactttttgctattcatgagatcaaacaatttcttatccttatgcttagttactttgaattagagcttattgagggacaagcgaaatgtccgccactggatcagtctagagccgggctgggaattcttccgcctctgaacgatatcgaatttaaatacaaattcaagcattta

SEQ ID NO: 249890 - DNA, 1512 bp, Artificial Sequence
  Description of Artificial Sequence: Synthetic coding sequence
atgatgaccactagtctaatctggggcatcgctatcgcagcttgctgctgtctgtggctgatactggggatccgacgtaggcaaacaggagagccaccattggagaatgggctcatcccttatcttgggtgtgccctgcaatttggcgccaaccctctggaatttctgagggcgaaccagcggaagcacgggcatgtgtttacttgcaagttaatgggaaagtacgttcactttattacaaatccgctttcctaccataaagttctgtgccacggaaaatacttcgattggaagaagttccattttgctacctctgcaaaggcgtttgggcaccggtcaattgacccaatggacggcaacacgactgagaatatcaatgatacattcattaaaacgctgcaaggccatgcccttaacagtcttacagagtccatgatggagaatctccagagaataatgaggcctccggtctctagtaactcaaagacagcagcctgggtgaccgagggtatgtactcattctgctatcgtgtcatgttcgaagcagggtacctcacaatttttggcagagaccttactagacgagacactcagaaagcacacattctgaataatctggataacttcaagcagtttgataaagtgtttccagccctggtggctggcttgccaattcacatgttccgcaccgctcataatgcccgtgaaaagttagcagaatccttgagacacgagaatctgcagaagcgggagtctatatcagagctcataagcctccgtatgtttctgaacgatacgctctctacctttgatgatctcgagaaggccaagactcaccttgtagtgctgtgggcctcacaagctaatactatacccgctactttctggtcactctttcagatgattaggaacccagaggctatgaaggcagccaccgaggaagttaagcgcacattagaaaacgctggacagaaggtgtccttagagggaaacccgatttgtctgtcccaggctgagcttaacgatctgcctgtgctggatagcatcatcaaagaaagtctaagactgagttcagcgagcctcaacattagaaccgcgaaggaagatttcaccctgcacctggaagacggctcttataatatacggaaagacgacatcatcgcactgtatccccaactcatgcaccttgacccagagatctatcctgatcctctaacatttaagtacgacaggtatttggatgaaaacggcaagaccaagacgaccttttattgtaacggcctaaagctgaaatattattacatgccgtttgggtccggcgccacaatttgccctgggcgcttgttcgctatccatgagattaagcagtttctaattttaatgctaagctattttgaactcgaactgatcgaaggccaggccaagtgccctcctctggatcaatcccgtgctggtttaggaatcctacctccactaaacgacattgagtttaaatataagtttaagcacctg

SEQ ID NO: 249891 - DNA, 1512 bp, Artificial Sequence
  Description of Artificial Sequence: Synthetic coding sequence
atgatgactaccagccttatttgggggattgccatagccgcatgttgttgcctttggttgatcttggggatacgccggcggcaaactggggagccacccttggaaaatgggcttatcccttaccttggatgtgcgttgcagtttggtgcaaaccctttggaattccttagagccaaccagagaaagcatgggcacgtgttcacgtgtaaactcatgggcaagtacgtgcatttcataaccaatcctctgtcctaccataaggtcttgtgtcacggcaagtacttcgattggaaaaagtttcactttgcaacttcagcaaaggcatttggacatcggagtatagaccctatggatggcaataccaccgaaaacattaacgacaccttcatcaagactctgcaaggccatgcacttaatagcctcactgagtcaatgatggagaacctgcagcgaatcatgcggccacccgtcagctcgaactccaagaccgcagcctgggttacggagggaatgtactccttttgttatcgggtgatgttcgaggccggttacctcactatctttgggcgcgacctgaccaggcgggatactcagaaggcacatattctcaacaacctggataacttcaaacaatttgataaggtttttcctgcactggtggcagggcttccaattcacatgtttcgcactgctcataacgcccgtgaaaaacttgctgaaagcctgaggcatgaaaacttgcagaaaagagagtccatttcagaacttatttcgctgcgaatgtttttgaatgataccctttcaacttttgatgacttggagaaagctaagacccacctggtggtgctttgggcaagccaagcaaacaccataccggcaaccttttggtccctttttcagatgattcggaatcctgaagctatgaaggcagcaaccgaagaagtgaagcgtaccctggagaacgcgggacaaaaagtctcacttgaaggcaaccccatttgcctttcgcaggcagaactcaacgacctcccggtgctggattccataatcaaagaatcgctgcgcctgtcgtcggcgtcattgaacattagaaccgccaaggaggactttactctgcatctcgaagatgggtcgtacaacatcaggaaggatgatatcattgccctgtacccacagcttatgcatctggatccggagatctaccctgatcctctcacctttaagtacgatcgatacctggatgagaatggtaagaccaaaaccactttctattgtaatggtcttaaactgaagtactactacatgccctttggcagcggtgcaaccatctgtccaggaagattgtttgccattcatgagataaagcagttccttatactcatgctctcgtatttcgagctcgagcttattgaaggccaagcaaagtgccccccattggatcagtcgagagcaggacttggaatccttcccccactcaatgatattgaattcaagtacaagtttaaacacctg

SEQ ID NO: 249892 - DNA, 1512 bp, Artificial Sequence
  Description of Artificial Sequence: Synthetic coding sequence
atgatgaccaccagcttgatctggggcatcgccattgccgcatgctgttgtctctggctcatacttggaatccggaggaggcagactggagagcctcccctcgaaaacggactgatcccctatttgggatgcgctctccaattcggcgccaaccctctcgagttcctgagagcaaaccaaaggaagcacggccatgtgttcacatgtaaactcatgggcaagtacgtgcactttatcaccaacccgctgtcatatcataaagtgctgtgccatgggaaatatttcgattggaagaagttccatttcgcaacatcagctaaagccttcggacacaggagcatagaccccatggacgggaacacaaccgagaacatcaacgatacatttatcaaaaccctgcaaggacatgcactgaacagtcttacagagtctatgatggaaaaccttcagaggatcatgcgtcccccagttagttctaactcgaagactgcggcatgggtaaccgagggcatgtacagcttttgctatagggtgatgtttgaagccggatacctgacaatcttcggcagggaccttacaagaagagacactcagaaggctcatattctcaacaacctggataacttcaaacagtttgacaaggtctttccggctttggttgccggactgcccatccacatgtttcgcaccgcgcacaacgcccgggagaagctggctgagtctctgcgccatgaaaacctacaaaaaagggaatcaatttccgaactcatttcactgcgaatgttccttaatgatacccttagtacttttgacgatctcgagaaggctaaaacccatctcgtggtattgtgggcttcccaggccaacacaatcccagctaccttctggagtctttttcagatgattcgaaacccggaggctatgaaggctgccacagaagaggtaaagcgcacactcgaaaacgctgggcagaaagtgtctctcgagggaaaccccatctgcctgtcacaggctgaactgaatgatctgcctgtcctggatagcatcatcaaggaaagcctgcgactgtctagcgcaagcctgaacatccgaacagctaaagaggacttcacactacacttggaggacggttcttacaacatcagaaaagatgacatcattgctctgtacccacagttgatgcatctcgacccagaaatctacccagatccactcacttttaaatacgatcgctacctggacgaaaacgggaagacaaagacaaccttctattgcaacggactcaaactgaagtattactacatgccgttcggcagtggagcaactatatgtcccggacgcctgtttgctattcacgaaatcaaacagtttcttatcctgatgttgagttacttcgaactggagctgatcgagggccaggctaaatgtcccccacttgatcaatccagggcaggcctcggaatacttcctcctctgaacgacatcgaatttaagtataagtttaaacatctg

SEQ ID NO: 249893 - DNA, 1512 bp, Artificial Sequence
  Description of Artificial Sequence: Synthetic coding sequence
atgatgactacgtcccttatatggggaatcgccattgccgcttgttgctgtctgtggttgattctcggcatccgacggcgacagacgggtgagccgccgctcgaaaatggattaatcccataccttgggtgcgctctccagttcggcgctaatccattggagttcctccgagcaaaccaacggaagcatggacacgtgtttacatgtaaactcatgggaaaatacgtacattttataacaaacccactctcctatcataaggtactatgtcacggtaaatactttgactggaaaaaattccacttcgctacttcagccaaagcattcggacatcggtcaattgatcccatggatggaaatacaactgagaatatcaatgatacctttattaaaacccttcaaggacatgccctgaatagtcttacggaaagcatgatggagaatctgcaacgaattatgagaccaccagtctcaagtaacagcaaaacagcagcttgggttactgagggaatgtattccttttgttacagagtgatgtttgaagcaggataccttaccattttcggtagagatttgacgaggagagatacacaaaaggctcatatcttgaataatttggataactttaaacagttcgacaaggttttcccagccttggttgcaggcctaccaattcacatgtttaggacagctcataacgctagggagaaacttgcggaatcacttcggcatgaaaacttgcaaaagcgagaatctatctcggagttgatctcactcagaatgtttcttaatgatacactttcaacgtttgatgacctcgagaaggctaagacccatctggtcgtcctctgggctagtcaagctaataccatcccggcaacattttggtctctctttcagatgatccgtaatcccgaggcgatgaaagctgctacggaagaagtgaaacggaccctcgaaaacgccggacaaaaggtgtcccttgaaggaaatcccatttgcctttcacaagcagaacttaacgatctgccggtattggactcgattattaaggagtcattgagactttcttctgcatctcttaacattcgtacagccaaggaggatttcacactccacctcgaagacggaagttataacattcgtaaggatgacattatcgcactgtacccacaattgatgcatttagatccagagatttatccggatccgcttactttcaagtacgatagatatcttgacgagaatggaaaaacgaagactacattctattgcaatgggttgaagctcaaatattattatatgccatttggatccggagctactatatgcccaggacgactatttgccatacatgagattaagcagtttttgattttaatgctgtcgtatttcgaattagaactcatagagggacaagccaaatgtccgccactggatcaaagtagagcaggacttggaattttaccacctttgaatgatattgaatttaaatataaatttaagcatttg

SEQ ID NO: 249894 - DNA, 1512 bp, Artificial Sequence
  Description of Artificial Sequence: Synthetic coding sequence
atgatgaccacctctttgatctggggtattgcgattgcagcttgctgttgcctgtggctcatcctcggcattcgacggcgccagaccggggagcctcctctggaaaatgggctgataccttatctggggtgtgctctgcaattcggggccaacccgcttgagttcctgcgggccaatcagagaaagcatggacatgtgttcacttgtaagcttatgggaaaatatgtccactttattacgaacccgctcagctaccacaaggtactttgccacggcaagtactttgactggaagaaatttcacttcgcaacttcagcaaaggctttcgggcatagaagcatagaccccatggatggaaataccaccgagaatatcaacgatacatttattaagactcttcaagggcatgcactgaatagcctgaccgaaagtatgatggaaaatttgcaaagaataatgagacccccagtctctagtaattcaaagaccgctgcatgggtgaccgagggcatgtactctttctgctatagggtcatgttcgaggccgggtacctgacgatttttggccgagacctgacacgaagagatacccaaaaggcacacattctgaacaatctggataactttaaacagtttgacaaggtttttccagccctcgttgccggactaccaatacacatgtttcggaccgctcataacgcccgggaaaagctggccgagagcctgcggcatgaaaatttgcagaagcgagagtcgattagtgaactaatctcattgcggatgttcctcaatgatactctctctaccttcgacgaccttgagaaggctaaaacacaccttgtggtgctgtgggcctctcaagccaatacgatacccgcaactttttggtctcttttccagatgatacgaaaccctgaggcaatgaaagctgctaccgaagaggtgaagcgaacgctagagaacgccggtcagaaagtgtcgctcgaagggaaccccatctgcctctctcaggccgagttgaacgatttgcctgtcctagacagtatcataaaggagtcgctaaggctctcctctgcttctctcaatatccggacagctaaggaggactttacactgcatctggaagacggttcatataacatccgaaaggacgatatcatcgccctatatccacaactgatgcatcttgatcccgagatctaccctgaccccctcacgtttaaatatgacaggtacctggacgaaaacggcaaaaccaagacgacattttactgtaatgggttaaaactgaagtactactatatgccttttggatctggcgcaaccatctgtccagggagattattcgcgatccacgaaataaaacagtttctgatcctgatgctgtcatacttcgagctggagctgatcgaagggcaggccaaatgcccccctctggaccagagccgtgcagggctgggcatactgccccctttgaacgacatcgagttcaagtacaaattcaaacacctg

SEQ ID NO: 249895 - DNA, 1512 bp, Artificial Sequence
  Description of Artificial Sequence: Synthetic coding sequence
atgatgacgacctccctcatctggggtattgcgatcgccgcctgttgctgcctctggcttatactgggcattcggagacgacaaactggggagccacctctggagaatggcctgatcccatacctcggctgcgctctgcagtttggagccaaccctctcgagttcctgagggccaaccagagaaagcatggccacgtgttcacctgtaagctcatggggaaatacgtgcactttatcaccaaccctttgagctaccacaaagtcctctgccatggcaagtacttcgactggaagaagttccacttcgcaacgtcggcaaaggcttttggtcaccggtccattgatccgatggatgggaacaccaccgaaaacatcaatgacacctttatcaaaactctccaaggacacgccttgaacagcctcactgaatcaatgatggaaaatcttcaaaggatcatgcgcccccctgtgtcctcgaactcaaagaccgcagcttgggtgaccgaagggatgtactcgttctgctatagggtgatgttcgaggctggatacctgactatctttggacgcgaccttacccggcgcgacactcagaaggcacatatcttgaacaacctggacaatttcaagcagttcgataaagtatttccagctctggtcgccggactccctatccatatgtttcggactgcccacaacgccagagagaagttggccgaatcccttcgccatgagaatctgcagaagcgcgagtccatttcggaactgatctcgctgcggatgttcctgaacgataccttgtcgaccttcgacgacttggaaaaggcaaagacccacttggtggttctctgggcgagccaggcgaacacgatcccggccactttctggtccctgttccagatgatcaggaatcctgaagcaatgaaggcggccactgaagaagtcaagcgaacgctggagaacgccggacagaaagtcagcctggaaggtaaccctatctgcctgtcacaagcagaattgaacgatttgccagtcctggactcgattatcaaggaatcgctgcgcctgtctagtgcgtcactcaatatccggaccgccaaagaggatttcaccctgcaccttgaggacggaagttacaatatcagaaaggatgacataatagcgctgtatccccaactcatgcaccttgaccctgaaatctaccctgacccgctcacgttcaagtacgatagatacctggacgaaaatggaaaaaccaagactactttctactgtaacgggctgaaactgaagtactattacatgccgtttggaagcggggcgaccatctgccctgggagactgttcgctattcatgagattaaacagtttctcatcctgatgctgtcctacttcgagcttgagctgatcgagggacaggctaagtgcccgcccctggatcaatccagagccggcctcggcatcctcccaccattgaatgatatcgaattcaagtacaaattcaaacatctg

SEQ ID NO: 249896 - DNA, 1512 bp, Artificial Sequence
  Description of Artificial Sequence: Synthetic coding sequence
atgatgactaccagcctcatctggggtattgccattgcggcgtgctgttgtttatggctcattctggggatccggaggagacaaactggtgagcccccgctcgaaaacggcctgatcccctaccttggatgtgccctgcagtttggagcaaacccccttgaatttctgcgggcgaatcaacggaagcatggccacgtgtttacctgtaaattgatgggcaaatatgtgcatttcataacgaatcccctgagctaccacaaagtactctgtcacggtaagtattttgattggaaaaagttccactttgccacctctgccaaggctttcggccacagatctatagatccaatggacggcaacacgaccgagaatatcaacgacacctttatcaaaacactccaggggcatgcgctgaactccctgacggaatccatgatggagaatttacaaagaatcatgcgccccccagtgtctagcaactctaagaccgctgcttgggtcaccgaggggatgtattccttttgttacagagtgatgtttgaggccggctatcttacaatcttcggacgtgatctgacaaggcgggatacccagaaggctcacatacttaacaacctggacaactttaaacagtttgacaaagttttcccggccttggtggcaggactccccattcatatgttccggactgcccataatgcccgcgaaaaactagcggagagtttgcgtcacgaaaacttgcagaagcgcgaatccatctctgaactcatctctctgcggatgtttctgaacgataccctgtccacattcgacgatttggagaaagctaagacccatttggtggtcctctgggcgagccaggcaaacacaattccagctactttttggagtctgttccaaatgatccggaaccccgaggccatgaaagctgcaacagaggaagtgaaaagaaccctggaaaacgcaggccaaaaggtgtccctggaaggtaacccaatatgcctgagccaagccgagctaaacgacctccctgttcttgactctatcatcaaggaatcactgcggctgtcctcagcatccctgaacattcgaaccgctaaagaggactttactctacatctggaggacggctcatacaacatccgcaaagatgacataattgctctgtatccccaactgatgcatttggatcccgagatctaccctgatcctctgacctttaagtatgacaggtacctagatgagaatggaaagaccaagactaccttctattgtaacggcttgaaactgaaatactattacatgccttttggaagtggtgccactatttgtcctggccggctatttgctatccatgaaattaagcagttcctaatactgatgctatcttacttcgagttggaactcattgaggggcaagcaaaatgccctcccttagaccaatccagagccgggttgggaattctgcctcctctcaacgacattgaattcaaatacaagttcaagcatctc

SEQ ID NO: 249897 - DNA, 1512 bp, Artificial Sequence
  Description of Artificial Sequence: Synthetic coding sequence
atgatgacaacttctcttatatgggggatcgccattgccgcctgctgttgtctttggctcattttgggcatccgcagaagacagaccggggaacctcccctcgagaatggcctgatcccatatctgggctgtgctctgcaattcggcgccaaccctctggaattcctgcgagccaatcagcgaaagcacggacatgtgtttacctgcaagcttatgggcaagtatgttcactttataactaaccccctgagttaccacaaggtgctgtgccatggcaaatactttgattggaaaaagttccactttgccacttctgcaaaggcatttggacacagaagcatcgatcctatggacggcaatactaccgagaacatcaatgatacatttatcaagactttgcagggtcacgcacttaactcattgacggaaagcatgatggaaaatctccaacggattatgcgaccgccggtctcctcaaactcaaagaccgcagcatgggtgacagaaggaatgtactccttctgctatcgggtgatgttcgaagcagggtacctcacgatttttggcagggatctcacgaggagagacactcagaaagcccatattttgaacaatcttgataacttcaaacagtttgataaagtttttcctgcattggtagcaggccttcccatacatatgttcagaacagcccacaacgctcgagaaaaattggctgaatctctgagacatgagaatctgcaaaagcgcgagtccatctccgagcttatatctctgagaatgtttctcaacgacacactgtccacctttgatgatctggagaaagccaaaacccatctggtcgtcctttgggcctcccaggctaacactattccagccacattttggtcattgttccagatgatccggaatccagaagctatgaaggccgcaacagaagaggtgaagcgcacgctcgagaacgccggccagaaggtgtccctggaaggcaaccccatttgcctgtcacaagctgagctcaacgacctgcctgtgttggatagtattataaaggagtccctgcgcctgagctctgccagtctgaatatccggactgccaaggaagatttcaccctgcacctggaggacggcagttataatattcgaaaagacgatatcatcgcgttgtacccccagctcatgcacttggatccagaaatttacccggacccccttacattcaagtacgatagatatctcgacgaaaacggtaaaacaaagaccaccttctattgcaatggcctgaagctgaagtactactacatgccttttggaagcggtgctactatttgtccaggtagactgtttgccatccacgaaattaagcagttcttgatcttgatgctgagctatttcgagctcgagctcattgaagggcaggcaaagtgtcctcccctggaccagtctagggctggacttggtatcctgccgcctttgaacgatatcgaattcaaatacaagttcaagcatctt

SEQ ID NO: 249898 - DNA, 1512 bp, Artificial Sequence
  Description of Artificial Sequence: Synthetic coding sequence
atgatgacaacatctttgatttggggcattgccatcgcagcctgttgctgcctgtggctcattctggggatcaggagaaggcagacaggagagccacccctagagaatggtctgattccctatctgggctgcgcgctgcagtttggagcaaatcctctagagttcctgcgcgccaaccagaggaagcacggacatgtatttacctgtaaactgatgggaaagtatgtgcactttatcacgaacccgctcagttatcataaggtattatgccatggaaagtatttcgattggaagaaattccactttgctacgtcagctaaggcattcggacacagaagtatcgaccctatggatggtaatactaccgagaacatcaacgatacatttattaagaccctgcagggacatgccctgaacagtctgacagagagtatgatggagaacttgcagcgaattatgcgaccacctgtgtctagcaactctaagaccgctgcttgggtgactgagggcatgtattcattctgctaccgagtcatgttcgaagcaggataccttactatattcggtagagacctgacacgacgcgatacccagaaagcgcatatattgaacaatctcgataacttcaagcaatttgacaaggtcttcccagccttggttgcaggactgccgattcacatgttcagaacggcacacaatgccagagagaagttggcagaaagtctgagacatgagaacctacaaaaaagagagagcatatctgagctaatctctctgcgtatgtttctgaatgatacacttagcacatttgatgacttggagaaagccaaaacccatcttgtcgtgctgtgggcgtcgcaggcaaacaccatccccgccaccttctggtcgctgtttcaaatgattaggaatccggaggccatgaaggccgcgaccgaagaagttaagcggactctggaaaatgcgggtcagaaagtcagcctcgaaggtaatcccatctgcttaagccaggcagagcttaatgacttgcctgtcttggactccattattaaagagagtctacgactcagctcagccagccttaatattagaacagccaaggaggacttcaccctccatctggaggatggaagttataacatcagaaaggacgatatcatcgcattgtacccgcagctgatgcacctggatcctgagatctaccccgatcccctgaccttcaaatatgaccgctaccttgacgaaaatggcaaaacaaagaccactttctactgcaacggactgaagctgaaatactactacatgccattcggaagtggagccacgatatgccccggtaggttattcgcaattcacgaaatcaagcagtttttgattctgatgttgagttattttgagttggagttgatcgaaggccaggctaagtgtccacccctagaccagtcgagggcgggtctcgggatactgcctccactcaatgacatagaattcaagtataaatttaaacatctg

SEQ ID NO: 249899 - DNA, 1512 bp, Artificial Sequence
  Description of Artificial Sequence: Synthetic coding sequence
atgatgaccacctccctgatttggggcattgcgattgccgcgtgctgttgcctttggcttatccttggtatccgtcgaaggcaaaccggggaaccgccccttgaaaatggacttatcccatacctgggttgtgctcttcagtttggtgcaaacccccttgaatttcttcgagcaaatcaaagaaagcacggtcacgttttcacttgtaaactgatgggcaagtacgtgcatttcattacgaaccccctttcctaccataaagtgctttgccatggaaagtactttgactggaagaagtttcattttgctacttccgccaaggcattcggacaccgatctattgaccctatggatggcaatacgaccgaaaacataaacgacacttttatcaaaactctgcaaggccatgcactgaattcgctgaccgagagcatgatggaaaatctccaacgtatcatgcgaccacccgtgtcctctaacagcaagaccgctgcatgggtgaccgaaggaatgtattccttttgttacagagtgatgtttgaagccggttacttgacgatctttgggagagatctgacccgacgcgatactcaaaaggcgcatattctgaacaatcttgacaatttcaagcaatttgataaggtgtttccagctttggtggccggcttgccaatccatatgttcaggaccgcgcacaacgcacgggaaaaacttgccgagtcgttgcgccacgaaaacttgcagaagcgggaaagcatatccgagcttatctcgttgagaatgtttcttaacgatactctgtcgacttttgatgatctggagaaggcaaagacccatctggtggtgctgtgggcctcgcaagcaaatactataccggcaaccttctggagcctttttcagatgatccgaaatcctgaagccatgaaagccgcaactgaagaagtcaaaagaactttggaaaacgcgggccaaaaggtgtccctcgaaggaaatcccatatgtctttcgcaggctgagctgaatgaccttcctgtgcttgactcaattatcaaggaaagccttcggctttcctcagcaagcctgaacatccgcaccgcaaaggaggattttacccttcacctcgaagatggatcatacaacatcaggaaggacgatatcattgcgctgtaccctcagctgatgcatctcgatccagagatatatcctgatcccctcacttttaagtacgaccgttatcttgacgagaatggcaagaccaagaccacgttttactgtaatggactgaagttgaagtactactatatgccattcggatcgggtgcaaccatttgtccaggtagactctttgccatacacgagatcaaacaattccttattctgatgcttagctactttgagctcgaattgatcgaaggtcaggctaaatgccctccgctcgatcaatcaagagccggcctcggtatcctgccaccactgaacgatatcgaattcaagtacaaattcaagcacctc

SEQ ID NO: 249900 - DNA, 1512 bp, Artificial Sequence
  Description of Artificial Sequence: Synthetic coding sequence
atgatgactaccagtctaatctggggaatcgccattgctgcgtgctgctgtctgtggctcatactgggaatacgcagacgccaaaccggggaacctcctctagaaaatggcctgatcccctatctcggttgcgccctgcagtttggagccaatcccctcgagtttctgagggccaaccaaagaaagcatggacatgtctttacttgtaaactgatggggaagtatgtgcactttatcaccaaccccctgtcctaccacaaagttctgtgtcatggtaagtacttcgactggaagaaatttcattttgcgacctcagctaaagccttcgggcatagaagcatcgatcctatggatgggaacactacagaaaatattaacgacacattcatcaaaactctccagggccacgctctcaactctttgacagagtccatgatggagaacctccagcggataatgcgtcctccggtcagttcaaacagtaagacggctgcatgggtgacggagggtatgtactccttctgctatcgagtcatgttcgaagctggatacttgacaattttcggtcgagacctgactcgaagggacactcagaaagctcacattctcaacaacctcgataacttcaaacagtttgacaaagttttccctgccctggtagctggattacctattcacatgttccgaaccgcgcataatgcccgagaaaagctggcagaatcactacgacatgagaatctacagaaacgagaatctatatctgagctgattagcctgcgaatgttccttaatgataccctgtccacattcgatgacttggagaaagccaagacccatctggtcgtcctatgggcttcccaggcaaatacgattcccgcgaccttttggtctctgtttcagatgatacgaaatccagaggcaatgaaagcagcgaccgaagaagtcaagaggaccctggagaacgcaggtcagaaagtcagccttgaaggcaacccaatttgcctcagccaggctgagctcaacgatctgccagtgttggacagtatcattaaggagtctttgaggttgagctccgcctcgctcaatatcaggacggctaaggaagattttacgctccatctcgaagacggaagctacaatatcaggaaggacgacataatcgctctgtacccccaactgatgcacctggatcccgagatatatccagatccattgacttttaagtacgataggtatttggatgaaaatggtaaaaccaagaccaccttctactgcaatgggctgaagctgaagtactactacatgccattcggcagtggcgccaccatctgtcccggaagactgtttgccatccatgaaatcaagcagttccttatcctgatgctgtcctacttcgaactggagttaattgagggtcaggccaagtgtcctcccctcgatcagtcccgagctgggttgggcatcctcccccccttaaacgatatagagtttaagtacaagttcaaacacctc

SEQ ID NO: 249901 - DNA, 1512 bp, Artificial Sequence
  Description of Artificial Sequence: Synthetic coding sequence
atgatgacaaccagcctgatctgggggatcgcgatagccgcatgttgctgcttgtggctgattctgggtattcggcgccgacagactggtgagccaccactggaaaatgggctcatcccgtatttaggctgtgccctgcagttcggcgctaaccctctggagttcttaagagcaaatcagagaaaacacggccatgtgtttacttgcaagctgatgggtaagtatgtccattttatcaccaacccgttatcttaccacaaggttctctgccatggtaagtatttcgattggaagaagtttcatttcgctacatctgccaaagcgttcggccatcggagcattgatccaatggacggtaatactacagagaacataaatgatactttcatcaaaacactccaagggcacgcccttaactctttaacggaaagcatgatggaaaacttgcagcgaatcatgcgtcctcctgtcagcagtaattctaaaaccgcggcttgggtgacagagggaatgtactctttctgctatcgggtgatgttcgaggccggttatcttaccattttcggtcgtgacctgacaaggagagacacccagaaggcccatatcctcaataatctggataactttaagcagtttgataaagtatttcctgcactggtggccggcttgcctatccacatgtttagaaccgctcacaacgcacgcgagaaacttgccgaatcactcaggcacgagaacttacagaagcgcgaatcgatcagtgagctcatctccttgaggatgtttctgaacgacaccctgagcacattcgacgatctggagaaagccaagactcatctggtggtactgtgggcttcgcaggctaatacaattcccgccacgttttggtccctgtttcagatgattcgaaaccctgaagctatgaaagccgcgacagaggaagtgaagaggacactagaaaacgctggtcagaaggtgtcgctcgaggggaacccaatctgcctctcacaggcagagttaaatgacctcccagttctggatagtatcatcaaggagagtttgagactgtcttctgcttctctaaatatccggacggctaaagaggacttcacgcttcacttagaggatggttcgtacaatattcgtaaagatgatatcatcgcactttatccccaacttatgcacctggacccagagatctatcctgatcctcttacattcaagtatgaccgctaccttgacgagaatgggaagaccaaaacgactttttactgtaacggtctgaaactgaaatactattacatgccctttggctcaggtgcgacaatatgccccggcaggttgttcgccatccatgagatcaaacaattccttattctgatgctgtcctatttcgagctggagttgattgaaggtcaggctaaatgcccgcctctggaccagagcagagcaggattaggtatactccctccattgaacgacatagaattcaagtataaatttaaacatctg

SEQ ID NO: 249902 - DNA, 1512 bp, Artificial Sequence
  Description of Artificial Sequence: Synthetic coding sequence
atgatgaccacttctctcatctgggggatcgcaatcgccgcttgttgctgcttgtggctcattctgggaatccgccgacgccagaccggcgagccgccgcttgagaatggtctgatcccatacctgggctgcgctcttcagttcggagcaaacccgctggagttcctgcgcgcgaaccaaagaaagcatggtcacgtgttcacttgcaaactcatgggaaagtacgtgcacttcatcactaacccgctctcgtaccacaaggtgctctgtcatggaaagtacttcgattggaagaagttccacttcgctacgtctgccaaagcgttcggacatcgcagcatcgacccgatggacggaaatactaccgagaacattaacgacactttcatcaagaccctgcaaggacatgctctgaactcgctgaccgaatctatgatggaaaacttgcagcggatcatgcggccgcccgtttcgtcgaattcaaaaaccgccgcgtgggtgaccgagggaatgtattcgttctgctaccgggtcatgttcgaagctggatacctgactatcttcggacgtgacctgacccgcagagatacccagaaggcccacatcctgaacaatcttgacaacttcaagcagttcgataaggtgttcccagccctcgtggctggcctgccaattcacatgtttcggaccgcacataatgctcgcgagaagctggccgagagcctgagacatgaaaaccttcagaagagggaaagcatctccgaactgatcagcctgcggatgttcctgaacgacacgctgagtacctttgatgacctggaaaaggcaaaaacccatttggtcgtgctgtgggcatcccaggccaacaccatcccggctaccttctggtccctcttccaaatgattaggaatccagaagcgatgaaggcagccactgaagaggtgaaaagaaccctggaaaacgcaggacaaaaggtgagcttggaagggaatcccatctgcttgagccaggcagaactgaatgatctccctgtgctcgactccatcattaaagagtccctgagacttagctcagcgagcctgaatatcaggacggctaaggaggatttcacgttgcaccttgaagacggcagctacaacatccgaaaggacgacatcattgcactgtacccacagctcatgcacctggatcctgaaatctacccagacccactgaccttcaaatacgaccgctacctggacgagaacggcaaaaccaagaccaccttctactgcaatggactcaagctcaagtattactacatgccattcggatccggtgcgaccatctgccccggtagacttttcgctattcatgagatcaagcagttcctgatcctcatgctgtcgtacttcgaactcgagctcatcgagggacaggccaaatgcccacctctcgaccagtcacgggccggcctgggtatcctgcccccgctcaatgatatcgagtttaagtacaagtttaagcatctg

SEQ ID NO: 249903 - DNA, 1512 bp, Artificial Sequence
  Description of Artificial Sequence: Synthetic coding sequence
atgatgacaacatcactgatctggggcatcgcaatcgctgcctgctgttgcctctggttgatacttggtatccgccggcgccaaactggggagccacccctagagaatggattgatcccttacctgggctgcgctttgcaatttggggctaaccccttggagttcttgagagcaaaccagagaaagcacgggcacgtgttcacatgcaagctgatgggcaaatatgttcatttcataaccaatcctctttcctaccacaaggtgctgtgtcatgggaagtattttgattggaagaagttccatttcgccactagtgccaaggcctttggccataggtccatcgatcccatggacgggaataccacagagaacattaatgacacctttatcaaaacactgcaagggcacgccctgaatagcctgaccgaaagcatgatggagaacctccagagaattatgcggccccccgtgtcttccaattctaaaacagctgcatgggtgaccgaaggaatgtactctttctgttacagggtaatgtttgaggccggctacctaactatcttcggacgggacctgacccgcagagacacccagaaagcccacatccttaataacctggataactttaaacagttcgacaaggtgttccctgcactcgtggcgggcctgcctattcacatgtttcgcaccgctcataacgcccgcgagaaattggccgagtctctcagacatgaaaacctgcaaaagcgcgagtcaatatctgaacttatcagcctgcggatgttcctgaacgataccctgagcacctttgatgacttagagaaggccaagacacacctggttgtgttgtgggctagccaggctaacacgattccggccaccttttggtcactgttccaaatgatccgcaatcctgaggctatgaaggcggccacagaggaggtgaagcgaacgctggagaatgctggccagaaagtttcgctggaagggaatcctatttgcctgtcccaggctgagctgaatgacctcccagtcctggactcaattatcaaggagtccctacgactgtcatccgcatcactaaatatccggaccgctaaagaggatttcactctgcacctggaagatggctcctacaacattcggaaagacgatataattgccttatatcctcagctgatgcatttggaccctgaaatctatccagatccactgacctttaagtacgaccgttaccttgacgaaaatggaaagactaagaccacattttactgtaacgggttgaagctgaagtactactacatgcctttcgggagcggcgcgacaatctgtcctggacgtctgttcgccatacacgaaataaagcaattcctgattctgatgttgagctacttcgagttggagctgatcgaaggccaggccaagtgtcctcccctggatcagtccagagcagggctcggcattcttccacctttgaatgacattgaattcaaatataaattcaagcatctg

SEQ ID NO: 249904 - DNA, 1512 bp, Artificial Sequence
  Description of Artificial Sequence: Synthetic coding sequence
atgatgaccacttcgcttatttggggaattgcgattgccgcatgttgctgcctgtggctgatcttaggaattaggcgccggcagacgggtgagccccccctggaaaatggcctcatcccatacctgggatgcgcacttcagtttggtgcgaatccgcttgagttcctccgggcaaatcagcgtaaacatgggcatgtgttcacctgcaagctgatgggtaaatacgtgcactttattactaaccccctctcataccacaaggtgctctgccacggcaagtatttcgattggaaaaaattccacttcgctacctcagcaaaagcctttgggcatcgctccatcgaccctatggatggcaatactactgagaacatcaatgacaccttcataaagaccctccagggccacgccctgaactccttgaccgaatcgatgatggagaacctgcagcgcatcatgcgtccccctgtctccagcaattctaagactgccgcctgggtgaccgaaggaatgtacagtttttgctatcgagtgatgtttgaggcaggctacttgaccattttcggccgcgacctgacccggagggacacacaaaaggcccacatcctgaacaaccttgacaatttcaagcagttcgacaaagtgttcccagctcttgtggccggtctcccaatccacatgtttcgaacagcccacaacgcgagggaaaaactcgccgaatccttacggcatgagaatcttcagaaaagagagagcatttcagaactaatttcattgaggatgttcctgaacgatacgctctccacctttgacgacttggaaaaagcaaaaacccatctcgtggtgctttgggcatcacaagccaataccattcctgccaccttctggtctctgttccagatgatcagaaatcccgaggctatgaaggctgccacggaggaggtaaagcgcactttggaaaacgccggacagaaagtgtcactcgaagggaaccccatttgtctgagccaagcggagcttaacgacttgcctgttctggattccattatcaaagaaagtttgcggctttccagcgcgagcttaaacatcagaaccgcgaaggaggatttcactctgcatctggaagatggcagttacaacatccggaaagacgacataattgcattgtacccccagttgatgcacctggatcccgagatctaccctgatcccctcacattcaagtacgaccgctacctcgacgaaaatggcaaaaccaaaaccaccttttattgcaatggcctgaagctgaagtactactacatgccgttcgggagcggcgcaacgatatgcccaggcagactttttgccattcacgaaatcaagcaattccttattctgatgctgagctacttcgaattggaactcatcgagggccaagcgaaatgcccgccgctagaccagagccgcgctgggctcggaatcctccctccgttgaacgacattgaatttaagtataagttcaagcacctt

SEQ ID NO: 249905 - DNA, 1512 bp, Artificial Sequence
  Description of Artificial Sequence: Synthetic coding sequence
atgatgaccacgtcactcatttggggaatcgctatcgcggcatgctgttgtctgtggctcatcctgggaattcgcaggcggcaaaccggcgagccgcccctcgagaatgggctgatcccttacctcggatgcgccctccaattcggagcaaaccctctcgagttcctcagagctaaccagagaaagcacggccatgtgttcacctgcaaacttatgggaaaatacgttcatttcatcacgaatccactctcataccacaaggtcctgtgccacggaaaatactttgactggaagaagttccatttcgctacctcggctaaggcattcggacacagatccatcgacccgatggacgggaatactaccgaaaacatcaatgacaccttcatcaagaccctgcagggacacgccctgaacagcctgacggagtcaatgatggaaaacctccagcggatcatgcgcccgccggtgtcgtccaattcaaagaccgccgcctgggtgaccgaggggatgtactccttctgttaccgggtgatgttcgaagccggttatctgactatcttcggaagggacctgactaggagagacactcaaaaagctcatatccttaacaacctcgataactttaagcagttcgataaggttttcccggcactcgtggcgggactgccgatccatatgttccggaccgcccacaacgcaagggaaaagctggcggaatccttgagacacgagaatctccagaagcgggagtcaatctcggagctgatctccctgcgcatgttcctgaatgacacgctgagcaccttcgatgacctggagaaagccaagacccacctcgtggtgctgtgggcgtcgcaagctaataccattccggctaccttctggagcctgttccagatgatcaggaacccggaagcgatgaaggccgccactgaagaagtcaaacgcactctggagaatgctggacaaaaggtgtcactcgaaggcaacccgatctgcctctcccaggcagaacttaatgatctcccggtgcttgactcgattatcaaagaaagcctgagactttcgtcagccagtttgaacatcagaaccgccaaggaggactttactcttcatttggaggacggatcttacaacattcgaaaggacgacattatcgccctgtaccctcagcttatgcatctcgacccggaaatctacccggacccgttgaccttcaaatatgatcggtacttggatgaaaatggtaagactaagacgacgttctactgcaatgggctgaagctgaagtactactacatgcctttcggctccggcgccactatctgcccaggccggctgtttgccattcatgaaatcaaacagttcctgatcttgatgctgtcgtacttcgagctcgagctgattgaggggcaggctaaatgtccgccgctcgaccagtcaagagctggactggggatcctcccaccactcaatgatatcgagttcaagtataagtttaaacatctc

SEQ ID NO: 249906 - DNA, 1512 bp, Artificial Sequence
  Description of Artificial Sequence: Synthetic coding sequence
atgatgaccacctctcttatttggggcatcgcaattgcagcctgttgttgcctctggctgatcctgggtataaggcgaagacagaccggagaaccacctctcgaaaatggccttatcccctacctgggctgcgccctgcagtttggcgctaatcctcttgaatttctgcgagctaaccaaaggaagcacggacacgtgtttacttgcaagctgatgggcaagtatgtgcacttcatcaccaacccactaagctaccacaaagtcctgtgccacggaaagtactttgactggaaaaagtttcacttcgccacgtcagcgaaggctttcggtcaccggagcatcgacccaatggacggcaataccacagaaaacatcaatgataccttcatcaagacccttcagggccatgccttaaactcgttgacggagtccatgatggagaacctgcagcggatcatgaggcccccagtcagctctaactcgaaaacagcagcctgggtcaccgagggcatgtatagcttttgttatcgagtcatgtttgaagctggatatttaacgatcttcgggagagatctgacacgcagggatactcagaaagcccacatcctcaacaacctggataacttcaagcagttcgacaaggtgtttccagccctcgtcgccgggctacccatccatatgtttagaacagcccataacgctcgagagaagctcgcggaaagcctgagacacgagaatctgcagaagcgcgagagcatatccgaactcattagcctaagaatgttccttaacgatactctgagtacctttgatgatctcgagaaagctaagactcacctcgtggtgctgtgggcctctcaggcaaataccatccccgctacattttggtcactcttccagatgataaggaacccagaggcaatgaaggctgcgaccgaagaggtgaagagaacactggagaatgccggccagaaagtgtccctggaggggaacccaatttgtctgtcacaggcagaactgaatgacttacccgtgcttgactctatcatcaaagaatccctgcggctgtcctcggcctcactcaatatcaggacagcaaaagaggatttcacactccacttggaggacggcagctataacatccgaaaagatgatatcatcgcactgtacccacagctgatgcatcttgatcccgaaatctacccggatccactcacctttaaatatgaccgatacctggatgaaaatggaaaaacgaagactaccttctattgcaatgggttgaaactgaagtattactatatgccctttggcagtggagcaaccatttgcccagggcgcctctttgctatacacgagattaagcagtttcttatcttaatgctgagctatttcgaactcgagctgatcgaaggccaggccaaatgcccacccttagaccagtcccgcgctggattggggatcctgccccccctgaatgacattgagtttaagtacaagtttaaacatctg

SEQ ID NO: 249907 - DNA, 1512 bp, Artificial Sequence
  Description of Artificial Sequence: Synthetic coding sequence
atgatgactacgtctttaatttggggtatcgccatcgctgcctgctgttgcttgtggcttattctgggaataaggcgtcggcagactggggagcctccattggaaaatggattgattccatacttaggatgcgcgctgcaatttggtgccaaccctctggaatttctgcgcgccaatcagagaaagcatggacacgtttttacgtgtaagctgatggggaaatatgtgcactttatcacgaatccactatcttaccacaaggtgctatgtcatggcaagtattttgactggaaaaagtttcacttcgcaacctctgccaaggcttttggccaccgaagcatcgaccccatggacggcaatacaacagagaatatcaacgacacttttattaagaccctccaaggacacgctctgaactccttgacggagtccatgatggaaaacttgcaacgcatcatgcggcctccagtttcttctaactccaagaccgcagcctgggtcaccgagggcatgtactccttttgttatcgagttatgtttgaggccggatacctgacaattttcggcagggatttaacacggagggacacacagaaagcacacatcctgaacaatctggataacttcaagcagttcgacaaggtgtttccagcgctggtggccggactgcccatccatatgtttcgcaccgcgcataatgcacgggagaaactagccgaaagcctgaggcacgagaacctgcagaaaagggaatcaatctcggaacttatctccctgaggatgttcctgaatgacacccttagcacgttcgacgatctggagaaggccaagacccacctggtggtactgtgggcaagccaggccaatacaatccctgctacattttggagcctgtttcaaatgatcagaaaccctgaagcgatgaaagctgctaccgaggaggtgaaacggaccctcgaaaacgcgggccagaaagtgtctctggaaggtaacccaatctgcctctcgcaagccgagttaaacgacctcccagtactggactcgataattaaggaatcgcttcgcttaagttccgcgtctctgaacatcaggacagcaaaagaggatttcacgcttcacttggaagacgggtcgtataatatacggaaggacgatatcatcgcgctgtacccacagttaatgcatttagaccccgagatatacccagatcctctaaccttcaagtacgaccgctatttggacgagaacggtaaaactaagacgactttttactgtaacggcctgaagctgaagtactattacatgccattcggatctggtgcaacaatctgtcccgggagattatttgcaatccacgagataaagcaatttcttattctgatgctcagttactttgaactggaactgatcgagggccaggctaagtgtcccccactagatcaatcaagggccggacttggtattttgcctccattgaacgacattgaattcaagtataaatttaagcacctg

SEQ ID NO: 249908 - DNA, 1512 bp, Artificial Sequence
  Description of Artificial Sequence: Synthetic coding sequence
atgatgactacctcgcttatctgggggatcgctatcgccgcctgctgctgcttgtggctgatccttggaatccggcgccggcagaccggggagcctccgcttgagaacggactcatcccgtacttgggatgcgcgctccagttcggagcgaacccgcttgagtttctgcgggccaaccagcgaaagcatggacacgtattcacctgtaagctgatgggtaagtacgtgcacttcatcactaacccgctgtcctaccacaaggtgctctgtcacggaaagtacttcgactggaaaaagtttcattttgctacttcggctaaggcgtttggtcaccgttccatcgacccaatggacggaaacactactgagaatatcaatgataccttcatcaaaaccctccagggacatgccctgaactctctgaccgagtccatgatggaaaacttgcaaagaatcatgcgcccgcccgtgtcgtcgaattccaagaccgcagcgtgggttaccgagggaatgtactcgttctgctaccgggtgatgtttgaagcgggctaccttacgatcttcggcagagatctgaccaggcgggacactcaaaaggcccacatcctcaacaatttggacaacttcaagcagttcgacaaggtgttcccagcactggtggccggcctgccaatccacatgttcagaacggcacacaacgcgcgggagaaactcgcggaatcgttgcgccacgaaaatctccagaagcgggaatcgatctccgagctgatcagcctgcgaatgttcctgaatgacaccttgagcacctttgatgacctcgaaaaggccaaaactcatctggtcgtgctttgggcatcgcaggccaacaccattccagccaccttttggagcttgtttcagatgatcagaaatccggaggctatgaaggccgctactgaagaggtgaaacgcactttggagaatgcaggacaaaaagtgtccctggaaggcaacccaatttgcctctcgcaggccgaactgaacgatctgccagtgctcgatagcatcatcaaagaatcacttaggctgagctcggcgtcgctcaacatccgcaccgcaaaggaagattttaccttgcacctggaggacgggtcatacaatattcgcaaggacgacatcatcgccctgtatccacagctcatgcatctggaccctgagatttacccagatccattgaccttcaagtacgaccggtacctggatgaaaacggaaagaccaagacgaccttctactgcaatggcctcaagctgaagtactactacatgccgttcggatcaggcgcgactatctgtccaggaaggctcttcgccatccatgagatcaagcagttcctcatcctcatgctttcgtacttcgaactcgaactgatcgagggccaggccaagtgcccgccgctggaccaatcaagagcaggcctcgggatcctgcctccgctgaatgatatcgagttcaagtacaagttcaaacatctg

SEQ ID NO: 249909 - DNA, 1512 bp, Artificial Sequence
  Description of Artificial Sequence: Synthetic coding sequence
atgatgacaaccagtctcatttggggtatcgccattgcagcgtgttgttgtctatggctgatactgggaatacggagacgtcagaccggcgagccgccgctggagaacggcctgataccctatttaggatgcgccctgcaatttggtgctaatccgctagaatttctgcgcgccaaccagcgcaagcatggacacgtgtttacctgcaagctaatgggaaagtatgttcacttcatcaccaatccactgagctaccacaaagttctgtgccatggcaagtacttcgattggaagaaattccatttcgctacttccgctaaggccttcgggcatcgcagcatagatccgatggatggcaataccaccgagaacatcaacgatacgttcatcaagaccctgcagggtcatgcccttaacagtctgactgagtcgatgatggaaaacttgcagcgcataatgagaccgcccgtgtccagtaacagtaagaccgccgcttgggttacggaaggcatgtacagtttctgttaccgcgtcatgttcgaggcgggatatctgacgatattcggaagggatcttaccaggcgagatacgcagaaggctcacatactaaacaatctggacaatttcaagcaattcgataaggtgtttccggccctcgttgctggcctgccaatccacatgttccgcaccgcccataatgccagagagaagctggcagagtcccttcgacatgagaatttgcaaaagcgagaatccatttcggagctgatttcgctacgaatgttcttgaacgatacgttgagtactttcgacgatttggaaaaagccaagacgcacttggtcgtcctgtgggctagccaggcgaacacaatccccgcaactttctggagtctcttccagatgatcaggaacccggaagccatgaaggccgccaccgaggaggtgaaacgaactttggagaatgccggtcagaaggtctcccttgagggaaatccaatatgtctgtcgcaagccgagctcaacgacttgcccgttctggattctattatcaaagagtctttacgtttgagcagcgcgtccctgaacattcggacggccaaagaggactttaccttacacttggaggatggctcctataacattcgaaaagacgatataattgcgctgtacccacagctgatgcatctcgacccggaaatatatcccgatccacttactttcaaatacgacagatatctggatgaaaatggaaagaccaaaacgacattctattgtaacggcctcaagctgaagtactactatatgccgttcggcagcggcgctaccatctgccccggtcgattgtttgcaattcatgagataaaacaattcctcatcctgatgctgtcgtactttgagttagagctgatagaggggcaagccaagtgcccccccctcgatcagtcaagagctggcctcggaattctaccgccgctgaacgatattgagttcaaatacaagttcaagcatctg

SEQ ID NO: 249910 - DNA, 1512 bp, Artificial Sequence
  Description of Artificial Sequence: Synthetic coding sequence
atgatgacgacatcactgatatggggcattgccattgccgcttgctgttgcctttggttgatactgggcatcaggaggagacagaccggcgaacctcctctagagaacggtctcatcccctatctcggctgcgctctccagtttggcgctaatcctctggagttcctccgcgccaaccaacggaagcacggccatgtttttacctgcaagctgatggggaagtacgtacatttcattaccaatccccttagctaccacaaggtgctttgtcatgggaagtacttcgattggaagaagttccacttcgcaacctccgcgaaggcatttgggcacagatccattgacccaatggatgggaacaccaccgagaatatcaatgacacatttattaaaactctgcagggccatgctctgaacagcctgaccgagagcatgatggagaacctccagagaatcatgcgcccccccgtgtcttctaattctaagacagccgcctgggttaccgaaggcatgtactcgttttgctaccgggtgatgtttgaagcaggatatctgactatctttgggcgagacttgaccagaagggatacacagaaggcacacattctgaataatttagacaatttcaagcagtttgataaggtatttcctgccctcgtggctggtctgccaatccatatgtttcgcaccgctcataacgccagagaaaagttggctgagtctctccgccacgagaatctgcagaagcgtgagtcaatatcagaactgatatctttgcggatgttcctgaacgatacattgtctactttcgacgatttggagaaagcgaaaacgcacctggttgtactgtgggcttcccaggccaatacaatcccagcaacattttggtctcttttccagatgatccggaaccctgaggccatgaaggctgctaccgaagaggtgaagaggaccctggagaatgcgggtcagaaagtgtccctggaagggaaccccatttgtttaagccaggcagagttgaacgacctgcccgttctggattctatcataaaagaatctctgcgtctgagctcagcgagcctgaatatccgcacagccaaagaagattttaccctgcatctcgaggatgggagctacaatataagaaaggatgatatcattgcgctgtatcctcaacttatgcatctggatcctgagatataccctgacccactaacttttaaatatgatcggtatctcgacgagaacggcaaaacaaagactactttctattgtaacggcctaaaattaaagtactactatatgcctttcggatcgggcgccactatctgtcctggaagactgttcgccatccatgaaatcaagcagtttctgatactaatgttatcctacttcgagttagagctgattgagggccaggccaagtgccccccgctggatcagtcgagagccggtctgggaatattgccccctctgaacgacatagaattcaaatacaaattcaagcacctc

SEQ ID NO: 249911 - DNA, 1512 bp, Artificial Sequence
  Description of Artificial Sequence: Synthetic coding sequence
atgatgactacctcgctgatctggggtatcgcaatagctgcatgttgttgcctatggctcattctcggcataaggagaaggcagaccggcgaaccaccactcgaaaatggtttaattccttatctgggttgtgctctccagtttggcgccaatcctttggagtttctgagggcgaatcagaggaagcatggccacgtgttcacttgcaagcttatggggaagtacgtgcacttcatcaccaacccgctctcctatcataaagtgctgtgccacggcaaatatttcgattggaaaaagtttcattttgcaactagcgcaaaggcctttggccaccgtagcatcgatccgatggacggtaacacaacagagaatattaacgatactttcatcaaaacgctgcaaggccacgcacttaacagtcttaccgaatcaatgatggaaaacctccagaggattatgcggccacctgtgagctcgaatagcaaaactgcagcatgggtcactgaggggatgtattctttttgctaccgagtcatgtttgaggcaggctacctcacaatctttgggcgcgacctcaccaggcgagacacacagaaagctcacatccttaataatctggacaatttcaagcagttcgacaaggtgtttccagccttagttgcagggctgcctattcatatgttccgtactgctcacaacgcccgcgagaagctcgctgaaagcttacgacacgaaaatctgcagaagagggagagtatctcagagcttatttctcttagaatgttcctgaacgacaccctgagcactttcgacgaccttgaaaaggccaagacgcatctggtagttctttgggcttcccaggccaatacgatccccgccacgttttggagcctttttcagatgatacgaaaccctgaggcaatgaaggcagctaccgaagaggttaagaggaccttggagaatgctggccagaaggtgtccctggaaggcaatcccatatgcctctcgcaggccgaactcaacgatctgcccgttctagacagtattattaaggaatctcttaggttgtcttcagcgtcactgaacatccgaacagcaaaggaggacttcacactgcaccttgaggacggatcctataacattcgaaaggatgatattatagcattgtatccacagctcatgcatctcgatcctgaaatctaccctgaccctttaacctttaaatacgataggtaccttgatgagaacggaaaaacgaaaaccaccttctactgcaatggactgaagctgaaatactactatatgccgtttggatctggcgctaccatttgccctgggagattatttgcaatccatgagatcaagcagttcctgatcctcatgctatcttacttcgaactggaacttattgaaggccaagctaaatgcccaccactggaccagtcacgagcagggctgggaatactaccaccactgaatgatattgagtttaaatataagtttaagcacctt

SEQ ID NO: 249912 - DNA, 1512 bp, Artificial Sequence
  Description of Artificial Sequence: Synthetic coding sequence
atgatgaccacttcccttatctggggtattgctatcgccgcatgttgttgcctgtggctcattctggggataaggcgtcgccaaacaggagaaccaccgctggagaacggtctgatcccttatcttggttgcgcacttcagtttggggctaatcctcttgagtttctgagagcaaaccaacggaagcacggccatgtcttcacctgtaaactcatggggaaatatgtccacttcatcactaacccacttagctaccataaggtactgtgtcacggaaagtactttgactggaagaagtttcattttgcaacctccgcgaaggccttcgggcataggtccatcgatccgatggacggaaacaccacagagaacattaacgatacctttatcaagactctccagggacacgccctgaattctctgaccgaatctatgatggagaatctacagcgcataatgcgcccgcctgtgtcctctaatagcaagactgcagcatgggtgactgagggaatgtactccttttgctacagagtaatgtttgaggcaggatatctgaccatttttggccgcgacctgacccgccgggatacacagaaggctcacatcctcaataacttggacaactttaaacagttcgacaaagtctttcccgccctggtggccggcctccccattcatatgttcaggacagcccataacgccagagaaaagctggccgagagcctgcggcacgagaatctacagaagagggaaagcatttctgaactgatcagcctaaggatgtttctgaatgataccttgtccacgttcgacgacctcgagaaggctaaaacacatctggttgtcctctgggcgagccaggccaacaccattcccgctaccttctggagcttgttccagatgatacgcaatcctgaggccatgaaggccgccactgaggaggtgaaacgcactctcgaaaacgccggacagaaagtgagcctggaaggtaaccccatttgtctttcgcaggcagagttgaatgatttgcctgtcctggatagtatcattaaagagtcactgcggctgtcttccgcctccttaaatatcaggacagccaaagaggactttactctccatctggaggacggcagctacaacatccggaaagacgacattattgctctgtacccccaattgatgcatctggaccctgagatctacccagaccctctaactttcaagtacgaccggtacttagatgaaaacggaaaaacaaagactactttctactgtaacggccttaagctgaagtactactacatgccatttgggtcaggagctacaatctgtccgggacgcctgttcgcgattcatgagataaaacagtttctgattctaatgctgagctactttgaactggagctaattgagggtcaggcaaaatgtccccccttagatcagtcgagggcgggcttgggaatcctccctcctctgaatgatatcgagttcaagtataagtttaagcacctt

SEQ ID NO: 249913 - DNA, 1512 bp, Artificial Sequence
  Description of Artificial Sequence: Synthetic coding sequence
atgatgaccactagcctgatatggggcattgccatcgcagcctgttgctgcctgtggctcattcttggaattagaaggaggcagaccggagaacctcctctggaaaacggcctcattccatatctcggttgtgcactgcaattcggcgcaaacccacttgaattccttcgcgcaaatcagcggaagcatggacacgtctttacctgcaagttgatgggaaagtacgtgcacttcataaccaatccactgtcgtaccataaggtgttgtgccatggcaaatactttgactggaagaagtttcacttcgccacctccgcaaaggcatttggccatcgttccatcgatcctatggatggtaatacgactgagaacattaatgataccttcataaagaccctgcagggccacgctctgaattcgcttactgaatctatgatggaaaacctgcagaggattatgcgcccaccggtgagctcgaactctaagacggcggcatgggtgaccgaaggcatgtactctttttgttacagagtgatgttcgaagccggttaccttactattttcggaagagatctgaccagaagggatacgcagaaggcccatatcctcaataacctggataacttcaagcagtttgataaggttttccccgctctggtggcagggctgcccatccatatgtttcgaactgcccacaatgcacgtgagaagttggcggaatcacttcggcacgagaatctccaaaagcgagagtcgatctcagagctgatttcgttgaggatgttcctgaacgataccctctcaactttcgatgaccttgaaaaggcgaaaacccatcttgtggtgctgtgggcatcgcaagcgaatactattcccgctaccttttggagcctgtttcaaatgattcgaaacccggaggcaatgaaggccgcaactgaagaagtgaaaagaactcttgaaaacgctggacagaaagtttccctggaaggtaatccaatttgtctttcccaagcagagctgaacgatctgcctgtgttggactcgatcataaaggaatcgttgcgcttgtccagcgcaagccttaacattagaaccgcaaaagaagattttaccctccacctggaggacggatcatacaacataagaaaggatgacattatcgcactgtacccacaactcatgcaccttgatccagagatttatcccgatcctctcacctttaagtacgatcgctacctggacgagaatggcaagactaagaccaccttttactgcaacggcttgaaattgaagtactactatatgccatttggatccggagcgactatctgccctggccggctgtttgcaattcatgagataaagcaattcctgatccttatgctctcgtacttcgaactcgaactcatcgagggtcaagcaaagtgtcctcccctcgaccagtccagggcaggattgggaatactgcctcccctgaacgatatagaattcaagtacaagtttaaacatctg

SEQ ID NO: 249914 - DNA, 1512 bp, Artificial Sequence
  Description of Artificial Sequence: Synthetic coding sequence
atgatgactacaagcctgatttggggcatcgccatagctgcatgctgttgcctatggctgatcttgggtatccgccgtcggcagaccggggagccccctctagaaaatggcctaataccctatctgggctgcgccctccagttcggcgccaaccctttggaattcctgagagccaatcagaggaaacacgggcatgtgttcacttgcaagctgatggggaaatacgtgcactttattactaaccctttgtcttaccacaaagtcctttgccatgggaagtactttgattggaaaaagtttcacttcgcaacctcggcaaaagcttttgggcatcgcagtatcgatcctatggatggaaataccaccgagaatataaatgatacctttatcaagaccctgcagggtcacgcacttaattctttaacagaaagcatgatggagaatctgcagcggataatgaggcctcccgtgtcgtcaaattcaaagactgccgcctgggtgacggaaggaatgtattcattctgttaccgagtgatgttcgaagccggctacttgaccatttttggtcgcgacctgactcggcgggacacacagaaagctcacattctgaataatctcgataacttcaagcaatttgacaaggttttccctgccctggtagccggattgcctattcacatgttcaggaccgcgcacaatgcaagagaaaagttggcagaatcattacggcacgagaatctccaaaaaagggagagtattagcgaactgatctccctgaggatgttcctcaacgatactctctcgacttttgatgatctggagaaggcaaagacacatttggtggtgttatgggcctcccaagccaatactatcccagccacattctggtcgctattccagatgatcaggaaccctgaggccatgaaggcagctacagaggaagttaagagaaccttagaaaatgcaggacagaaggtgagcctggaggggaatcccatatgcttgtctcaagccgagttgaatgacttgccagtattggactctatcatcaaggaatctcttaggctttcttctgcttccctgaacatccgtactgctaaggaagacttcaccctacatctcgaagatggctcctataacatacgtaaagacgacataattgcactgtacccccaacttatgcacctcgacccagagatatatcccgatcccctgacttttaagtacgatcgatacctggacgaaaacggcaagactaagacaaccttttattgtaatggattaaagcttaagtattattacatgccttttgggtccggagccaccatttgcccaggccggctcttcgctatacacgaaattaaacagttccttattttgatgctgtcctactttgagctggagctgatcgagggacaggcaaagtgcccccctctcgaccagagccgcgccgggttgggaatactgccccccttgaatgatatcgagttcaaatataagttcaaacatctc

SEQ ID NO: 249915 - DNA, 1512 bp, Artificial Sequence
  Description of Artificial Sequence: Synthetic coding sequence
atgatgactaccagtctgatttggggtatagcgattgccgcttgttgctgtctctggctcatccttggaatacgacgcaggcagaccggagagccgcctcttgaaaacggcctgatcccgtacctgggatgcgccctgcagttcggtgccaaccctctggagtttctcagagccaatcagcggaaacatggacatgttttcacctgcaaactgatggggaagtatgtccactttatcaccaatccactgtcctaccacaaggtgctgtgccatggaaagtacttcgattggaaaaagtttcactttgcaacttcagccaaggctttcggacaccgctcgatcgacccaatggacgggaacactaccgagaacattaatgacactttcatcaagaccctccagggtcatgccctgaatagcctgacggagtcaatgatggagaacctccagcgaatcatgaggccaccggtttcttctaacagcaaaactgcggcgtgggtgaccgaaggaatgtactcattctgctatcgcgtcatgttcgaagcgggttacctcactatctttgggcgcgatctcacccggagagacacccaaaaggcgcatatcctgaataatctggataactttaaacagttcgataaagtgtttccagcgctggtcgctggacttccgatccatatgttccgcaccgcgcacaacgcacgcgaaaagttggccgaatcgctgcgccacgaaaatctgcagaagcgcgagtcgatctcagaacttatcagcctgcggatgttcttgaacgatactctgtccacttttgatgatcttgaaaaggccaagactcacctcgtggtgctctgggcctctcaggccaacaccatccctgcgaccttctggtcacttttccaaatgatccgtaaccccgaagccatgaaagcggctactgaggaagtcaaaaggaccttggaaaacgccggacagaaggtcagcctggaggggaaccctatctgcttgagccaagccgaactcaatgacctgccggtgctggatagcatcatcaaggagtcgttgcgactctcctcggcttccctgaatatccgcaccgctaaggaggacttcacgctgcatctcgaggacgggtcctacaacatccgaaaggacgacatcatcgccctctacccccaacttatgcacttggatccggagatctacccagacccgctgaccttcaaatacgatagatacctcgatgaaaatgggaaaaccaagaccactttctactgcaacggcctgaagttgaaatactactacatgcctttcggctcgggagcgactatttgcccgggtagactgtttgccatccacgagatcaagcaattcctcatcctcatgctctcctacttcgaactggagctgattgagggccaagccaagtgccccccgctggatcagtctagggcgggcctgggaatcctgcctccactgaacgacatcgaattcaagtacaagttcaagcacctg

SEQ ID NO: 249916 - DNA, 1512 bp, Artificial Sequence
  Description of Artificial Sequence: Synthetic coding sequence
atgatgaccacctctctgatttgggggatagctattgctgcctgttgctgtctctggttgatattgggaattaggcgccgacaaacaggggaacctcccctggagaatggattgatcccttatctaggttgcgcactccaatttggggccaatcctctggagtttttacgagcgaaccagcgtaagcatggccatgtcttcacttgtaagcttatgggcaaatacgtgcacttcataacaaacccactaagctatcacaaggtgctttgccatggtaagtacttcgactggaaaaagttccatttcgccacctccgctaaagccttcggacatagatcaatcgatccgatggacggaaatactactgagaacatcaatgacacattcattaaaacgctccagggtcatgctttaaattcgcttaccgaatcgatgatggaaaacctgcagagaatcatgagaccccccgtttccagtaattctaagactgcagcctgggtcacagagggcatgtatagtttttgctacagggtgatgttcgaggcagggtacttgactatcttcggcagggatctgaccagacgtgacacccaaaaagcccacatcttgaacaaccttgacaacttcaaacaatttgataaggtgtttcccgcgctggtggctggactgcccattcacatgtttcgcaccgctcacaacgcacgcgagaaactagcggaaagtctccggcacgaaaacctgcagaaacgcgagtccatatccgaactgatttcgctccgcatgttcttgaacgatacgttaagcaccttcgacgacctggaaaaggcaaagacccatctggtcgtgttatgggcctcccaggccaataccattccggcaactttttggtccctgttccagatgatcagaaacccagaggctatgaaggcagccactgaggaagtcaagcgcactctggagaacgcgggtcaaaaggtcagcttggaaggcaaccctatctgtctgtcccaagctgagctgaatgacctgcctgtattggattctatcataaaggagagtctgagactctcgagcgcctccctcaatataaggaccgctaaagaggattttactctccatttggaggatggaagttacaacatacgcaaagacgatatcattgcgctgtatccgcagctcatgcatctggaccccgagatctatcctgatcctctcacctttaaatatgatcggtacctcgatgaaaacggaaagactaagaccacattttattgtaacggactgaagctgaagtattactatatgccattcggcagtggcgcgactatatgcccaggcaggctgtttgccatccacgaaatcaagcagttcctgatcctgatgctttcgtacttcgaactcgagttgattgagggccaggcaaagtgccctccactggaccaatcaagagccgggctgggtattttgccgcccctgaacgacattgagtttaaatacaaatttaagcacctg

SEQ ID NO: 249917 - DNA, 1512 bp, Artificial Sequence
  Description of Artificial Sequence: Synthetic coding sequence
atgatgaccacctcgctcatctgggggattgccattgcggcctgttgttgtctttggctgattctgggcatccgcagacgacagactggagagcccccattggagaatggattgattccatacctggggtgtgcgttgcaattcggggcaaacccactcgaattcttgagagcaaaccaaagaaagcatggccacgtgtttacctgcaagctcatgggaaagtacgtccactttatcaccaatcccctctcctaccacaaggtgttgtgtcacggcaagtactttgattggaagaaatttcattttgcaaccagcgccaaggcttttggtcatagatctattgacccgatggatggcaacacgaccgaaaacataaacgacacctttatcaagaccctgcagggacatgccttgaactctcttactgaaagcatgatggagaacctgcaacgcattatgcggccacccgtgtcgagcaatagtaagacggcagcctgggtgacggaaggaatgtactcattttgttaccgggtcatgttcgaggcaggttaccttactattttcgggagagatctgactcgtagggatactcagaaggctcatattctgaataatctggataactttaagcaatttgataaagtgtttcctgcactggtggccggactcccaattcatatgtttagaacggcccataacgcccgagaaaagttggcagaaagccttagacatgagaatctgcaaaagagagaatcaatttccgaactgatatccctgcggatgttcctcaatgacactctcagcactttcgatgacctggaaaaagcgaaaacccacctggtggtgctctgggcatcacaagcaaacactatacccgcaactttttggtcactttttcaaatgatcagaaaccctgaggcaatgaaggcggctactgaggaggtgaagaggaccctggaaaatgcaggacaaaaagtatccctggaaggaaatcccatatgtttgtcccaggcagaactcaacgatctgcccgtcctggattcgataatcaaggaatcactcagactgagctcggcctcgctgaacataagaactgctaaagaagattttaccctgcaccttgaagatggatcgtataacatccgcaaagacgacattatcgctctctatccacaactgatgcatctggaccccgaaatctacccagatcctcttaccttcaagtacgatcggtaccttgatgagaatggcaagactaaaactactttctactgcaacggccttaagctgaagtactactacatgccattcggtagcggggccaccatctgccctggacgcctgttcgcgattcacgagattaaacagtttctgatactcatgctgtcctactttgaacttgaactgattgaaggccaggctaaatgccctcctttggaccaatccagagcaggcctcgggatcctgcctcccctgaacgatatcgagttcaagtacaagtttaagcatctt

SEQ ID NO: 249918 - DNA, 1512 bp, Artificial Sequence
  Description of Artificial Sequence: Synthetic coding sequence
atgatgacaacgagtctcatctggggcattgccattgccgcatgctgctgcctctggctcatcctgggcatccggagacgccaaactggtgagccaccgctggaaaatggcctaatcccctacctgggctgcgcgctccagtttggcgcgaatcctctggagttcctgagggctaatcagaggaaacatggccatgtcttcacgtgcaagctgatgggcaagtacgtgcatttcatcacaaaccctctcagctaccacaaagttctttgtcacggaaaatacttcgattggaaaaagttccatttcgcaacctctgcaaaagcgtttggccaccgatcgattgaccccatggatggaaacacgaccgagaacatcaacgacacattcatcaagaccctccagggccatgcgttaaatagcctgactgagtctatgatggaaaacctgcagcgtatcatgcgacctcccgtgtccagcaattccaagaccgccgcatgggtcactgagggaatgtacagcttctgctacagagtgatgttcgaagctgggtacttaacaattttcggtagggatctgactagaagggacacccaaaaggcacacatactcaataatctcgataactttaaacagtttgacaaggtgtttcctgcactcgtggccggactgccaatccatatgttcaggaccgcacataatgcgagggaaaagctcgcagaaagtctccggcatgagaacctccagaaaagggagtccattagtgaactgatttccctgcgcatgttcctgaacgacactctctctacattcgacgacctggagaaagctaagacgcacctggtggtgctatgggcctcacaggccaataccatacctgctacgttttggagcctattccagatgatccgaaacccagaggctatgaaagccgcaaccgaggaggtgaaacgcacactcgaaaacgccggacagaaggttagcctggaaggaaaccctatctgcctatctcaagccgaactgaacgaccttcctgtgctggactctattatcaaagaatccctccggctcagtagcgcctctctgaacatcagaacagctaaagaggattttacgcttcatctcgaagacgggtcctacaacataagaaaagatgatattattgccctctacccgcagttgatgcacttggaccccgagatatacccagaccctctgactttcaagtatgaccgctacctggatgagaacggtaaaactaaaacaacgttctattgtaatggtctgaagctcaaatactactacatgccctttgggtcaggcgccaccatatgccctgggaggctttttgcgatacatgagattaagcagttcctgattctgatgctttcatacttcgagctcgagctgatagagggtcaagccaagtgcccaccgcttgaccaaagccgggccgggctaggaattttgccccccttaaatgacatcgagttcaagtacaagttcaaacacctc

SEQ ID NO: 249919 - DNA, 1512 bp, Artificial Sequence
  Description of Artificial Sequence: Synthetic coding sequence
atgatgacgacttccttaatctggggtattgctatcgcggcctgttgctgcctgtggctgatcctgggaatccggcgtaggcagactggtgaaccgccactggagaacggcctgattccgtacttgggatgcgccttgcagtttggtgctaatccactggaattcttgcgagccaaccaacgcaaacacggccacgtctttacatgcaaactgatggggaagtatgttcacttcattactaacccccttagttatcataaggtgttatgtcacggaaaatacttcgattggaagaagtttcattttgcaacctcggccaaggcgttcgggcatcggtccattgatcccatggatggcaacaccactgagaatattaatgacacattcataaagaccctgcagggacatgcgctaaattctttgaccgagtccatgatggagaatctccagcggattatgagacccccggtctcaagtaacagcaagaccgctgcctgggtgactgagggcatgtactccttctgttatagggtgatgtttgaggcaggttatctgacgatattcggtcgcgacctgacacggagggacacacaaaaggcacacatactcaataatctagataatttcaagcagtttgataaagtttttccagcgctggtagcagggttgccaatccacatgttcagaaccgcccacaatgccagagagaaactggcggaatccttgcgccatgagaatttgcagaagagggagagtatctccgaactgataagtctgcgaatgtttctcaatgatacgctctccacatttgatgacctggaaaaggccaagacccacctggttgtgttgtgggcaagccaggccaataccattcctgccaccttttggtctctgttccaaatgattagaaaccccgaagcgatgaaagctgctactgaggaggtcaaacggaccctcgagaatgccggtcaaaaagtgtctttagagggcaaccccatctgcctctcacaggccgagctgaatgatctccctgtgctcgattctatcattaaggagagcctcaggctatcctccgcgtccctgaatattcgcaccgctaaagaagatttcactctccacctggaggatggttcttacaatattagaaaagacgatataatcgcactgtacccccagctaatgcacctggaccctgagatatatcctgatcccctgaccttcaaatacgatcggtacctggacgaaaatggaaagaccaagactaccttctactgcaacggtctaaagctgaaatactattatatgccctttgggagcggcgctaccatctgtccaggcagacttttcgccatccacgagatcaagcagtttctcatcctgatgttgtcctacttcgaacttgagctcatagagggccaggcgaagtgtccaccattggaccaatcccgggcagggctgggcatcctgcccccccttaatgatattgagtttaagtataaatttaaacacctg

SEQ ID NO: 249920 - DNA, 1512 bp, Artificial Sequence
  Description of Artificial Sequence: Synthetic coding sequence
atgatgaccacttctctcatatggggcatagccattgcagcttgttgttgcctgtggcttatccttgggatccggagaaggcagaccggggaaccccctttggagaacggtcttattccttacctcggatgtgcgctccagtttggtgcaaaccctttggaattcctcagagcaaaccagcggaagcacggtcatgtcttcacatgcaagctgatgggcaagtatgttcattttataacaaacccgctctcatatcacaaagtgttatgtcatgggaaatatttcgattggaagaaattccatttcgccacctctgctaaggcctttggccacagaagcattgatcccatggacggtaacaccacggagaacattaacgatacctttattaagacattgcaaggccatgcccttaatagcttgacggaatctatgatggagaatctgcagaggataatgagacctcctgtcagctctaattccaagacagcagcatgggtgaccgagggtatgtactcattttgttaccgggtgatgtttgaggcagggtacttgacaatatttgggcgggatctgacccgccgcgatactcagaaagcccatatattgaacaatcttgacaactttaagcagtttgacaaggtcttcccagccctggtggccggtctgcctatacatatgttccggacagcacataacgcgcgtgaaaagctggcggaatcactcaggcatgagaatctgcagaagcgggagtctatttccgaactgatcagcctgagaatgttcctcaatgacaccctttccacatttgatgacctggagaaagccaaaactcacctggttgtactgtgggcaagtcaggcgaatactattcctgcaacattttggtcgctattccagatgatacgcaaccctgaagcaatgaaagctgccacagaggaggtcaaaaggacattggagaacgcaggtcagaaggtttctttagagggcaaccctatttgccttagccaggcagagttgaatgacctgcccgtcctggattccattatcaaggagtccctgagattgagcagcgcaagcttgaacattcgcacagctaaagaggactttacgcttcatctggaagacgggtcctacaatattagaaaagatgacattatagcgttgtaccctcaattaatgcacctggatccagaaatatatccagatccactcacttttaaatatgatcggtacctggacgaaaatggcaaaaccaagaccacgttttactgtaacggactgaaactcaagtattactacatgccgtttggtagtggggcaacaatttgtcccggcagacttttcgccattcatgaaatcaagcagttcctgatcttaatgctgagctactttgaactagaacttatcgaggggcaggctaagtgcccaccccttgaccaatcacgcgcaggactcggcatactccctcctctgaatgacatagagttcaagtataagtttaagcacctg

SEQ ID NO: 249921 - DNA, 1512 bp, Artificial Sequence
  Description of Artificial Sequence: Synthetic coding sequence
atgatgaccacttccctaatatggggcattgcgatagcagcctgctgttgcctctggctgatccttggcatccggcgacgacaaactggggagccaccactggagaacggcctaatcccgtacttaggttgcgctctccaattcggtgctaatcccctcgagttcttgagagcaaaccagcgcaagcacgggcatgtatttacttgtaagttaatgggcaagtacgtgcattttatcacaaaccctttgagctatcataaggtgctgtgtcatggcaagtactttgattggaaaaagttccatttcgcaacatctgccaaggccttcggtcatcggagcatcgacccgatggacggcaataccacagaaaacattaacgatactttcatcaaaacgctgcagggacatgcccttaattctctgaccgagagcatgatggaaaatcttcagcggatcatgcggccccctgtcagttccaattctaaaacagctgcctgggtgactgagggtatgtattcattctgttaccgtgtgatgtttgaagccggctacctcacgattttcggcagagacttgacgcgtcgggatactcagaaagcccacattttgaacaacttggacaacttcaagcagttcgataaggtgttcccggcccttgtggccggcctaccaatacatatgttccggacagcacacaacgctcgggagaagttagccgaatccttacggcacgagaatttgcagaagcgcgagtcaatttctgagctgatctctctgaggatgttccttaatgatacattgtctacgtttgacgacctggagaaggccaagacacacctggtggtgctttgggcgagtcaggcaaatacaattccagccaccttttggtctctgtttcagatgattcggaacccagaagctatgaaggccgcaacagaggaagtgaagcgcacgctggaaaatgccggccaaaaggtcagcctggagggtaaccctatctgcttgagccaggcagagctcaatgacctgcccgtcctggattctattatcaaggagtcactaaggctgtcctccgcatccctgaatatacggacggctaaggaggacttcacattacatctggaggatggatcatacaacatccgtaaggatgacataatcgccttatacccccagctaatgcatctggatcccgaaatttacccggatcccctcacgtttaaatatgaccggtatctggacgagaatggtaagacaaagacgaccttctactgtaatggcctgaagctgaaatactactacatgccctttggctcaggcgcgaccatctgtcccgggcgccttttcgctatacacgagataaaacaattcttgattcttatgctttcctactttgagctcgagcttattgagggccaggccaaatgcccccctcttgatcagtcacgcgccggtctgggaattctaccgccgctaaacgacatagagttcaaatataagtttaaacatttg

SEQ ID NO: 249922 - DNA, 1512 bp, Artificial Sequence
  Description of Artificial Sequence: Synthetic coding sequence
atgatgactacttctcttatctgggggatcgccatcgccgcttgttgctgtctctggcttatccttggaatccggaggcgacagacaggggaacctcctttggaaaacggattaataccatatcttggatgtgcgttacagttcggggctaaccccctagagttcttaagggccaatcagcgaaaacacgggcacgtattcacttgtaagttaatggggaaatatgtccatttcatcactaaccctctatcttatcataaagtgctgtgccatgggaaatattttgactggaaaaagttccattttgccacatccgcaaaggcatttggacatcgatcaatcgatcctatggacgggaacacaacagaaaatatcaacgatacatttataaaaactctccagggacacgccctgaactccttaacagaatcaatgatggagaatttgcagaggataatgcgtccacctgtgtcctcaaatagtaaaacagccgcctgggttactgaaggaatgtattctttctgctacagggtgatgtttgaggctggatatctcacaattttcgggagagatctaactcggagagatactcagaaagcccacatcctcaacaatctcgataacttcaaacagtttgacaaagtttttcctgccctcgttgccgggcttcccatccacatgtttcggacagctcataatgcaagggaaaaattagccgaatccctcagacacgaaaatctccagaaacgagaatctatctctgaactaatctctttacgcatgttcttaaacgatactctctctacatttgacgatctagagaaagcaaaaacacacctggtggtgctctgggcgtcgcaggctaacacaatcccagctacattctggtctctgtttcagatgatcagaaaccccgaagccatgaaagcagcaactgaagaggtcaagaggactctcgagaacgccgggcagaaagtttccctcgaaggaaaccccatctgcctatctcaggcagagttaaatgatctgcctgtgctcgattccataattaaagagtcactgaggttgagttctgctagtctcaatatcagaacggccaaggaggattttactctgcatttagaagatgggtcctataatataagaaaagatgatatcatagcgctgtatccccagctcatgcatctggatccagaaatatatcccgacccactaactttcaaatatgataggtatttagatgaaaatgggaaaacaaaaactacattttactgtaatgggctgaagcttaagtattactacatgccattcggatccggagccactatatgtcctggaaggctttttgcgatacacgaaatcaaacagttcctcattcttatgctgtcatatttcgagctcgaactgatagagggacaagccaagtgtcccccattagatcagagtcgggctggactcgggatcctgcctcccctcaatgatatagaatttaaatacaaattcaaacatctg

SEQ ID NO: 249923 - DNA, 1512 bp, Artificial Sequence
  Description of Artificial Sequence: Synthetic coding sequence
atgatgaccacctccctgatatggggtatagctattgctgcctgctgctgtttgtggctaatactcgggattcggagaagacagaccggggagcctcccctcgagaacggcctaattccctaccttggatgcgccctgcagtttggtgccaaccccttagagtttcttcgagccaaccagaggaagcacggccatgtgttcacttgtaaactcatgggcaaatatgtgcacttcatcacaaaccccctgtcctaccacaaagttctgtgccacgggaaatattttgactggaagaaattccacttcgcaacttcagccaaggcattcggacatcgaagtattgatcctatggatggaaacacgacagagaacatcaacgataccttcataaagacactccaagggcacgctttgaacagcctgaccgagagcatgatggaaaatttgcagagaatcatgagaccaccggtctccagtaattctaagacagccgcatgggtgaccgaagggatgtactctttttgttacagagttatgttcgaggccgggtatctcaccatcttcggcagagatttgacaaggcgcgacacgcaaaaggcccacatccttaataacctagataatttcaaacagtttgacaaagtctttccagcactggttgctggtctgccaatacacatgttccggacggcacacaatgcccgggaaaagcttgctgaaagtttgagacatgagaacttacagaagagagagagcatttccgagctcatatctcttaggatgtttctcaatgacacactgagcacctttgatgacttggaaaaggcaaagacccatttggtcgtcctctgggctagccaagccaacactattcctgctacgttctggtcacttttccagatgatacgcaatccggaggccatgaaggccgcaactgaagaggtcaagcgcacactggaaaacgccggacagaaagtctcgctcgagggcaaccctatctgcctgtcgcaagccgagctgaatgatttgcccgtgctggattctataattaaggagagtctgcgcctcagttccgcttcacttaacattcggaccgcgaaggaagactttactcttcaccttgaggatgggtcatataacattaggaaggatgacatcattgccctgtacccgcaactgatgcatttggatcctgaaatctaccctgatcccctgacctttaaatacgataggtacttagacgaaaatggtaaaactaaaacgaccttctattgtaatggactaaaattaaaatattattatatgcccttcgggtcaggagccaccatctgccctggccgtcttttcgcaatccatgaaatcaaacagttcttgattctaatgctgtcctacttcgagctggagctgatcgaaggccaggctaagtgtccccccctagatcagtcaagggccgggctcggaatcctgccccccctgaacgatatcgaatttaaatacaaatttaaacacctg

SEQ ID NO: 249924 - DNA, 1512 bp, Artificial Sequence
  Description of Artificial Sequence: Synthetic coding sequence
atgatgaccactagtttaatctggggaatagctattgccgcatgttgttgtctttggctcattctaggtattagacggagacagacaggtgagccacctcttgagaacggcctcataccttatttgggttgcgctcttcagtttggtgctaacccattggaattcctccgggccaaccaaagaaagcacgggcatgtttttacatgtaagcttatggggaagtacgttcatttcatcacgaatcctctgtcctatcataaggttctctgtcacggcaagtacttcgactggaaaaaattccacttcgctacctctgctaaggcgttcggtcatagaagtatagatccaatggatggtaacactacagagaacattaatgatacattcattaagactttgcagggccatgctttgaattcgttaactgagtcaatgatggaaaacttgcaaaggattatgaggccacctgttagtagtaattcgaagacagccgcttgggttactgagggcatgtatagcttctgttatagagtcatgttcgaggctgggtacttaaccattttcggccgcgacttgaccaggagggacacacagaaggcacatattcttaataatttggataatttcaagcaattcgataaggtgtttcctgccctcgttgctggacttccaatccatatgtttaggaccgcccataatgcgcgtgagaaactagctgaatcgcttagacatgagaaccttcaaaagagagaatccataagtgagttaatatcacttaggatgttccttaatgatacgcttagtacgtttgatgacttagaaaaagcaaaaacgcacttggttgtcctctgggcttctcaagctaacaccatacctgctacattctggtctctttttcaaatgatcaggaaccccgaggctatgaaggcagccaccgaagaggtaaagaggacacttgagaatgcgggccagaaagtttctctcgaagggaaccctatttgcctcagtcaggcagaactgaatgacttgcccgttttggatagtatcatcaaagaatcgttgagattaagttcggcttcacttaacattagaactgccaaggaggattttacattgcacttggaggatggaagttacaatattaggaaggatgatattattgctttgtacccacagttgatgcatttggaccctgaaatttatcctgatccgctaactttcaagtatgataggtatcttgatgagaacgggaagactaaaacgacattttactgcaatggcttaaaattaaagtactattatatgccatttggctcaggtgctaccatatgccccggaaggctttttgccattcatgagattaaacagtttctgatccttatgctgagttactttgaacttgaacttattgaaggtcaagctaagtgccctccattagaccagtcgagggccgggctcggtattctcccaccattgaacgacattgagttcaagtataagtttaaacatctc

SEQ ID NO: 249925 - DNA, 1512 bp, Artificial Sequence
  Description of Artificial Sequence: Synthetic coding sequence
atgatgaccacctcgctcatttggggaatcgccattgcggcttgttgttgcctctggctcatattggggattagacgccgacaaactggcgaaccaccacttgagaacggtctgatcccataccttggatgtgccctgcaattcggcgcaaatccactggagtttcttcgggctaaccaacgcaagcatggtcatgtgtttacttgcaagctgatggggaaatatgtccactttatcacgaatcccctttcataccacaaggtcctctgtcatggtaaatacttcgactggaaaaagtttcactttgcaacgtcagcgaaggcctttggccatagatcgattgatccaatggacggtaacacgaccgagaacattaacgataccttcatcaagaccttgcaaggacacgcgctgaactcacttactgagagcatgatggaaaatctccagaggattatgcgtcctccagtcagctcgaatagcaagaccgcagcctgggtgactgaaggaatgtactcgttctgctacagagtgatgtttgaagcaggatacttgaccattttcggacgcgatcttacccggagagatactcaaaaggcgcatatcctcaacaaccttgacaactttaaacagtttgataaggtctttcctgcgctggtcgctggtttgccgatccacatgtttcgtactgcacacaacgctcgcgaaaaactcgcggaatcgctcagacatgagaatctgcaaaagcgggagagcatttcggagctgatctctctgagaatgtttctcaacgacacgctgagcacttttgatgatctggaaaaggccaagactcatctcgtggtgctctgggcatcacaggcaaatactattcccgcaacgttttggtccctttttcagatgatacggaacccagaagcgatgaaagccgccaccgaagaggtcaaaagaactcttgaaaacgccggacagaaagtgtcccttgaagggaaccccatatgtctttcacaagcagagcttaacgaccttccggtgctcgattccatcatcaaagaatcgcttcgactttcgtcagcatctctgaatatcagaaccgcaaaggaggacttcactttgcacttggaggacggaagctacaacatccgtaaagatgatatcattgcactttaccctcaactcatgcatctggacccggagatttacccagacccactgacctttaagtacgatagatatctggacgagaatggtaaaaccaaaactactttttactgtaatgggttgaagctgaagtactactacatgcctttcggctcaggagccactatttgtccaggacggctgtttgccattcacgaaatcaagcagtttcttatccttatgcttagctattttgaactggaactcatcgaaggtcaggcaaagtgccctccgcttgatcaatcccgcgccggactgggtattctgcctccactcaatgacattgaattcaaatacaagttcaagcatctg

SEQ ID NO: 249926 - DNA, 1512 bp, Artificial Sequence
  Description of Artificial Sequence: Synthetic coding sequence
atgatgactacttcactgatctggggcatcgctattgccgcctgttgttgcctgtggctgattctgggcatcaggcgccgccaaaccggggagccgccactggaaaacggtctgattccatacctcggatgtgccctgcagttcggcgcgaacccgctcgaattcttgcgcgctaatcagcggaagcacggacatgtctttacttgcaagctgatgggaaagtacgtgcatttcatcactaacccactctcgtaccacaaagtcctgtgccacggcaagtactttgactggaagaagttccacttcgctacttccgccaaggcctttggccatcggtcgatcgatcccatggacggcaataccactgaaaacatcaacgacaccttcatcaaaaccctgcaagggcacgcactgaactcgcttactgagtccatgatggaaaacctgcaacgcatcatgcgtcccccggtcagctccaattcaaagactgctgcttgggtgaccgagggaatgtactccttttgctaccgcgtcatgttcgaagctggatacctgaccatcttcggacgggatctgactaggcgggacactcagaaagcgcacatcctgaacaatctggacaatttcaaacagtttgataaggtgttcccagcgctcgtggccggcctgcctatccacatgttccgcactgcccacaacgcccgggagaagctggccgaatccctgaggcatgaaaacctgcagaagcgggaatcaatctcagaactgatctccctccgcatgttcctgaacgataccctgtccacgttcgatgatctggagaaagcaaagactcatctggtcgtgctctgggcgtcccaagcgaacaccatccctgcgaccttctggtccctgttccagatgatccggaatcccgaagcgatgaaggccgcaaccgaggaagtgaagaggactctcgaaaacgccggccagaaagtgtccctggaaggaaatcctatctgtctgtctcaggcagagctgaatgacctgcccgtgcttgactcaatcatcaaggagtcgctgcggctctcctcagctagcctcaacatccgcactgcgaaggaggacttcaccctgcacctggaagatggtagctacaacatcagaaaggacgacatcatcgcgctctacccacagctcatgcatcttgacccagaaatctacccggatccacttacgtttaagtacgaccggtacctcgacgaaaacggcaagactaagaccaccttctactgcaatggattgaaactcaagtactactacatgccattcggctcgggagccacgatctgtcctggacggctgttcgcgattcacgagatcaaacagtttctgattctgatgctgtcatacttcgaacttgaactcatcgagggacaggccaagtgcccgcctcttgatcagtctcgggcgggactcggaatcctgccgccgctcaatgacatcgagtttaagtacaagtttaagcacctg

SEQ ID NO: 249927 - DNA, 1512 bp, Artificial Sequence
  Description of Artificial Sequence: Synthetic coding sequence
atgatgactacttcactgatctggggtattgcaatcgccgcctgctgctgtctctggctgattcttggcatcagacggaggcagaccggcgaaccgcccttggagaacggactgatcccttacctcggctgtgcactgcagttcggcgcgaatccgctggaattcctgcgcgcgaatcagcggaagcacggccacgttttcacgtgcaaactcatgggaaaatacgtccacttcatcacgaaccctctttcgtaccacaaggtcctgtgccacgggaagtacttcgactggaaaaagttccattttgcgactagcgcgaaggcgttcgggcacagatcaattgacccgatggatggtaataccactgaaaacattaacgacacctttatcaaaacgctccagggacacgcccttaactcgctgaccgaatccatgatggagaacttgcagcgcataatgaggccacccgtgtcgtcaaattcgaaaaccgccgcttgggtcaccgaaggaatgtacagcttttgctaccgggtgatgttcgaggctggatatttgactattttcggccgcgacctcactcgccgggacacccagaaggcgcatatcctcaacaatctggacaacttcaagcaattcgataaagtctttcctgccctggtggccggactgccaatccatatgttccgcaccgcacacaacgccagggagaagttggccgagtcccttcggcacgagaacttgcaaaaacgcgaaagcatctccgagttgatctccctccggatgtttctgaacgacaccctgtcaacttttgatgatctggaaaaggcaaaaactcatttggtggtcctctgggcgtcccaggcaaacaccattccggctactttctggtcgctgttccaaatgatcagaaatccagaagctatgaaggctgcaaccgaagaggtgaagagaacgctggaaaacgccggacagaaggtgtctctggaaggaaatccgatctgtttgtcccaagcagagctgaatgacctgcccgtgctcgattcgataatcaaggagtccctgcgcctgagcagcgcctcgttgaatatcagaacggccaaggaggatttcaccctccatctggaagatgggtcctataacatccgcaaagacgatatcattgctctttacccacaactcatgcatctggacccagaaatctaccccgatccgctcaccttcaagtacgaccgctacttggacgagaacggaaagacgaaaactactttctactgcaatggtctgaaactcaaatactactacatgccattcggaagcggtgccaccatctgcccgggccgactcttcgctattcatgaaatcaagcagttcctcatcctcatgctgtcatacttcgaactggagttgatagaaggacaagctaaatgccctccgttggaccagtcacgggcgggtctgggaatcctgccaccactcaacgatatcgagtttaagtataagttcaagcacctg

SEQ ID NO: 249928 - DNA, 1512 bp, Artificial Sequence
  Description of Artificial Sequence: Synthetic coding sequence
atgatgacgacgagcctcatttgggggattgcaattgccgcatgttgctgtttgtggttgattctgggaatccggaggagacagactggcgaaccgccattggaaaatgggctcattccttacctgggatgtgcactccaatttggcgctaatcctctggagttcctgagagcaaatcaaagaaagcacgggcatgtgtttacctgcaagctgatggggaaatacgtgcacttcattacgaatcccctctcctatcacaaggtgctttgtcatgggaagtacttcgattggaaaaagtttcattttgccacctcggctaaggcttttggacatcgatcgattgatcctatggatggtaacaccaccgaaaacataaacgacaccttcataaagacccttcaagggcacgctcttaactccctgaccgagtcaatgatggaaaacctgcaacgaattatgcggcctcctgtatcgtcgaactctaagaccgcagcatgggtgactgaaggcatgtactcgttctgctatagagtgatgttcgaagcgggttatctgaccattttcggacgagatcttacccggagagatactcagaaggcccatattctcaataacctggacaatttcaagcagtttgataaggtgtttcccgccctggtggcaggactgccaatccatatgttcagaaccgcccataatgcaagagaaaaactggcggagagcctgagacatgaaaacctgcagaaacgtgagagcattagcgagcttatctcattgaggatgtttctcaatgacaccctctcgaccttcgatgacctggagaaggcaaaaactcatttggttgtgctttgggcgtcacaggcaaacacgatcccggcaactttctggtcgcttttccaaatgattcgcaaccctgaggcaatgaaagcagcaaccgaggaggtgaagaggacgctggaaaatgcaggacaaaaagtctcacttgaaggaaatccaatctgtctctcccaggcagaacttaacgatctgccagtgctggattcgataatcaaggaatctcttagactttcttcagccagcctgaacattaggactgccaaagaagattttaccctccacctggaggatggatcctacaacataagaaaggacgatatcattgcgctctaccctcagcttatgcatctggaccccgaaatctaccctgaccctctcacctttaagtacgataggtacctggacgagaacggcaagactaaaactactttttactgcaacgggctgaagctcaaatactactacatgccatttggatccggcgccacgatctgtcctggacggctgtttgccattcacgagattaagcagttcctgatacttatgctgagctacttcgaactggaacttatagagggccaagccaagtgtcctcctcttgaccagtcgcgcgcaggcctgggtattttgcctccactgaacgatatagaattcaaatacaagtttaaacatctt

SEQ ID NO: 249929 - DNA, 1512 bp, Artificial Sequence
  Description of Artificial Sequence: Synthetic coding sequence
atgatgaccacgtcattaatatggggaatcgccatagctgcttgctgctgcctgtggctgatccttggtattcgacgccggcagacaggggaaccacctttggaaaacggcctgatcccttaccttgggtgcgcactgcagtttggcgcgaaccccttggagttcctgagggccaaccagaggaaacacggtcacgttttcacatgcaaactgatgggaaagtacgtccacttcatcaccaacccactatcctaccacaaggtgctgtgtcacggtaaatacttcgactggaagaagtttcacttcgcgacgagcgccaaggctttcggacatcgttcaattgaccccatggatggcaacacaactgagaacatcaatgacacattcatcaagacactccagggacacgccctgaattccctaaccgagagcatgatggagaacctgcagcgtattatgcgcccacctgtaagttctaactcaaagactgcggcctgggtcactgaggggatgtatagtttttgttaccgcgtaatgttcgaggcgggctatctcacaattttcggccgggacttgacgcggagggatacccaaaaggcacatattctcaataacctcgataatttcaagcagttcgataaggtgtttcccgccctcgtggctggactgcccatccacatgttcagaacagcacataatgctcgtgagaagctggcggagagcctcagacacgaaaatctgcaaaagcgagagagcatatctgagctcatctccctaagaatgttcctcaacgacactctttctacgtttgatgatctggagaaagccaagacacaccttgttgtactctgggcttcacaagccaacaccattccagccacattttggtccctgtttcagatgattcgaaatcctgaagctatgaaagctgccaccgaggaagttaaacgcaccctcgagaacgcaggccagaaggtttcgctggaaggcaacccaatttgcttaagccaggcagagctcaacgatctgcctgtcctcgatagcattatcaaagaatctctcagactgagctccgcatcactcaacatcaggactgccaaggaggactttactctgcacttagaggacggaagctataacatcagaaaggacgatattatagcactctaccctcagctgatgcacctggaccccgagatttaccctgacccattgaccttcaagtatgataggtacctagatgagaatgggaagaccaagactactttttattgtaatggcctaaagctgaagtactactacatgcctttcggatcaggggccactatctgtcctggcaggctgtttgcaatccatgagattaagcaattcctgattctgatgctgtcttattttgagcttgagctgatcgaggggcaagcaaagtgccctccactggatcagagcagggcgggcttgggaattctgccgcctctgaacgacattgaattcaaatacaagtttaaacacctc

SEQ ID NO: 249930 - DNA, 1512 bp, Artificial Sequence
  Description of Artificial Sequence: Synthetic coding sequence
atgatgactacctctcttatctgggggattgcaatcgcggcatgttgctgtctttggctcattctgggtattcgccgtcggcaaactggagaacccccgcttgaaaatgggctgataccctacctggggtgcgcgttgcagttcggtgccaaccccctggagttccttagagcaaaccaacgtaagcacggacatgtctttacctgcaaactgatgggtaagtacgtccacttcattaccaatccgctgtcgtaccataaggtgctgtgtcacggaaagtactttgactggaagaagtttcattttgcaacctcagctaaggcatttggacacagaagcattgaccctatggacggaaacaccaccgaaaacattaacgatactttcataaagactttgcaagggcacgcgcttaactctctgaccgaatcgatgatggaaaatctccaacgcatcatgcggccacccgtgtcgtccaactcgaaaactgctgcctgggtaaccgagggaatgtacagcttttgttaccgggttatgtttgaagcaggctacctgaccatctttggccgggatttgacgcgccgcgatactcagaaggcacatattcttaacaacctggataactttaaacaatttgacaaagtgttccctgcacttgtggcgggactccccattcatatgttccggaccgcacataacgccagggagaagctggctgaatcacttcgccatgagaacttgcaaaaacgagaatcgatatcggaacttatctctcttcggatgtttttgaatgatactctgagcacctttgacgaccttgaaaaagccaagactcatctggtcgtgctttgggcaagccaggcaaatactattcccgccaccttttggtccctgtttcagatgatcagaaaccccgaagcaatgaaggcggcaaccgaagaggtgaagagaaccctggagaacgcaggacagaaggtgtcactggaaggcaacccaatatgtttgtcgcaagcggaactgaatgaccttcccgtgctcgattccatcatcaaagaatcgctgcgcctgtcctcagcatcacttaacatcaggactgcaaaagaagatttcactctccatctggaggatggctcctacaacattagaaaagatgacatcattgcactctaccctcagctgatgcatcttgatccagagatttaccctgacccactgacctttaagtacgacagatacctggatgaaaatggaaagacgaaaactactttttactgtaacggtcttaaacttaagtactactacatgccatttggcagcggagcgaccatctgtcctggacggctctttgcaattcacgagatcaaacaatttctgatattgatgcttagctacttcgagcttgagcttatcgaaggccaggctaagtgcccgcccctggatcaatcacgtgcagggcttggtattctgccacctctgaacgacatagaattcaaatacaaattcaagcacctg

SEQ ID NO: 249931 - DNA, 1512 bp, Artificial Sequence
  Description of Artificial Sequence: Synthetic coding sequence
atgatgactacctcacttatatggggcatagctatcgccgcctgttgctgtctgtggttgatactggggattcggagacggcagactggagagccacctctggagaatggcctcatcccctatctaggctgtgccttgcagtttggcgccaaccctcttgaattcctgcgggccaaccagcgtaagcacggacatgtctttacttgtaagctcatggggaagtacgtgcacttcatcactaatcctctctcgtatcataaggtgctgtgccacgggaagtattttgactggaaaaagttccattttgccacttctgccaaagccttcggtcaccgttcaattgaccctatggacggcaataccaccgagaatatcaacgatacattcataaaaaccctgcagggccacgccttgaactcactgaccgagtccatgatggagaatctacagcggatcatgcgccctcccgttagctctaatagcaagactgctgcgtgggtgacagagggcatgtactcattttgctatagagtgatgttcgaagccggctacctcaccatatttggccgggacctgactagacgcgatacccagaaagcccacatcttgaacaatctggacaattttaaacaattcgacaaagtcttccctgcgctggtagctgggctgccaatccatatgttcagaacggcccacaacgctcgcgaaaagctcgcggagagccttcgacacgaaaacctccagaaaagggagagtatttccgagctgataagtctgagaatgttcctgaacgatacactctctactttcgacgacctggaaaaggcaaagacacacctggtggtgctgtgggcgtctcaggccaatacaatccccgccaccttttggagcctgtttcagatgatccgcaacccagaggccatgaaagcagcaaccgaggaggtcaaacgcaccctcgagaacgcagggcagaaagtatctctggaaggaaacccaatttgtctgtcgcaggccgaacttaacgatctcccagtgctggactctatcatcaaagagtctctccgcctctctagtgcatcattgaacatcagaactgctaaagaggatttcacgttgcacttggaagatgggagctacaatattagaaaggacgacattatagcgctgtatcctcaattgatgcacctggaccctgagatctaccccgatcccttgacgtttaagtacgataggtatctcgatgaaaacggcaagaccaagacaactttttattgtaacgggctaaaactcaagtactactatatgcccttcggatcgggcgcaacgatctgccctggcaggctcttcgctatccatgagattaagcagtttttgatcctcatgctttcctattttgagttagagctaatcgagggccaggccaaatgcccccccctagatcagtcccgagcaggactgggcattctgcctccacttaatgatatcgaattcaagtacaagttcaagcatttg

SEQ ID NO: 249932 - DNA, 1512 bp, Artificial Sequence
  Description of Artificial Sequence: Synthetic coding sequence
atgatgactacttccctgatttggggcattgccattgccgcatgctgttgtctttggctgatccttggaatccggagacgtcaaacgggggaaccgccattggaaaacggtcttattccttacctgggctgtgcattgcagtttggggccaaccctcttgagttccttcgtgcgaatcaaagaaagcatgggcacgtgtttacttgtaagttgatgggtaaatacgtccacttcataacgaacccacttagctaccataaggtgctttgtcatgggaagtactttgattggaagaagtttcattttgccactagcgcgaaggcattcggtcatcgttccatcgaccccatggatggaaacactactgaaaacattaacgacaccttcataaagactcttcaaggacatgccctcaactcgcttaccgagtcaatgatggagaaccttcaaagaattatgcggccccccgtgagctccaattccaaaactgcagcatgggtgaccgaaggaatgtactcgttttgttacagagtcatgtttgaagcaggttacctcaccatttttggacgggatctgacccgtcgcgatacccaaaaggctcatatactcaataaccttgacaatttcaaacaattcgacaaagtgttcccagcacttgtggcaggactgcctattcatatgtttcgtactgcacataatgcacgggagaaacttgcggaatcgcttaggcatgaaaacctgcagaagcgggaaagcatctcagagctgatttcccttcggatgttccttaacgatactctttcaacctttgatgatctggagaaggcaaagacccatctggtcgtgctttgggcgtcgcaagcaaacaccattccagcaactttttggtcactgtttcaaatgattcggaaccctgaggcaatgaaagcagctaccgaagaggtgaagagaaccctcgaaaacgccggtcagaaggtgtcactcgaaggtaaccctatttgcctgtcccaagcggaacttaacgatctccctgtccttgattccatcattaaagaatcgctgagactgtcgtcggccagcctgaacattagaaccgcaaaagaagattttacccttcatctcgaagatggatcgtacaacatccgcaaagacgatatcattgcgctctacccacagcttatgcatctggaccctgagatttaccccgaccccctgacctttaagtacgaccggtacctggatgagaatggcaaaactaagacgaccttttactgtaacggcctcaagctgaaatactactacatgccttttggttccggggctactatatgccctggaagattgtttgcaatccacgaaatcaagcagttcctcattcttatgctttcctactttgagttggagcttattgaaggacaggcgaaatgccctccacttgaccaatctagggcgggcctggggatcctccctccattgaacgatattgaattcaaatacaagttcaagcacctt

SEQ ID NO: 249933 - DNA, 1512 bp, Artificial Sequence; identical to SEQ ID NO: 249910
  Description of Artificial Sequence: Synthetic coding sequence

SEQ ID NO: 249934 - DNA, 1512 bp, Artificial Sequence
  Description of Artificial Sequence: Synthetic coding sequence
atgatgactacctcgctcatttggggaatcgcaatcgccgcctgctgctgcctttggttgattctgggcattcggcgcaggcagaccggagaaccgccattggagaatgggctcatcccatacctgggatgtgctctccagttcggagcgaatccgctggagtttctgagagctaaccaacgcaaacacggccatgtgttcacctgcaagttgatgggtaaatacgttcatttcatcaccaacccgctgtcataccacaaagtgctgtgtcacggaaagtacttcgactggaaaaagttccacttcgctacttccgcgaaggcgttcggacacagatcgatagaccccatggatggcaatactactgagaacatcaacgacacctttatcaagactttgcagggacatgcgctgaactcactgaccgaatcaatgatggaaaacctccagcgcattatgaggcctcccgtctcatctaacagtaagaccgccgcctgggtgaccgaaggaatgtactcgttctgctaccgcgtgatgtttgaggcgggatacctcaccattttcggacgcgacctcaccaggcgcgacacccagaaagcccacatcctgaacaacctcgataactttaagcagttcgacaaggtgtttccggcgctggtggcaggcctcccgatccatatgttcaggacggcgcacaacgcgcgtgagaagctggctgaatccctcaggcatgaaaacttgcaaaagagagagagcatctccgaactcatcagcctgcgcatgttcctgaacgacaccctctcaaccttcgatgatctcgaaaaggccaagacccacctggtggtgctgtgggcatcgcaggctaatactatccctgcaaccttctggtcgctgtttcaaatgatcaggaacccagaggccatgaaggctgccactgaagaagtgaaacgaacgctggaaaatgccggacaaaaagtttcgctggaaggcaacccaatctgcctttctcaggccgaactgaacgacctgcctgtgctcgattcgatcattaaggagtcactgcggctgtcctcagcatccctgaacatccgcactgccaaggaagatttcactctgcatctcgaggacggttcatacaacatccgcaaggacgacatcatcgccctgtacccccagctgatgcatttggaccctgaaatctacccagaccctctgacctttaagtacgatcggtacctggatgagaacggaaagactaaaaccaccttctactgtaacggactgaaattgaagtactactacatgccattcggatcaggcgcaaccatctgcccaggacgactttttgcgatccatgaaatcaaacaattcctgatcctgatgttgagctactttgagctggaactgatcgagggacaagcaaaatgcccgcctctggatcaaagcagagccggcctggggatcctccccccgctcaacgacatcgagttcaagtataagttcaagcatctg

SEQ ID NO: 249935 - DNA, 1512 bp, Artificial Sequence
  Description of Artificial Sequence: Synthetic coding sequence
atgatgaccacgtccttgatctggggcatcgcgatcgccgcttgttgctgcctgtggctcatcctgggaatcagacgccgccagactggagaaccgcccctcgaaaacggactgattccgtacttgggttgcgccctccagttcggcgctaatccgctggagttcttgcgagcaaaccagcgcaagcacggacatgtgttcacttgcaagctgatgggaaaatacgtgcacttcatcaccaacccgctttcataccacaaggtgctgtgccacggcaagtatttcgactggaaaaaatttcatttcgccacgtccgccaaggcgttcggtcatcgtagcatcgacccgatggatgggaataccaccgagaatatcaacgatactttcatcaagaccctgcaaggacacgccctgaactcgctcaccgaatcgatgatggagaatctgcagaggatcatgcggcccccggtgtcctcgaactcgaaaactgccgcatgggtcaccgagggcatgtacagcttctgctaccgcgttatgttcgaggcagggtacctcactatctttggacgcgatctcaccagacgggatacgcagaaggcgcacatcctgaacaacctggataattttaaacaattcgacaaggtgtttcctgcactggtggcaggccttccgatccatatgtttcggactgcgcacaatgcccgcgaaaagctggccgaatcactgcggcacgaaaacctccaaaaaagagaatccatcagcgagctcatctcgctccgcatgtttttgaacgatactctctcgaccttcgacgacctggaaaaggcaaagactcatctggtcgtcctgtgggcttcccaggccaataccattccagctacgttctggtcacttttccagatgatcaggaaccctgaagccatgaaggcggccaccgaagaagtgaagcggaccctggaaaatgcgggacagaaggtcagcctggaaggaaacccaatctgtctgtcacaagccgaactcaacgaccttccggtgcttgacagtatcatcaaggagtccctgaggctttcgagcgcgtccctgaatattcgcactgctaaggaggatttcactctgcatctggaggatgggagctacaacatccggaaggatgacataatcgccctgtatccgcagttgatgcatctcgaccctgaaatttaccctgacccgctgacctttaaatacgaccggtacctggacgagaacggaaagaccaaaactactttctactgcaatggactcaagttgaagtactactacatgccattcggctctggagcaaccatctgtcccggtagactgttcgctatccacgagatcaaacagttcctgattctgatgttgtcgtactttgaactcgagctgattgaggggcaagcgaaatgcccaccactcgaccaatcaagagccggtctgggaatcctcccacctcttaacgacattgagttcaagtacaagttcaagcacctc

SEQ ID NO: 249936 - DNA, 1512 bp, Artificial Sequence
  Description of Artificial Sequence: Synthetic coding sequence
atgatgaccactagccttatttgggggatcgcaatcgcagcatgttgctgcctttggctcatccttggaataagacgacggcagacgggggagccacctctcgaaaacggactcatcccctacctgggatgtgccctgcagtttggagccaacccccttgaatttctgcgtgcaaaccaacggaaacacggacatgtgtttacttgtaaactgatgggaaagtacgtgcactttatcacgaatcccctttcgtaccataaggtcctgtgtcatggcaaatactttgattggaagaaattccattttgccacgtcggcaaaggcttttggccatagatccatcgaccctatggacggcaataccacggaaaacattaacgacactttcattaagactcttcagggacacgcgcttaactcactgactgaatccatgatggaaaacctccaacggataatgcgtcctccagtgagcagcaacagtaagacggctgcctgggtgactgaaggaatgtactcgttctgttacagagtgatgtttgaagcgggctacctgaccattttcggaagggacctgactcgccgcgacacccagaaggcacatatccttaacaacctcgataacttcaaacaatttgataaggtgtttcctgccctggttgcgggacttccaattcatatgtttcgtactgcacataatgcacgcgaaaagctcgcagaaagcctgcgccatgaaaaccttcaaaagagagaatcaatttcggaactgatttcgttgcggatgttcctgaatgatactctttcgactttcgatgatctggaaaaggcgaaaacccatcttgtggtgctgtgggcgtctcaagcaaataccatccctgcaaccttttggtcactgttccaaatgatcagaaatccagaggcgatgaaggcagcgacggaggaagtgaagcgcaccctggagaatgcaggccaaaaggtgtcgctggaaggaaaccctatatgcctgtcccaagcagaactcaacgacctgcccgtccttgattcaatcatcaaagaatccctgagactgtcgtcggcatcccttaacattagaacggcaaaggaggattttactctccacctggaagatggatcgtacaacatcagaaaggatgacataattgcactctacccacaactcatgcacctggaccctgaaatctacccagatcctcttaccttcaaatacgacagatatcttgatgagaatggtaagactaagactaccttctactgtaatgggctcaaactgaagtactactacatgccctttgggtcaggagccactatctgtccaggcagacttttcgcaatacacgagatcaagcaatttctgatactgatgctgtcctattttgagctggaactcattgagggacaggcaaagtgtccaccccttgatcagtctcgcgcaggtctgggaattctccccccacttaacgatatagaattcaagtacaagtttaagcatctt

SEQ ID NO: 249937 - DNA, 1512 bp, Artificial Sequence
  Description of Artificial Sequence: Synthetic coding sequence
atgatgactacaagtttaatctggggcatcgccattgccgcttgctgttgtctatggctaatactcggcatccgccgcaggcaaactggcgaacctcccctggaaaatgggcttattccgtacttgggatgcgccttgcaatttggtgccaaccctctggagttcctcagagccaatcagaggaagcacgggcatgtgttcacctgtaaattgatgggcaagtacgtgcactttatcaccaatcccctatcctaccataaggtgctctgccatggtaaatatttcgactggaagaaattccattttgctacctccgctaaggctttcggccataggtctatcgatcccatggacggtaataccacagagaatataaacgatacctttatcaaaactctgcagggacatgcgcttaacagtcttacagaatcaatgatggaaaatcttcaaagaattatgcgcccacccgtgtcttccaattctaagactgccgcgtgggtgaccgagggtatgtactccttctgctatagggttatgttcgaggctggatatctcaccatctttggtcgggatctaactcgtcgtgacacccagaaggcacacatactcaataaccttgacaacttcaagcagttcgacaaagtcttccccgccctcgtggcaggactccccattcacatgttcagaacggctcataatgcacgggaaaagctggccgagtcccttcgtcacgagaacctgcagaaaagagaatctatttctgagttgatatcgctccgcatgttcctgaatgataccttatcgaccttcgacgacctcgagaaagctaagacccatttggtcgtgctttgggcctcacaggccaacactatccccgcgacattttggagcttgttccagatgatccggaatccggaggcgatgaaagccgctacggaggaggtcaagcgaacactggaaaatgctggtcagaaggtgtccctcgaagggaaccccatttgtctgtctcaggctgagctcaacgatctccctgttctcgactccattatcaaggagtccctaagattgtcctcggctagcttaaacatccgaacagccaaggaagacttcacacttcatctggaggacggatcgtacaacattcgcaaggatgatattatcgcgttgtacccacaacttatgcatctcgaccccgagatttatcccgacccccttacctttaaatatgatcgttatctcgacgagaatggtaagaccaagacgacattctactgtaatggcctcaagcttaaatactactacatgcccttcggttctggcgctaccatttgtcctggtaggctcttcgctatccacgaaataaagcagtttctcatcctcatgctctcatacttcgaactggaattgatcgaggggcaggcgaaatgccccccccttgaccaaagccgtgcaggcttggggatcctccctccacttaacgacattgagttcaaatataaatttaagcatttg

SEQ ID NO: 249938 - DNA, 1512 bp, Artificial Sequence
  Description of Artificial Sequence: Synthetic coding sequence
atgatgaccacgtccctcatttgggggatcgcaatcgccgcgtgctgctgcttgtggctcatacttggaattaggagacgacaaaccggagaaccacctctggaaaatggactgattccttacttgggttgtgcacttcaattcggagcgaatccgcttgaattcctgcgagcaaaccaaagaaaacatggtcatgtgtttacgtgtaagctgatggggaagtacgtgcactttatcaccaacccattgtcctaccacaaagtgctctgccacggaaaatacttcgattggaaaaagtttcattttgcgacttccgcaaaggcattcggacatagatccattgacccaatggatggcaataccactgaaaacattaatgatacctttatcaaaacgctccaaggtcatgcgctcaattcgttgaccgagtcaatgatggagaaccttcagcggatcatgcgcccacctgtgtcatcaaactcgaaaactgcagcttgggtcaccgaaggtatgtactccttctgctaccgggttatgttcgaagcagggtaccttactatattcggcagggaccttaccaggagagatacccaaaaggcccacatactgaacaaccttgacaactttaagcagttcgataaagtgtttccagcgctcgtcgcgggactcccaattcacatgtttagaactgcgcataatgcccgggagaagttggcagagtccctgagacatgagaatctgcagaagcgcgaaagcattagcgagcttatctcgcttcgaatgtttctgaacgatactctgagcaccttcgatgacctggagaaggcaaagacgcatctcgtggttctgtgggctagccaagcaaacaccattccagcgacgttctggtccctcttccagatgatccgtaaccctgaggcgatgaaggcagcaaccgaggaagtgaagagaacccttgaaaacgctgggcagaaggtcagcctcgagggtaaccccatttgtctctcgcaagccgagctgaatgatcttccagtgcttgattccatcataaaggaatccctgcggctctccagcgcgtccttgaacatccgtactgcaaaggaagattttactctgcatcttgaagatggatcatacaacataagaaaagacgacatcatcgctctgtatcctcagcttatgcatttggatcctgagatttacccagatcccctgactttcaagtacgatcgctaccttgatgagaacggtaagactaagactaccttttactgtaatgggttgaaacttaagtactactacatgcctttcgggtcgggcgcaactatttgtcctggccgtttgttcgccattcatgagatcaagcaatttctgatccttatgctcagctactttgaattggaacttatagaaggccaggcaaagtgtcctcctctcgatcagtcgagagcaggccttggcattcttccccctcttaacgacatcgagttcaagtacaaattcaaacacctt

SEQ ID NO: 249939 - DNA, 1512 bp, Artificial Sequence
  Description of Artificial Sequence: Synthetic coding sequence
atgatgacaacgtccttaatttggggtatagcaattgccgcttgttgttgtctctggttaatcctcggaatcaggcgcagacagacaggggagcctccactggaaaatggactcataccctatctgggttgtgccctgcaatttggggccaatccgctggaattcttacgtgctaatcagcggaaacacggtcacgtctttacatgtaagctcatgggcaaatatgtccattttatcactaatccactgtcctaccacaaggtactgtgtcacgggaaatattttgattggaagaagttccactttgccacgtccgcaaaagcattcgggcatcggagcatcgatccgatggatggcaacaccacagaaaacattaatgataccttcataaagacactccaaggtcacgcactgaactccctgactgagtcaatgatggagaacctccaaagaatcatgcgccccccggtatcctcgaactccaaaaccgccgcatgggtgactgaaggaatgtactctttttgctatcgggtcatgtttgaagccggctatttgacaatttttgggagagatctgacacggcgtgacacacagaaagcccacatcctaaataatttagacaatttcaagcagttcgataaagtgtttccagctttggtggctgggctgccaatccacatgtttcgcaccgctcacaacgcgcgggagaagctcgcggagtctctccgacacgagaacctgcagaagagagaatcaatatccgagctgatttctctgcgcatgtttctgaacgatacactgagtacctttgacgatctcgagaaggcgaaaacccaccttgtagtactgtgggccagccaagcaaatacgataccagccaccttttggtcactcttccagatgataaggaaccctgaagctatgaaggctgcaacagaggaagtcaagagaacacttgagaacgctgggcagaaagtctccttggagggcaacccgatatgtctgagccaggcagagttgaatgatctgcctgtgttggactccatcatcaaagagtctctccgcttatcttctgccagtctgaacattaggacagctaaagaagacttcacactccacctagaggacggctcatacaacatcaggaaagacgatatcattgctctgtatccccaactcatgcatctggacccggagatttatccggatcctttgacgtttaaatacgatcggtatctggacgaaaatggaaagaccaaaacaaccttctactgtaatggactgaaactgaaatactactacatgccattcggatccggtgccaccatttgccctgggcgccttttcgccattcacgaaatcaagcagttccttatcctgatgttatcttatttcgagttggagctcatcgagggtcaagcaaagtgccctcccctggaccagagccgggctggactgggaattcttcctcccctcaatgatattgagttcaaatacaaatttaagcacctg

SEQ ID NO: 249940 - DNA, 1512 bp, Artificial Sequence
  Description of Artificial Sequence: Synthetic coding sequence
atgatgaccacatcactgatctggggaattgctattgcagcgtgctgctgcctgtggctgattttaggcatccgcagaagacagactggcgaacctcccttggagaacggtctcattccatacctcggctgcgctctgcagttcggggccaacccacttgagttccttagggcgaaccaaaggaagcatgggcacgtgtttacatgtaagctgatgggcaaatacgtccatttcatcacgaatccacttagctaccataaggtgctgtgtcacggcaaatattttgattggaagaaatttcactttgcgacatcagccaaagcttttggccacaggagcatcgaccctatggacgggaacaccaccgaaaacatcaacgacacatttattaagaccctgcagggccatgcactcaactcattgaccgaatccatgatggaaaatcttcagcgcataatgagaccacctgtgtcctctaacagcaagaccgcagcctgggtcaccgagggaatgtatagcttctgctacagggttatgttcgaggctggatatctgacaatcttcggcagagatctgactcggagggacacacaaaaggcacacattttgaacaacctggataatttcaaacaattcgataaggtttttccggccctcgtggcggggcttcctattcacatgttcagaactgcccataacgcaagagaaaaactggctgaaagcctgagacatgagaatctgcagaaaagggagtcaatcagcgaactgatctcgctgcggatgtttctgaacgacactctgtcgacattcgatgacttggaaaaagctaaaacccatctggtggtcctctgggccagtcaggcaaacaccatcccggcaaccttctggtccctttttcagatgattcggaacccagaggctatgaaggcggccacagaggaagtcaaacgaacattggaaaatgctggacaaaaagtgtcactggaaggaaatcctatctgcctctcgcaggcagagctcaacgatctgcctgtgctcgattctattatcaaggaaagcctgcgcttgagctcagcaagcctgaatatcagaacagccaaggaagactttacactgcaccttgaagacggaagttataacattaggaaggacgatatcattgcgctttatccgcaactgatgcatctggaccccgagatctacccagatcctcttacatttaagtacgacaggtacctggacgaaaacgggaaaactaagaccactttctactgcaacgggctcaaactcaagtattactacatgcctttcggaagcggagccaccatctgtcctggacgtctgttcgcaattcacgagatcaaacagttcctaatcctgatgctttcatactttgagctagaactgattgagggtcaagccaagtgccctccactcgatcaaagcagggcagggctgggtatccttccgcctttgaatgatatcgaattcaaatataaatttaaacaccta

SEQ ID NO: 249941 - DNA, 1512 bp, Artificial Sequence
  Description of Artificial Sequence: Synthetic coding sequence
atgatgactacgtccctgatttggggtatagctatcgctgcttgttgctgtctttggcttattctgggtattagacgtcgacaaaccggagaacctccactggagaatgggcttatcccctacctgggttgcgcgcttcaattcggagcaaacccactcgagttcttgagagcaaaccaacgcaagcacgggcatgtgttcacctgtaagctcatgggaaagtacgtgcatttcataacgaaccctctttcgtatcacaaggttctttgtcacgggaagtacttcgactggaagaagttccactttgctactagcgccaaagcatttggccatagatcaatcgacccgatggatggtaatacgaccgaaaacatcaatgacacgttcattaagactctccagggacatgcattgaactccctgaccgaatcaatgatggaaaacctccagagaataatgcggcctccagtctcttccaacagcaaaactgcagcatgggtgactgaaggtatgtacagcttttgttaccgggtcatgtttgaagcaggttacctgaccatctttggcagggatctgactcgccgcgatacccaaaaagcccatatactgaacaacctggacaactttaaacaattcgataaagtctttccagcactcgtggcagggcttcccatccacatgtttaggaccgcacataatgcaagggaaaagctcgcggaatcgcttagacacgaaaatcttcaaaagagagaatccatttcagaacttatttcgctccgcatgtttcttaatgatactttgtcgacctttgacgatctggaaaaagccaagactcatcttgtggtgctttgggcatcgcaagcaaataccatcccagcaaccttttggtcgctttttcagatgatccgcaatcctgaagcgatgaaggcagccaccgaagaagtgaaacggactttggagaatgccgggcaaaaagtgtcccttgaaggcaacccaatctgcctttcgcaggcagagctgaatgacctcccagtcctggactcgataatcaaggaatcactgcgcctcagctccgcctccctcaacattaggaccgcaaaggaggacttcaccctgcaccttgaagatggttcctacaacatacgcaaggatgacataattgccctctacccccagcttatgcacctcgatccagagatatatcctgaccccctcacttttaagtacgaccgatacctggatgagaatggtaaaactaagactacgttttactgcaatggccttaagctcaaatactattacatgccattcggatcgggtgccaccatttgtccggggcgcctttttgcgatccatgaaatcaaacagtttcttattcttatgctttcctactttgagcttgaacttatcgaaggccaagctaagtgtccccctttggaccaatcgcgcgccggacttggaatccttccgccactgaacgacatcgaattcaagtacaagtttaagcatctc

SEQ ID NO: 249942 - DNA, 1512 bp, Artificial Sequence
  Description of Artificial Sequence: Synthetic coding sequence
atgatgactacgtctcttatctggggaatcgcgattgccgcctgctgctgtctctggctgatccttgggatcagacggaggcaaaccggtgaacctccgttggaaaacggtctgataccatatctcggctgcgccctgcagttcggagcaaatcccctggagttcctgagggcaaaccagcgaaagcacggccatgtgtttacgtgtaagctgatgggaaaatacgtgcactttatcactaatccactctcctaccacaaggtgctttgccacggcaagtatttcgattggaagaagtttcactttgctacctcggctaaggcgttcggccaccgtagcattgatcctatggatggaaataccactgagaacatcaacgacaccttcattaagacgctgcaggggcatgccttgaactcattgactgaatcgatgatggaaaacctgcagagaatcatgcgccccccggtcagctcgaactctaaaaccgccgcctgggtgacggaaggaatgtacagtttctgctaccgggtcatgttcgaagcgggatacctcaccatctttggccgcgacctcacccggcgcgatactcagaaggcccacatcctcaacaacttggacaactttaagcaatttgataaagtgttcccggcactcgtggcaggactcccaatccacatgtttcgcactgcccacaatgcacgcgagaaactggcagaatcgcttagacatgagaatcttcaaaagagagaatcaatcagcgaactgattagtctccgcatgttcctgaatgacactctctccacttttgacgatttggaaaaagcaaagacccatctcgtggtcctgtgggcgtcgcaggcaaacactatcccggctaccttctggtcactgttccaaatgatacgaaatccagaggcaatgaaagccgctaccgaagaagtcaagagaaccctggagaacgcggggcagaaagtgtcactcgagggcaatccgatctgcctgtcgcaggctgagctgaacgacctgccggtcctggactccatcattaaggagagcctgcgcctgtcgagcgcctctctgaacatcagaacggcaaaagaggacttcactctgcacctggaagatggttcctacaatatcagaaaggatgacattatcgcgctgtaccctcagctgatgcacctcgacccggaaatctacccagacccactcactttcaagtacgatcggtacctggatgagaacggcaagaccaagaccaccttctactgtaacggattgaagttgaagtactattacatgcccttcggctcaggagccactatttgcccgggacggctctttgccattcatgagatcaagcagttcctcatcctgatgctcagctacttcgagttggaactcatcgaagggcaggccaagtgcccgccgttggatcaatcccgcgcaggtctgggaatacttcctccgctcaacgacatcgagtttaagtacaaattcaaacatctg

SEQ ID NO: 249943 - DNA, 1512 bp, Artificial Sequence
  Description of Artificial Sequence: Synthetic coding sequence
atgatgaccacctcgctgatttgggggatcgcgatcgcagcctgctgctgcctgtggctcatcctcggaatccgcagaaggcagactggagaaccaccgcttgagaatggactgatcccgtacctgggctgcgcccttcagttcggagcgaaccctctcgagtttctgcgcgccaaccagcgcaaacatggacacgttttcacctgcaagctgatgggcaagtacgtgcacttcattactaacccgctgtcataccacaaagtgctgtgccacgggaaatactttgactggaagaagttccacttcgcgacctcggcgaaggcatttggacacaggtcgatagatccaatggacggaaacaccactgaaaacattaatgacacctttatcaagactctccagggacacgctctcaattccctgactgaatccatgatggaaaacctccagagaatcatgaggccccccgtctcgtcgaactcaaaaaccgccgcgtgggtcaccgagggcatgtactcgttttgttaccgtgtgatgtttgaagccggatatctgaccatcttcggacgggatttgactcgcagggatactcaaaaggctcacatcctcaacaacctcgataactttaagcagttcgataaggttttcccagctctggtggctggactgccaatccacatgtttaggactgcccacaatgcccgggagaagctcgcggagtcgctccggcatgaaaacttgcagaaacgcgagtccatcagcgagctgatctcactgcggatgttcttgaacgataccctgtcgacgttcgacgatctggagaaggcaaagactcatctggtggtgctgtgggcgtcacaagccaacaccatccctgcaactttctggtccttgttccagatgatcagaaatccggaagcgatgaaggccgccactgaagaggtcaagagaacgcttgaaaacgccggccagaaggtgagcctcgaaggcaatcctatctgcctcagccaagccgaactgaatgacctgccagtgttggactccatcattaaggagagcctcaggctttcgtcagcctcccttaacatccgcactgcaaaagaagatttcaccctgcatttggaagatggatcctacaacattaggaaggacgacatcatcgctctctacccgcaactcatgcacctggacccggaaatctaccctgacccactgactttcaagtacgaccgctacttggacgaaaatggcaaaaccaagaccaccttctactgcaatggacttaaactgaaatactactacatgccattcggctcaggcgctacgatctgtccaggccggctcttcgctatccatgagatcaagcagttcctgatcctgatgttgtcgtatttcgagcttgaactgattgaaggccaggctaagtgccccccactggaccagtcacgggcgggattgggaatcctgccgccgctgaacgatatcgaattcaagtacaagtttaagcatctc

SEQ ID NO: 249944 - DNA, 1512 bp, Artificial Sequence
  Description of Artificial Sequence: Synthetic coding sequence
atgatgaccacaagcctgatatgggggattgctatagccgcctgttgctgcctgtggctaatcctcggcatcaggcggaggcaaacaggcgagcctccactggaaaatgggttgatcccctacctaggatgcgctctccagtttggggctaatccgctcgagttcctgagggcaaaccagcgaaaacacggccacgtttttacctgcaaactcatgggcaagtatgttcactttataacaaatcctctttcttatcataaagtgctgtgtcatgggaagtatttcgactggaaaaaatttcacttcgctacatccgccaaagctttcggtcataggtccattgatccaatggacggtaatacaacagaaaatatcaacgatacctttattaaaactttacagggccatgccctcaacagcctcaccgagtctatgatggagaatcttcaaagaattatgagaccacctgtgagcagtaactcaaaaacagctgcctgggtgaccgagggcatgtatagcttttgttacagggtcatgttcgaggccggctacctgacaattttcgggcgggatctgactagaagggatacacagaaggcccacattttaaataatctcgacaactttaaacagtttgacaaggttttccctgccctggttgctggactgcccatacacatgtttagaaccgctcacaacgctagagagaagttggctgagagccttcggcatgagaatttacagaagcgggaaagcataagtgaactcataagcttgaggatgtttctaaacgatacactgagcaccttcgatgatctggaaaaagcaaagacccacctggttgttctatgggcatcacaggcaaacaccatccccgccaccttttggagtctgttccagatgattagaaatccagaagctatgaaggctgctactgaggaagtaaagcgaacactggagaacgctggccagaaggtgtccctggagggaaatcctatctgcctctcccaggctgagctgaacgatctacctgtcctcgacagcataattaaggaatccttaagactgtcaagtgcatctctgaatataaggaccgctaaggaagatttcactctgcacctggaggacggatcctacaacattaggaaggatgatattattgctctgtaccctcaactgatgcacctggatccagaaatctatcccgatcctctaacttttaagtatgacaggtatctggatgagaacggaaagaccaagacaaccttttattgtaacggcttgaagctaaagtattattatatgcccttcggaagcggggccaccatatgccccggaagattattcgccattcacgaaattaagcagttcttaatcctgatgctaagctattttgagctggaactgatagaaggtcaggctaagtgccctcctctagatcagagcagggctgggctcggcatactgcctcccctgaacgatatcgagtttaagtacaaattcaagcattta

SEQ ID NO: 249945 - DNA, 1512 bp, Artificial Sequence
  Description of Artificial Sequence: Synthetic coding sequence
atgatgacaacttctttaatatggggaatcgccatagcagcgtgctgttgcttgtggctcattctcgggattcgccgcagacagaccggggagccccccctcgagaatgggctgattccctatctggggtgtgcgctacaattcggtgccaatcccctcgaatttctgagggccaatcagcggaagcatggtcatgtgtttacttgcaaactgatgggcaagtacgtgcactttataacaaaccccctttcatatcacaaggtactctgtcacgggaagtacttcgattggaaaaaattccatttcgcaacatctgcgaaagcatttgggcaccggtctatagatccaatggatggaaacacaactgaaaatattaacgacacctttattaagacactgcagggtcatgccctcaacagcctcaccgagtcaatgatggaaaacttacagcgtattatgaggccacctgtaagcagcaactctaagaccgcggcatgggtcactgaaggcatgtactccttttgttaccgggtgatgttcgaggccggttaccttaccatttttggacgggacttaaccaggagggatacccaaaaggcccacattctgaataatcttgacaactttaagcagttcgacaaagtattccccgcactggtggcgggccttccaattcatatgttcagaaccgcccacaacgcaagagaaaaactggccgagtcactacgtcacgaaaacctgcaaaaacgggaatcaatttccgagctgatttctctgagaatgttcctgaatgataccttgagtacctttgatgatcttgagaaggctaaaactcatcttgttgttctgtgggccagtcaggccaacacgatccccgcaacgttttggagcttatttcaaatgatcaggaatccagaggccatgaaggcagccactgaagaggtcaagcggaccttggagaacgcaggtcaaaaagtgagtttggaggggaatccaatttgtctatcgcaagccgagctgaatgatctgccagttttggattccataattaaagaatcattgcgtctgagtagtgcatcgttaaacataaggactgcaaaggaggatttcaccctccacctggaggatgggagctacaacatccgaaaagatgatatcatcgccctataccctcaactgatgcacctggaccctgaaatttaccccgatcccctgacgttcaagtacgacaggtacctggacgagaacggtaagactaagactacattctactgtaacggcttgaaacttaagtattactatatgcctttcggcagcggggctaccatttgccctgggcggctgtttgctatacatgaaattaaacagtttctcattctcatgctgagctactttgagctggaattaattgaaggacaagcaaaatgtcctcccttagaccagtctcgagcaggtcttggcatcctccctccattaaacgacatcgaattcaaatataagttcaaacatctt

SEQ ID NO: 249946 - DNA, 1512 bp, Artificial Sequence
  Description of Artificial Sequence: Synthetic coding sequence
atgatgactacttcactgatctggggtatagcgatcgccgcttgctgttgtctgtggctgatcttgggaatcaggcggagacagaccggagagcctccactggagaatggcctgatcccatacttggggtgcgcccttcagttcggggcgaatcctctagaatttctgcgggcgaatcagcgcaagcatggccacgtgttcacgtgcaaactgatgggaaagtacgttcacttcattactaacccccttagctaccacaaggttctgtgccacggcaagtacttcgattggaagaaattccacttcgccacctctgcgaaggcattcgggcatcggtctatagatcccatggacggtaatacgacggagaacatcaacgatacctttatcaaaacattgcaggggcacgctttaaacagtctaactgaatccatgatggagaacctgcagcgcataatgagacctcccgtttccagtaacagcaagacagccgcctgggtgaccgagggaatgtattcattttgctatagggttatgtttgaggctggttatctgacaatcttcgggagggacctgacgagaagagatactcaaaaggcacacatcctgaacaacctcgacaacttcaaacagtttgacaaggtgtttcccgccctcgtggccggtctgccgatccatatgttcaggactgcccataacgccagagaaaagctggcagagtccctgcgccacgaaaatctgcaaaagagggagtctatcagcgagttgatttcactgagaatgtttctgaatgatacactctcaaccttcgatgacctggagaaagccaaaacccatctagttgttctgtgggccagccaggctaatacaatcccagcaaccttctggagcctgttccagatgattagaaatcctgaagctatgaaggcggccacagaagaggtcaagcggactttagagaacgccggccagaaagtgtccttggagggcaatcccatatgcctgtctcaggccgagcttaacgacctgcccgtgcttgacagcatcatcaaagaaagcctgcgattgtctagcgcctccctcaacatccgcaccgctaaagaggacttcacgctacatctcgaggacgggtcttataatattcggaaagacgacatcattgccctgtatcctcagcttatgcatctggaccctgagatctatcccgatcctctaacatttaagtacgaccgatatctggacgaaaacggaaagactaaaactactttttactgcaatggattaaagctgaagtactattacatgcctttcggcagtggggcaactatttgcccaggccgactgtttgctatacacgaaattaagcagttcctgatcctgatgcttagctactttgagctcgagctcatagaaggccaggccaagtgtccccctctggatcagtccagggccggccttggtatcttgccaccactgaacgatatagagttcaagtataagtttaagcacctg

SEQ ID NO: 249947 - DNA, 1512 bp, Artificial Sequence
  Description of Artificial Sequence: Synthetic coding sequence
atgatgactacctctctgatatggggtatcgccatcgctgcctgttgctgcctgtggctaatcctcggaataagaaggcgtcaaaccggggagccaccactggagaatggcctcataccgtacctggggtgcgccctgcagttcggcgctaatcctctggaatttctccgagctaatcagcgcaagcacggccacgtgttcacctgcaagctgatgggcaagtatgtgcacttcattaccaaccctctgagttaccacaaagtactctgccacggcaaatactttgactggaagaagtttcatttcgcgacgtctgctaaggcattcggacaccggtctattgatcctatggacgggaacacaaccgagaacatcaatgacactttcattaaaactttgcaaggccatgctcttaactcactgaccgaatcaatgatggagaacttgcagagaatcatgcggcctcccgtttcaagcaacagtaagacggcagcctgggtgaccgaaggcatgtactcattttgctatagggtgatgtttgaagcgggctatctgacaatttttggcagggatttaacccggagagatactcaaaaagctcatattctgaataacctggacaattttaaacagtttgacaaagtgttccccgcacttgtggccggattgcccatccatatgttccgaacagcacacaatgctagggagaagctcgccgaatctctccgccatgagaacctacagaagcgcgagtccatctccgagcttatctccttgcgcatgttcctcaatgacacgctctcaactttcgacgatctggagaaggccaaaacacatctggtcgtcctctgggcaagccaagccaatactatccctgccaccttttggagcctgttccagatgatccgcaaccctgaggccatgaaggctgccaccgaagaggtgaagcgtacgctggagaatgcgggacagaaggtgagcttggagggcaatcctatctgcctgtcccaggccgagctgaacgatctgccagtgttggatagcataattaaagagtcccttaggctgagcagcgccagtttgaatataagaaccgcgaaggaagacttcaccctccacctcgaggacggctcatacaacataagaaaggatgacattatagccttgtacccacagttgatgcacctggaccccgaaatttatcctgaccccctgactttcaagtatgatcgctatttggatgaaaatggcaagaccaaaacaacgttctattgtaatggactcaaacttaagtactattacatgcctttcgggtccggggcaaccatttgccccggccgactctttgccatccatgagatcaaacaattccttatactgatgctgtcctactttgagctggaattgatcgaaggtcaggcaaaatgtccgcctctggaccaaagccgcgcaggactgggaatccttcctcccttaaacgatatcgagttcaaatacaagtttaagcatctg

SEQ ID NO: 249948 - DNA, 1512 bp, Artificial Sequence
  Description of Artificial Sequence: Synthetic coding sequence
atgatgactacctcgttgatctggggtattgcgattgcagcctgttgttgcctgtggcttatcctcgggattagaagaaggcagactggagagccgcccctggaaaacggcctcattccgtatcttggttgtgcgcttcaatttggtgctaatcctctcgaattcttgagagcgaaccaacggaagcacggacatgtttttacttgcaagctcatgggcaaatacgtccacttcataaccaaccctctctcctaccacaaagtgctgtgtcatggtaagtacttcgattggaaaaagtttcattttgctacgagcgcaaaggcttttggacaccgttcgatagatcccatggatggcaacactactgaaaacataaacgatacttttatcaagactcttcaggggcatgcactgaattcgctgaccgaatcaatgatggaaaaccttcaacggattatgcgaccgcccgtcagcagcaacagcaagactgccgcatgggtgaccgaagggatgtactcgttctgctaccgcgtgatgtttgaagcaggatacctgaccatatttggaagggacctgacccgcagggacactcagaaggcacatattctcaataatctggataacttcaagcaattcgataaggtgtttccagccctggtggccggacttccaattcatatgtttcgaactgcacacaatgcacgtgagaagctggcagagagcctcagacatgaaaacctgcaaaaaagggaatcgatttccgagttgatctcgcttaggatgtttctcaacgataccctcagcacgtttgatgatcttgaaaaagcaaagacccatctcgtagtgctgtgggcctcgcaagcgaataccattcccgcgactttttggtccctgtttcagatgataaggaatccagaagccatgaaagccgccactgaagaggtgaagcgcacccttgaaaacgcaggtcaaaaggtttctcttgaaggtaaccccatttgtctttcgcaggcagagttgaacgatcttccagtgctcgattcgataatcaaagagtctctgcggctgtcatccgcaagcctgaatatcaggactgcgaaggaggatttcaccttgcatttggaggacgggtcatacaacatcagaaaagacgacatcattgcgttgtacccccagcttatgcatctcgatcctgaaatctaccctgacccactgaccttcaaatacgaccggtacctggacgaaaacggtaaaaccaagaccaccttttactgtaatggtttgaagctcaagtattactatatgccgtttggctcgggtgcaaccatttgtcctgggagattgttcgcaatccatgagattaaacaatttctgatcctgatgctgtcatacttcgagcttgagttgattgaaggacaggcgaagtgcccaccgctcgatcaatcacgagctggactcggaattcttccgcctttgaacgacattgagttcaaatacaagtttaagcacctt

SEQ ID NO: 249949 - DNA, 1512 bp, Artificial Sequence
  Description of Artificial Sequence: Synthetic coding sequence
atgatgactacctcactcatttgggggatcgcaatcgcggcatgctgttgcttgtggctcatccttggtattaggaggcgtcaaaccggtgaacctcctctggaaaacggtcttatcccttacctgggttgcgcactgcagtttggtgctaaccccctggaattccttcgcgcaaatcagcgaaaacatggacatgtgtttacgtgcaagctgatgggcaagtacgtgcactttatcaccaatcctctgtcataccacaaggtgctgtgccacggtaaatactttgactggaagaagttccattttgccacctccgccaaagcatttgggcatcggagcattgacccgatggatggaaacactaccgaaaacatcaatgacacctttatcaagactttgcaaggacatgcactcaattccttgaccgaatcaatgatggagaacctccaaaggatcatgcgccctccagtctcttccaattcgaaaactgctgcatgggtgaccgagggaatgtactcgttttgttaccgtgtgatgttcgaagcgggatacctgactattttcggtagggaccttactcgtagagacacccagaaggcacacatccttaacaacctggacaactttaagcaatttgataaggtattccctgcactcgtcgccggactcccaatccacatgtttagaactgcacataatgcacgcgagaaattggccgagagccttagacatgagaatctgcaaaagcgggaatccatatccgaactgatctcgctgagaatgtttcttaacgatactctttcgacttttgatgatttggaaaaggcaaaaactcatctcgtggtgctttgggcttcccaagccaacactattcctgcaacgttttggagcctctttcaaatgatccggaacccagaagcaatgaaagcagcgaccgaagaagtgaagcgtactctggagaacgctggtcaaaaagtctcccttgaaggcaacccaatttgtctgtcgcaggccgagctgaacgatctccccgtgctggactcgattatcaaggaatcccttcgcctgtcgagcgccagcctcaatattcgcaccgcaaaagaagatttcactctccatctggaagatggttcatataacataagaaaagacgacattatcgcactctaccctcagcttatgcatctggatcccgaaatctacccggacccacttacgttcaaatacgacagatatcttgatgaaaatggaaaaaccaagactactttttactgcaacggccttaaactgaagtactattacatgccctttggatccggagccaccatttgtcctggacgcctgttcgcaatccacgaaatcaagcagttccttattctgatgcttagctattttgaattggaactgatcgaaggccaggcaaaatgtcccccacttgatcaatcacgcgcaggtcttggaattctgcctccacttaacgatattgaattcaaatacaagttcaaacatctt

SEQ ID NO: 249950 - DNA, 1512 bp, Artificial Sequence
  Description of Artificial Sequence: Synthetic coding sequence
atgatgaccacctctcttatctggggtatcgctatagctgcttgttgttgcctttggctgatcctgggcataagacgcaggcaaaccggagaacctccactcgaaaacggcttgatcccctacctgggctgcgccctgcagtttggagcaaacccacttgagtttctgagagccaaccagaggaagcacggacatgtttttacatgcaaactcatgggaaagtatgtgcacttcatcactaacccactttcataccataaggtcctttgtcacggaaaatactttgattggaagaagtttcacttcgcaacaagcgcaaaagcttttggtcataggtctattgaccctatggacggtaataccactgagaacatcaacgataccttcattaagactctccagggccatgctcttaactcattgaccgaatctatgatggaaaatcttcagaggatcatgcgccctcctgtgtcatccaactccaaaacagctgcctgggtaactgagggaatgtattctttctgctatcgcgtaatgttcgaggctggttacttgactatcttcggtagggatctgacaaggagagacacccagaaagcacatattctcaacaatctggataactttaagcagtttgacaaagtgttcccagcacttgtcgctggcttgccaattcatatgtttcgcactgcccacaacgcccgcgaaaagcttgccgaatcactgaggcacgagaatttgcaaaagagggagtccatctcagaacttatatctctgcgcatgtttttgaatgatacactgtctacttttgatgacctcgaaaaggccaagactcatctggtggtcctttgggcttcccaagcaaacactatccccgctactttttggagtttgttccaaatgatcaggaacccagaggctatgaaagcagctaccgaggaggtgaaacgcacactggagaacgccggacagaaggtgtcactcgaaggaaacccaatctgcctctcacaagctgaactgaacgacctccccgtgttggactccatcatcaaggagagcttgcgtctgagttcagctagtttgaacataaggaccgctaaggaggacttcaccttgcacctggaggatggcagttacaatatccgtaaggatgatataatcgccctgtacccacagctgatgcacttggaccccgagatctaccctgaccccctgactttcaagtatgaccgttatctggatgagaacggcaaaacaaagaccaccttctactgcaacggactcaagttgaaatattattacatgcctttcggtagcggtgccactatatgtccaggaagactcttcgccatccacgaaattaaacagttccttatactgatgttgagctatttcgagcttgaacttatcgaaggccaggctaagtgcccacctctggatcaaagccgtgcaggactcggcatcttgccacccctgaacgacatcgagttcaagtacaagttcaagcacttg

SEQ ID NO: 249951 - DNA, 1512 bp, Artificial Sequence
  Description of Artificial Sequence: Synthetic coding sequence
atgatgactacttcactcatctggggaattgccatagcagcctgctgctgcctatggctaatactcggaatccggagacggcagacaggggaacccccacttgagaatggactcataccatatctggggtgcgcactgcagttcggggctaatcctctggaattcttacgcgccaatcagaggaaacatgggcacgtgtttacatgtaaactaatgggaaagtatgtgcatttcattacaaaccctctctcctatcacaaagtgctctgccatgggaaatatttcgattggaaaaaattccatttcgccacttctgccaaagctttcggacacaggagtattgatccaatggatggaaatactacagaaaacatcaacgatacttttataaagacactccaggggcatgccctgaattccctgacggaatctatgatggaaaatctgcagcgcataatgcggccacccgtatcttccaattcaaagacagctgcttgggtgactgaagggatgtattctttttgttacagggtgatgtttgaggctggatatttaacaatattcggacgagacctcactagaagagatacacagaaagcgcacatcttaaataatctcgataattttaaacagtttgataaagtgttccccgccctggtggcgggactccctatccatatgttcaggactgcacacaacgcccgcgaaaaactggctgaatcacttcgccatgaaaatctccagaagagggaatccatttctgaactgatatcccttagaatgttcttgaatgatactctctctactttcgatgatctggaaaaagctaaaactcaccttgtcgtattatgggcatcccaggcaaatacaataccagctacattttggtccttgttccagatgataagaaatcccgaggctatgaaagccgctacagaggaggtaaaaagaacacttgaaaacgctggacaaaaagtgagtttagaaggaaaccctatctgtctgtctcaggcagagctcaatgatctacccgttctagattctatcatcaaagaatcactcagactgtcatctgcatccttgaacatcaggacagccaaagaggattttactcttcatcttgaagatggatcttataacatccggaaggatgatatcattgcgctatacccacagctgatgcatttggatcctgaaatctatcctgatccccttacattcaaatatgaccggtatctcgatgaaaatgggaaaacaaaaacaacattttattgtaacggactcaagcttaagtattattatatgccttttggatcgggggcgacaatatgccctgggaggctttttgccatccatgaaataaaacagttccttatcttgatgctctcttactttgaactcgagcttatcgaaggacaggcgaaatgtcctcctcttgaccagagtagggccggactggggattcttccccctttgaacgacattgagtttaaatataaattcaaacatctg

SEQ ID NO: 249952 - DNA, 1512 bp, Artificial Sequence
  Description of Artificial Sequence: Synthetic coding sequence
atgatgaccacgtcgctcatctggggaatcgctatcgctgcctgctgctgtctctggctgattctgggaatccggaggagacaaactggcgaaccgcctctggagaacggcctcatcccataccttggctgcgccctccagttcggcgcaaatcccctcgaattcctccgcgccaatcagcgaaagcacggtcacgtgttcacttgcaagctgatgggcaagtacgtccatttcattaccaatccactgagctaccacaaggttttgtgtcacggaaagtacttcgactggaagaaattccattttgctacctcggccaaggctttcggacaccgcagcattgatccaatggatggcaataccactgagaacatcaatgacactttcatcaagaccctgcaaggtcatgcgctgaactcgctgaccgagtcgatgatggagaatctgcagagaatcatgaggccaccggtgtcatctaactcaaagactgccgcatgggtcactgagggaatgtactccttttgttaccgcgtgatgttcgaggcggggtaccttacgattttcggccgcgacctgacccgccgcgatactcaaaaggcccatatcctgaacaatctggacaactttaagcagttcgacaaggtgttcccggccctcgtcgcgggtctgccgatccatatgttccggactgcccataatgccagagagaagctggccgagtccctcagacacgaaaacttgcagaagcgcgagtcgatttcggaactgatctccctgcgaatgttcctgaatgacacgctcagcactttcgatgatctggagaaagccaaaacccacctcgtcgtgttgtgggcgtcccaggcgaacaccattccggcgaccttctggtcgctttttcaaatgatccggaacccggaagcaatgaaagccgctactgaggaggtgaaacgcactctcgaaaatgctggccagaaggtttcgctcgagggaaaccccatctgcctgagccaagccgaactgaacgacctgccggtgctggattcgatcatcaaggagagcctccgcttgtcatcggcttccttgaatattcggactgcaaaggaggatttcactctgcatttggaggacggaagctacaacatccgcaaagacgacattattgcactgtaccctcaactgatgcacctggacccggagatctatccggacccgctgactttcaaatacgacagatacctggacgagaatggaaagactaagaccaccttctactgtaacggactcaagctcaaatactactacatgccgttcggtagcggagctaccatctgcccggggagactgttcgctattcatgaaatcaagcagttccttatcctcatgctctcctacttcgaactcgagctgatcgagggccaggccaagtgcccgccgttggatcaatcccgggctggactgggaatcctgccacccctgaatgacatcgaattcaaatacaagtttaagcatctc

SEQ ID NO: 249953 - DNA, 1512 bp, Artificial Sequence
  Description of Artificial Sequence: Synthetic coding sequence
atgatgaccacctcgctcatctggggcatcgcaatagctgcttgctgttgtctgtggctcattcttggcatccgtcgccggcaaacgggcgaaccaccccttgagaatgggctgattccatatctcggctgcgccctgcagtttggagccaaccccctcgagttcctccgtgccaaccagcgcaagcacggtcatgtttttacctgcaaactgatgggtaagtacgttcacttcatcacgaacccactctcttaccacaaggtgctctgccacggtaaatactttgattggaagaagttccattttgctacttccgcaaaggccttcggccaccgctctattgatccgatggatggtaacaccacggaaaatatcaatgacaccttcatcaagaccttgcaaggccatgccctgaactccctgactgagtccatgatggagaacctacagcgaatcatgcgcccgcccgtgtcttcaaacagcaagactgcggcctgggtgaccgagggaatgtactccttctgttatcgcgtgatgtttgaagctggctatctgaccatcttcggtcgtgatctgacccgtcgtgatacccagaaggctcacattctgaacaatctggataacttcaagcagttcgacaaggtcttccccgctctcgtagcaggcctgccaatccacatgttccgcactgcccataacgcccgcgagaagcttgctgagtcgctccgccatgagaatttgcagaagagagaaagcatcagcgaactcatcagccttaggatgttccttaacgacaccctctcaaccttcgacgacctggagaaggccaagacccatctggtcgttctctgggcctctcaggccaacacgatccccgcaaccttctggtcgctgttccagatgatccgaaacccagaggcgatgaaggccgccacggaggaagtcaagcgcaccctcgaaaacgccggacaaaaggtctctctagaaggaaaccctatctgcttgtctcaagccgaactcaacgatctgcccgtgctcgacagtataattaaggagtctttgagactttcgagcgccagcctaaacattcgtaccgccaaggaggatttcaccctgcacctcgaggatggtagttacaacatccgtaaggatgacatcatcgctctgtacccccagctgatgcacctggaccccgagatttatccggatcctttgactttcaagtatgaccgttacctcgacgagaacggcaagacaaagacgacgttttattgcaatggacttaagcttaagtattactatatgccattcggttcgggcgctaccatttgccctggacgcctcttcgccatccatgaaatcaagcagttcttgatcctgatgttgtcctattttgagcttgagctcatcgaaggacaggctaaatgtcctcccctcgaccagagtcgtgccggcctcggcattctcccccccctgaacgacatcgagttcaaatacaagttcaagcacctc

SEQ ID NO: 249954 - DNA, 1512 bp, Artificial Sequence
  Description of Artificial Sequence: Synthetic coding sequence
atgatgacgacctcgctgatctggggaatcgcgatcgcggcctgctgctgtctctggctgatcctcggtatccgccggaggcagaccggggagccgccgcttgagaatggacttatcccgtatctcggatgtgccctgcagttcggagctaacccgctcgaattcctgcgcgccaaccaaaggaaacatggccacgtgttcacttgcaagctgatggggaaatacgtgcacttcatcacgaacccactgtcataccacaaggtcctttgtcacggaaagtacttcgactggaagaagttccacttcgcaactagcgccaaggccttcggccacaggagtattgaccctatggacggaaacaccactgagaacattaacgataccttcatcaaaaccttgcaaggacacgctcttaatagcctcactgaatcaatgatggagaacctgcaacgcattatgcgtcctcctgtctcctcgaacagcaagactgcggcatgggtgactgaaggaatgtacagcttttgctaccgggtcatgtttgaggcaggctatcttactatcttcggaagggacctcaccagacgggatacccaaaaggcccatatcctcaataatctcgacaactttaaacagttcgataaggtctttccagcgctggtggcgggtttgccaatccacatgttcagaactgcacataacgcccgcgaaaagctggcagagtcgctgcggcatgaaaacctgcagaagagagaatccatctctgaactcatttcactgcggatgtttttgaacgacacccttagcaccttcgacgatctggagaaggccaagacccacctggtggtcctctgggcctcccaagccaacactatcccggcgacgttctggtcgctctttcagatgattcggaatccagaagcaatgaaagccgctaccgaagaagtgaaaagaaccctggaaaatgcgggacagaaagtctcgcttgaaggcaatccaatctgtctgtcgcaagccgagctcaatgatctgccggtccttgattctattatcaaggaatccctgagactgtcctccgcctcactcaacatccggaccgccaaagaagattttactctccacctggaagatggatcgtacaacatccggaaagacgacatcatcgccctctacccgcagctcatgcacctggacccggaaatctacccggacccactcacttttaagtacgacagataccttgacgagaacggcaagactaagactactttctactgtaatggactgaaactgaagtactactacatgccatttggtagcggagccacgatctgtccgggacgcctcttcgccatccacgaaatcaagcaattcctgatcctgatgttgagctattttgagctggagctcatcgaaggacaggctaaatgcccaccactggaccaatcacgggccggcctgggaatcctcccaccacttaacgacatcgaattcaagtacaagtttaagcacctg

SEQ ID NO: 249955 - DNA, 1512 bp, Artificial Sequence
  Description of Artificial Sequence: Synthetic coding sequence
atgatgaccacttcactgatctggggaatcgccatcgccgcctgctgttgcctttggcttatccttggaatccgtcgtagacagaccggagaaccgcctctcgagaacggactcatcccgtacctcggatgcgccctccagttcggtgctaacccactggagtttcttcgcgcgaaccaacggaagcacggtcatgtgttcacttgcaagttgatgggcaaatacgtgcactttatcaccaatcctctgtcctaccacaaggtgctgtgtcacggtaagtactttgactggaaaaagttccatttcgctacctccgcgaaggcgttcggccaccggagcatcgacccgatggacggtaataccacggaaaacattaacgacactttcattaagacgctccaaggacatgctctgaattccctgaccgaatccatgatggagaacctccaacggattatgcgcccgcccgtgtcaagcaactccaagactgctgcttgggttactgaaggtatgtactccttttgttacagggtcatgttcgaggccggatatctgaccattttcggtcgggacctgacccgccgcgacactcagaaagcgcacatcctcaataacctcgataacttcaaacagtttgacaaggtgttcccggcactggtggcgggattgcctatccacatgttccggactgcgcataatgcccgggaaaagctcgcggagagccttaggcatgagaatctgcagaaacgggagagcatctcggagttgatcagcctcagaatgttcctcaacgacaccctgtcaacttttgatgatctggaaaaggccaagactcatttggtggtcttgtgggcctcgcaggcaaacactatcccggcaactttctggtcactcttccaaatgattagaaatccggaagctatgaaggccgcgacggaagaggtcaaaaggactctggagaatgccgggcaaaaagtgtccctcgaagggaacccaatttgcctgtcacaagccgaactcaacgacttgccagtattggactcgatcatcaaagaatctctccggctgtctagcgcctcgctgaacattcgaaccgcaaaagaagattttaccctgcacctcgaagatggctcatacaacattcggaaggacgatatcatcgcgctgtacccccagctcatgcacttggatccagaaatctaccctgacccgctcaccttcaagtacgatcgttaccttgatgaaaacggcaaaactaagactaccttctactgcaacggactcaagctcaagtactactatatgcctttcggctccggcgcgacgatctgcccggggagactgtttgcaattcacgaaatcaagcagttcctgatccttatgttgtcctatttcgagctggaactgatagaaggacaggctaagtgccctccgctcgatcaatcccgcgccggactgggaatcttgccaccattgaacgacattgagttcaaatacaagttcaagcacctg

SEQ ID NO: 249956 - DNA, 1446 bp, Artificial Sequence
  Description of Artificial Sequence: Synthetic coding sequence
atggctgccgttcggatgttgaggacatggagtaggaacgcaggaaaattgatctgtgtaaggtacttccagacatgtggaaacgttcacgtccttaagccaaactacgtttgctttttcggctacccatcatttaagtattctcatccacatcactttctgaagacaaccgccgctcttaggggccaagtcgttcagtttaaacttagcgacattggcgaagggatccgggaggtgacagttaaagagtggtacgtgaaggagggcgatactgtttctcagtttgattcaatatgcgaggtacagtcggacaaggcctcagtcacgatcactagcagatacgacggggttatcaagaagctgtactataacttggatgatattgcctacgtcggcaaaccgttagtggatatcgaaacggaagcgctgaaagatagtgaggaagacgtggtggagactcctgccgtcagccatgacgagcacacccatcaggaaatcaagggacgcaaaaccctggcaacccccgccgttagaagactggcaatggagaacaacatcaagctgtctgaggtggtcggctccggtaaagatggaagaatcttgaaagaggacatcctcaattacctggaaaaacaaacaggagcaatcctccctccaagtcctaaagttgaaataatgcctccacccccaaaacctaaagatatgacagtgccgatcctggtcagtaaaccccctgtttttacaggcaaagacaaaactgagccaattaaaggttttcagaaggccatggtgaaaaccatgtcggctgctcttaaaatcccacacttcggatattgtgacgaaatcgacttgacagaattggtcaagcttagagaagaactgaaacctatagctttcgctcgcgggataaaactgtcttttatgcccttttttttgaaggctgcatcccttgggttgctgcagtttccaatattgaacgcttctgttgatgagaattgccagaacatcacctataaggctagccataacatcgggatcgcaatggataccgagcaaggcttaatcgttccaaacgtgaaaaacgtgcagatttgtagcattttcgatatagccaccgagttgaacaggcttcagaaattggggagcgtgagccagctgtctactactgaccttacaggaggtacattcaccctctctaatatcggaagtatcggcggaaccttcgctaaacctgtgatcatgcctcctgaggtggcaatcggagctctgggcagcatcaaagctatcccacgcttcaaccagaaaggcgaagtgtacaaggcacagattatgaatgtctcgtggtcagctgaccatagagtgatcgatggagcaacaatgagtaggttctctaacttgtggaaaagttatctggaaaaccccgctttcatgcttttggaccttaaa

SEQ ID NO: 249957 - DNA, 1446 bp, Artificial Sequence
  Description of Artificial Sequence: Synthetic coding sequence
atggccgctgttcggatgctccgcacctggagcagaaacgcaggcaaactgatctgcgtgaggtactttcagacctgcggcaatgttcacgtgttaaaaccaaattacgtgtgtttctttggatacccaagcttcaagtactctcatccacatcacttcctcaagaccacggccgccctgagagggcaagtcgtccagttcaagttgtcagacatcggggagggtatcagggaagtaaccgtgaaagagtggtacgtgaaagagggggataccgtgtcccagtttgacagtatctgtgaggttcaatccgacaaagcttctgtgacaatcacctccaggtacgatggagtaatcaaaaagttatattacaatcttgatgatatcgcctacgtaggtaaacccctcgtcgacattgaaaccgaggcactgaaggattcagaggaggacgtggttgagacacccgccgtgagtcatgacgaacatacacatcaagagataaagggccgcaaaacccttgcaacccctgccgttaggagactggccatggaaaacaatatcaagctatccgaggtggtagggagcggaaaggatggaaggatcctgaaggaagacattttgaactatctggagaaacagacaggagccatattgccaccaagtcctaaagtggaaattatgccaccacctccgaagcccaaagacatgaccgtgccaattctcgtgagcaaaccgcctgtgtttactggaaaagataagacagaacctatcaaaggcttccagaaggcaatggtcaaaacaatgtcagctgccctcaagatcccgcatttcggctactgcgacgagatcgacctgaccgaacttgttaagctccgcgaggagctcaagccaatcgcctttgcccgcgggataaaactaagctttatgccattttttctgaaggccgctagtctaggcctcctccagttccctattctgaacgccagtgttgacgagaattgtcaaaacataacatataaagcctcacacaacatcggcatcgccatggataccgaacagggactgatagtgcccaacgtgaaaaacgtccaaatatgcagtatcttcgacatagctactgaactcaatcgactgcagaaattgggctcagtctctcagttgtctacaaccgacctcaccggcggaacctttactctgagtaatatcggctccatcggcgggacattcgctaagcctgtcattatgccacctgaagtggccattggcgccctgggcagcataaaggctatccccaggtttaaccaaaagggagaagtctacaaggcacagataatgaacgtgtcatggagcgctgatcacagggtgattgatggggcaactatgtcacgattctcaaacctgtggaagagctaccttgagaaccctgcattcatgctcttggaccttaaa

SEQ ID NO: 249958 - DNA, 1446 bp, Artificial Sequence
  Description of Artificial Sequence: Synthetic coding sequence
atggccgcggtgaggatgctcaggacctggagtcggaacgcgggcaagcttatttgtgtacgatattttcagacgtgcggaaatgtgcatgtgctcaaacctaactatgtgtgtttctttggttacccctcctttaagtattcccaccctcatcacttcctgaaaaccactgcggccttgagggggcaggtggttcaatttaagttgtctgatatcggagagggtatccgggaagtgaccgtgaaggaatggtacgtgaaggaaggggacaccgtgagccagttcgactccatttgtgaggtgcagtcagataaagcttcagtcaccatcaccagccggtatgacggagtgatcaagaaactttactacaaccttgatgacattgcttatgtggggaagcctttggtcgacatcgaaacggaggcgctcaaggactccgaagaagatgtggttgaaacgcccgccgtctcccacgatgaacatactcaccaggagatcaagggccggaagactctggcaacaccagctgtacgaagattggcaatggagaacaacatcaagttgtctgaggtggtggggagtggcaaggatgggcgtatcctgaaggaggacatcctcaactaccttgaaaagcagacgggagctatcctccccccgagcccgaaagtggaaatcatgcctcctcccccaaaacccaaagacatgacagtacccatcctggtgagcaagccaccggtgttcacgggcaaagacaaaaccgaacctatcaaaggattccagaaggcaatggtcaagaccatgtcggctgctttgaagattcctcacttcggttactgtgacgagatagacttgaccgagctcgtgaaactgcgggaggagctcaaacctattgcgttcgccaggggcattaagctgtccttcatgccgttcttcctgaaggctgcgtcccttggattgcttcagtttccgattctgaacgcctcggtcgacgagaattgtcagaacataacctataaggcctcgcacaacataggcatcgctatggatacagagcagggcctgatcgtgccaaacgtcaaaaatgtgcagatttgtagtatcttcgacattgcgacagagctcaaccgcctacagaagctgggcagcgtgagccagctatcaacaacagacctgacgggcggcacgttcaccctgagtaatattggcagtataggtggaacatttgccaagcctgtgatcatgccgcccgaggtggccatcggcgctttgggctctatcaaggccatacctcgcttcaaccagaagggtgaggtctataaggcgcagatcatgaacgtcagctggagcgccgaccaccgcgtgatcgatggcgcaaccatgtctcggttctccaatctttggaaaagctacctggagaaccccgccttcatgctgctcgacctcaag

SEQ ID NO: 249959 - DNA, 1446 bp, Artificial Sequence
  Description of Artificial Sequence: Synthetic coding sequence
atggcagccgtgcgtatgctcaggacctggtccagaaatgcaggaaagctcatctgtgtgaggtatttccagacatgcggcaatgttcacgttctgaaacccaattatgtttgctttttcgggtatcctagctttaaatactcccatcctcatcatttcctgaaaaccaccgccgccctgcggggtcaggtggttcagttcaaacttagcgacatcggtgagggaattagagaagtgaccgtgaaagaatggtacgtgaaggaaggagacacagtgtcacagtttgactctatttgcgaggttcagagcgacaaagccagcgtgaccatcacatccagatacgacggcgtcattaaaaaattgtactataacttggacgacattgcctacgtgggcaagcctcttgtggatattgagacagaggccctaaaggactcagaagaggatgtcgtggagactcccgcagtctcacatgacgaacatacccatcaggagatcaaggggcgcaagactttagccacccctgccgtgcgacggctggctatggaaaacaatattaaactctctgaagtggtgggatcaggaaaagacggaaggattcttaaagaggatatcttgaactatctagaaaagcagacaggcgctattctcccaccctccccaaaggtcgagatcatgcccccgcccccaaaacctaaggacatgactgttcccatccttgtctctaagccaccggtgttcaccggcaaggacaaaaccgagcctatcaaaggatttcagaaagcgatggttaaaaccatgagcgcagctttaaaaatcccccattttggctactgcgacgaaattgacctgacagaactggtgaaattgcgcgaggaattgaaaccaatagcatttgccagaggcatcaagttatctttcatgcccttctttttaaaggccgcctctctcggcctgctacagttccccatccttaatgctagtgtggatgaaaactgccagaatataacttataaagcctcccacaacatcggcatcgcaatggacaccgagcagggtttgatagtcccgaacgtaaaaaatgtccagatctgctccatcttcgacattgcaaccgaactgaacagactgcagaagctggggtcagtctctcagctatctacgactgatctgaccggggggacctttacactgtctaatattggttcaattggcggaacttttgctaaacccgtcattatgccacctgaggttgccatcggcgctcttggaagcattaaagcaataccacgatttaaccagaagggggaggtgtataaagcccaaatcatgaacgtatcgtggtcagctgatcacagggtgatcgacggcgccacaatgagccgattttcgaatctgtggaaaagctaccttgagaaccctgcctttatgctgctggatctaaaa

SEQ ID NO: 249960 - DNA, 1446 bp, Artificial Sequence
  Description of Artificial Sequence: Synthetic coding sequence
atggccgcagtgaggatgctcagaacatggtcaaggaatgccggaaagctcatatgcgttcgatactttcagacatgcgggaacgtccacgtgctcaaacctaattacgtatgcttctttgggtatccctctttcaaatactcccaccctcaccattttcttaaaacaacagccgcactccgggggcaagttgtgcagtttaaactttcagatatcggggaagggatcagggaagttacagttaaagaatggtatgtcaaggaaggggatacagtgagtcagttcgattccatatgcgaagtgcagagtgacaaagcatccgtaacaataacatctaggtatgatggggttatcaaaaaactttattataatctggatgacatcgcctatgttgggaaaccccttgtggatatcgaaactgaagcattaaaagattccgaagaggatgtggttgagacacccgccgtaagtcatgatgagcatacacaccaggagattaaaggaagaaaaactctcgctacacccgccgtccggagacttgccatggaaaacaatataaaactcagtgaagtcgtcgggtcaggaaaagacgggcgtattctcaaagaagatatcctcaattatctagaaaaacagacaggagcaattctacctcctagtccaaaagtagaaatcatgcctcccccacccaaaccaaaagatatgactgtgcctatactagttagtaaacctcccgtatttactgggaaggataagactgaacctatcaaagggttccagaaggcgatggtaaaaacaatgagtgccgctctcaaaatacctcactttggatattgtgatgaaatcgatttaacagaacttgtcaagttgcgggaagagctcaaaccaatcgccttcgcgcgcggaatcaaactatcctttatgcctttctttcttaaagccgcctctctcgggcttctacagttccctattctcaatgctagtgttgatgaaaactgtcagaacatcacatataaagccagtcacaatatcggaatagccatggatactgaacaggggctgatagtacctaacgtcaagaacgttcagatatgtagtatcttcgacatcgcaactgaactaaacagactgcagaaactagggtccgtctctcagctcagtactactgatttaacaggagggactttcacactgtcaaatataggatctatagggggaacttttgctaaaccagtcatcatgccacccgaagtggctattggagctctaggatccatcaaggctatccctagatttaaccagaaaggagaagtttacaaagctcagatcatgaatgtctcttggagtgcggaccatagagtaatcgatggggcaactatgagtcgcttctccaacctctggaaatcatatcttgagaatccagcatttatgcttctcgatctgaag

SEQ ID NO: 249961 - DNA, 1446 bp, Artificial Sequence
  Description of Artificial Sequence: Synthetic coding sequence
atggccgccgtgcgaatgctgagaacctggagccgaaatgctgggaagctgatctgcgtgagatactttcagacatgtggaaacgtgcacgttctcaagccaaactacgtgtgcttttttggctacccgagtttcaagtatagccatccacatcactttcttaaaactaccgccgctttgcgagggcaggtcgtgcagtttaagctcagtgatattggagagggtatacgcgaagttaccgtgaaggaatggtacgtgaaggagggcgacacagtgagtcagtttgactccatctgtgaagtccaaagtgataaagcctcagttacgatcacgagcaggtacgacggagtaatcaagaaactttactacaaccttgacgacattgcctatgtgggcaaacccctggtcgacatagagacggaggcgttgaaagattcagaggaagacgtcgtggagactccggccgtgagccatgatgagcacactcatcaggagatcaagggtaggaaaaccctcgcgacccctgccgtgagaagactggccatggagaacaatatcaagctgagtgaggtggttggaagcggtaaggacggtcggatcttgaaggaggacatcttgaattacctcgagaaacagacaggcgccatactcccaccttctcccaaagtcgaaatcatgccccctccacctaagcccaaggatatgacggtccctatactggtgagcaagccgcccgtcttcactgggaaagacaagaccgagccgatcaagggatttcagaaagctatggtaaagaccatgagcgcagcgttgaagatcccgcacttcggatactgtgacgaaattgatctgaccgagctggttaagctccgggaggagctgaagccaatagccttcgctaggggcatcaaattgtccttcatgccctttttccttaaagcggcctcactcggcctgttgcagttccctattttgaacgcctctgtcgacgagaactgtcagaacataacatacaaagcatcccacaatattggcatcgccatggatacagaacagggcttgatcgtgcctaatgtgaagaacgtacaaatttgtagcattttcgatattgcgaccgaacttaatagactgcagaagctcgggtccgtttctcagctgtccactactgatcttaccggcgggactttcacactctctaatatcgggtccataggcggcacgttcgctaaacctgtaataatgccccccgaggtggcaatcggagccctgggatccattaaggccatcccgcggtttaaccagaagggggaagtgtataaggcccagattatgaacgtgagctggagtgccgatcaccgcgtaatcgatggggccaccatgtcacggttcagcaacctctggaagtcttatttggagaatccagccttcatgcttctggacctgaag

SEQ ID NO: 249962 - DNA, 1446 bp, Artificial Sequence
  Description of Artificial Sequence: Synthetic coding sequence
atggccgcggtgcgcatgctgcgcacctggtcccgtaatgcgggaaaacttatctgcgttagatattttcagacatgcggcaatgttcacgttcttaagcccaactatgtgtgtttctttggttacccctctttcaagtactcccacccccatcatttcctgaagacaaccgccgcacttcgcggccaggtggtgcagttcaagctcagtgacatcggtgaggggatcagggaggtgaccgtgaaagagtggtatgtgaaagagggagatactgttagccagttcgattcaatatgcgaggtacaaagtgacaaggccagtgtgactatcacatcaagatatgatggcgtgattaaaaagttgtactacaatctggacgacatagcttacgtaggaaagcctctggtcgacatcgaaaccgaggccctgaaagactccgaggaagacgtggtggagactcctgccgtttcccacgatgagcacacccaccaggagattaaaggtcggaaaacgctcgcgacacccgcggtccgcaggcttgccatggagaacaatatcaagctctccgaagttgtgggctctgggaaggacggccgaatcctgaaggaagatatcctgaattacctcgaaaaacagactggagcgatcctgccgccatcgccaaaggtggaaatcatgcctccgccccctaagcctaaagatatgaccgtccccattcttgtgtccaagcccccagtgttcacgggaaaagacaagacagagcctataaagggttttcagaaggccatggtcaagaccatgagtgctgctctgaagatccctcactttggctattgtgacgaaatagacctgacagagcttgtcaagttgagagaggaattgaagcccattgccttcgcgagaggaatcaagttgtccttcatgccttttttcctgaaagctgcatctcttgggctcctccagtttcctatcctgaatgcatctgtagatgagaactgccaaaacatcacatacaaagcctctcacaacattgggatcgcaatggacacggaacagggtttaatcgtgcccaacgtcaaaaatgtccagatctgttcaatttttgacattgccacggaactcaaccgcctccagaaactgggcagtgtgagtcaactgtccactacggacctcacagggggcactttcaccctctctaacattgggtcaattggcggtaccttcgccaagcccgtgattatgccacctgaggtggcaattggggcactcggttctattaaggctataccacgctttaaccagaagggcgaggtctataaagcccaaatcatgaacgtgagctggtcagccgaccacagggtgattgatggagcaacaatgtcccgtttttccaacctgtggaaatcctatctagagaaccctgcctttatgctgttggacctgaag

SEQ ID NO: 249963 - DNA, 1446 bp, Artificial Sequence
  Description of Artificial Sequence: Synthetic coding sequence
atggctgccgtccgaatgctgcgtacctggtcaagaaatgccggcaaactcatctgtgtcagatattttcagacctgtggcaatgtgcatgtacttaagcccaattatgtgtgtttttttggttacccaagcttcaagtattcccacccccatcatttcctcaagactacagccgctttgagaggacaagtggttcaattcaagctctctgatataggcgagggcatacgcgaggttaccgtgaaagaatggtacgttaaagaaggggacaccgtgtcccaatttgattccatctgtgaggttcagtccgacaaagccagcgttacaatcacttctcggtacgacggcgtcatcaaaaaactgtactacaacctcgacgacatcgcatatgtgggcaaaccactggtcgacatagagacggaggctctgaaggattccgaagaggacgtcgtggagacccctgcagtgtcacatgacgagcacacacaccaggagattaaaggacgtaaaactcttgccacccccgccgtgcgccgactcgccatggagaataatattaagttgtcagaggtggtcggttccggaaaggacggccgaatcctgaaggaagacatcctgaactacctcgaaaagcaaacgggcgctattctaccgccctcccctaaggttgagataatgccaccacccccgaaaccaaaagatatgacagtgccgatcctcgtgagtaaaccccctgtgttcaccgggaaggacaagactgagccaataaaaggctttcagaaggctatggtgaagaccatgtcagccgctctgaaaattccgcattttggctactgtgacgagattgacctgaccgaactcgttaaactgcgggaagagttaaagcccatagcttttgcgcgaggaatcaagctgtccttcatgcccttcttcctgaaggccgcctctttggggcttctgcagttccccatcctcaatgcctcagtcgatgaaaactgccaaaacatcacatacaaggcatctcacaatataggcattgctatggacactgagcagggactcatcgtccctaatgtcaagaatgttcagatctgttccatttttgatatcgccacagagctcaaccgcctgcagaaactggggtcagtatcccagttgtccaccacggatttaaccgggggaacgtttaccctgtcaaatattggaagcatcgggggcacattcgccaagcctgtcatcatgcctcctgaagtggcgatcggggctcttggcagcatcaaggccatccctaggtttaaccaaaagggggaagtctacaaggcgcagatcatgaacgtgtcatggtcggcggatcacagagtaatcgacggagctaccatgagcaggttctcaaatctgtggaaaagctacttggagaacccagcattcatgctgctcgacctgaaa

SEQ ID NO: 249964 - DNA, 1446 bp, Artificial Sequence
  Description of Artificial Sequence: Synthetic coding sequence
atggccgccgtgcgcatgcttcgaacttggagtcgcaacgctggtaagctcatctgtgttcgctactttcagacctgtggcaatgtgcacgtattgaagccaaactatgtgtgtttcttcggctaccccagcttcaagtatagccatcctcaccatttccttaagacgacggctgcacttcggggccaggtggtgcaattcaaactgtcagacattggagaaggcatcagagaagttacggtcaaagaatggtatgtgaaggagggagatactgtcagtcagttcgactctatctgcgaggtgcagtctgataaagcatcagtcacaattacctcaaggtatgatggagtgataaagaaactgtactacaacctggatgatattgcctatgtggggaagcccttggttgatatagagacagaggcattgaaagactccgaggaagacgtggtggaaacccctgccgtttcacatgatgaacacactcatcaggaaatcaaaggcagaaagaccctggccacgcctgctgtgaggcggctggctatggagaacaacatcaaactgagtgaggttgttggctctggcaaggatggacgcatcctgaaggaggacatactgaattatctggaaaagcagaccggagccatacttccccccagccctaaagtggagataatgccacctccgccaaaacctaaggacatgactgtgccaattctcgtgtccaagccccccgtgttcaccggcaaggataagaccgaacctatcaaagggtttcagaaggcaatggtgaaaacaatgagtgcagcactcaaaatcccacacttcgggtactgcgacgagattgacctcacagaactggtgaagctccgagaagagttgaagcctattgcctttgctaggggaatcaaactctcctttatgcccttctttctgaaggctgctagtctcgggcttctgcagttccccattttgaatgcctcagtagacgagaattgccagaacatcacatacaaggcctcccacaacatcgggattgcaatggataccgagcagggtctgatcgtacctaacgttaagaacgtccagatctgttccatctttgatatcgctaccgaactcaaccggctgcagaagcttgggtcagtgtcccagcttagcactaccgacctgacaggaggcacttttacattgtctaacatcggaagtataggaggcacatttgcaaagcctgtgataatgccccctgaagtcgcaataggggccctggggtcaatcaaggcaatccctcggttcaatcaaaagggggaggtgtacaaagctcagatcatgaacgtatcctggtccgctgaccaccgcgttatcgacggcgccacaatgagccgcttttctaatctctggaaatcttatctggaaaatcctgcgtttatgctcctggatctgaag

SEQ ID NO: 249965 - DNA, 1446 bp, Artificial Sequence
  Description of Artificial Sequence: Synthetic coding sequence
atggccgcggtgcggatgctgcgaacatggtcccggaacgctggtaaactgatttgtgtcaggtacttccagacctgcgggaacgtgcacgtgctgaagccaaactacgtgtgctttttcggctatccatcctttaagtattcccacccccaccactttctgaagacaactgccgcccttcgcggccaggtggtgcagtttaaactttccgacatcggggaaggcatccgggaagtgaccgtaaaagagtggtatgtcaaagaaggagacaccgtcagtcagtttgacagcatatgtgaagtacaaagtgataaggccagcgtgactatcacgtcccgctatgacggcgtgatcaaaaaactgtattacaaccttgatgatatcgcctacgtgggcaaacccctggtggatatcgaaactgaagcgctgaaggatagtgaggaggacgtagtcgagacaccagctgtgagccacgatgagcacacgcaccaagagattaaaggcaggaaaacattggcaactccggccgtgaggagactggctatggaaaataacatcaagttgtctgaagtcgtcggttcagggaaagatggtcgcattctgaaagaagatatcctcaattacctggaaaaacaaacaggggcaatattgccacccagcccgaaggtcgaaatcatgcccccgccacccaagccaaaggatatgaccgtgcccatcctcgtgagtaaaccgcctgtatttactggaaaggataagacagaacctattaaaggattccaaaaggcaatggtcaaaacaatgagcgcagcccttaagattcctcatttcggatactgcgacgagatcgatctgactgagctcgtgaagttgagggaggaactgaaaccgatcgcattcgcccgagggatcaaactttcttttatgccgtttttcttgaaggccgcttctctgggtctcctgcaattcccaatacttaatgctagcgtggatgagaactgccagaacatcacttacaaggcctctcataacatcggcatagctatggatactgagcagggactcatcgtccccaacgtgaagaacgtccagatttgtagcattttcgacatcgccacagagttgaacaggctgcagaaactgggttctgtttcacagctgagcaccactgatttgactggcggtactttcacactttccaatatcgggagcattggcgggacattcgctaagccagttatcatgcctccggaggtggctatcggggcacttggaagtattaaggccatccctaggtttaatcagaagggagaagtgtataaagcgcagattatgaacgtgtcttggtccgctgatcacagggtaattgacggggcaactatgtcacggttctccaacctctggaagtcctatctggagaatccggctttcatgctgttggacctgaag

SEQ ID NO: 249966 - DNA, 1446 bp, Artificial Sequence
  Description of Artificial Sequence: Synthetic coding sequence
atggccgcagttcgcatgctcagaacatggtcacgcaatgcagggaaactcatctgtgtaagatacttccagacatgtgggaacgttcacgttctgaaaccaaactacgtttgtttcttcgggtacccctcattcaaatattctcatccccaccacttcctcaagactacagctgccttacgcggacaggtggttcagtttaaactgtccgatataggagaagggattagagaagtcacagtgaaagaatggtatgtgaaagaaggagatacagtgtctcagttcgattctatctgtgaagtacaatcagataaagccagtgtaacaatcacttcccgctatgatggagtgataaaaaaactatattataatctggatgatatagcctatgtggggaaaccattggtggatatcgagacagaagcgctgaaagattctgaagaagatgtcgtggagacacccgctgtgagtcatgatgaacacactcaccaggaaataaaaggacggaaaacactcgccacacctgcggtgcgccggcttgctatggaaaataatatcaaactctctgaagtggtggggtcaggaaaggatggacggatcctgaaagaggatatccttaactatcttgaaaaacagacaggggccattctgccacccagtcctaaagtggaaattatgccaccaccaccaaaacccaaggatatgacagtccccatactcgtctctaaaccccccgtattcactgggaaagacaaaacagaacctataaaggggttccagaaggctatggtcaagacaatgtcagctgccctaaagatcccgcacttcggatattgtgacgaaatagacctaactgaactcgtgaaactacgggaggaactcaaaccaatcgccttcgcccggggaataaagctttctttcatgcctttttttctgaaggctgcgagtttagggcttcttcagttccctatactgaacgcctcggtggacgaaaattgccagaatatcacatataaagcttcccataacatcggaatcgcaatggatacagaacaggggctaattgttcctaatgtgaaaaatgtgcagatctgttccatcttcgatatcgcaacagaactaaacaggctccaaaaactcggatcagtctcacagctctctacaacagacctgacgggggggacattcacactatccaatataggatccatcggaggaactttcgctaaaccagttattatgccacccgaggtagccatcggagccctagggtccataaaagctatacccagattcaatcagaaaggagaagtttacaaagcccagataatgaacgtgagttggtctgcggatcacagggttatcgatggggccactatgtcacggttctctaacctgtggaagtcctacctcgaaaaccctgctttcatgctcctggatctgaaa

SEQ ID NO: 249967 - DNA, 1446 bp, Artificial Sequence
  Description of Artificial Sequence: Synthetic coding sequence
atggccgccgtgcgcatgctgaggacctggtcacgaaatgctggaaaactcatttgcgtgagatatttccaaacctgtgggaatgttcacgtcctgaaacccaattacgtgtgtttttttggctacccctcatttaaatactctcacccgcaccattttcttaagacaaccgcagcgctgcgcggacaggtggtccagtttaaactgtccgacatcggagagggcatcagggaggtgacagtgaaagagtggtatgtgaaggagggtgacacggtgtctcagtttgattctatctgcgaggtacagtccgataaggcctccgtgacaattacttctcgctacgacggggtcattaagaagttgtattataacttggacgacatagcctacgtgggcaagcctcttgtcgacatagaaacagaagctctgaaagacagcgaggaggacgttgtggaaacacccgcagtgtcccatgatgagcacacacaccaagaaattaagggcaggaaaaccttggccactccggccgtgcgacgactggccatggagaataacatcaaactgtctgaggtcgttggttctggtaaggatgggcggatccttaaggaggacattcttaattatcttgaaaagcagactggggctatcctgcctccgagtccaaaagttgaaatcatgccccccccccctaaaccgaaggacatgacggtccccatactggttagtaagcctcccgtgttcaccggcaaggacaagacagagcccatcaaaggtttccaaaaggccatggtgaagaccatgagtgccgcactcaagattccccacttcggctactgcgacgagatcgacctgactgaactcgtgaaattgcgggaggaactcaaacccatcgccttcgctcggggtataaagctgtccttcatgccgtttttcctcaaagccgcctcactgggactgctgcagtttcccattcttaatgccagcgtggacgagaattgtcagaatattacttataaggcttctcacaacattggaatcgctatggataccgaacagggtctcattgtgcctaacgttaagaacgtgcagatttgtagtatctttgatattgccactgagcttaacaggctgcaaaaactcggttccgtctcccagctttccactactgatctgactgggggaactttcaccctgagtaatattgggtccatcggtgggacctttgcaaaaccagtcataatgcccccggaagtggctatcggagcgctgggcagcatcaaagcaatacctcggttcaaccagaagggggaagtgtacaaggcacaaatcatgaatgtgtcttggtccgccgaccacagggtgattgacggagccacgatgagccgattctccaatttgtggaagtcatatctcgagaatccagcgtttatgctcttggatttgaag

SEQ ID NO: 249968 - DNA, 1446 bp, Artificial Sequence
  Description of Artificial Sequence: Synthetic coding sequence
atggcggccgtgcgcatgctcagaacctggagcaggaacgcaggaaagctgatctgcgtgcggtactttcagacgtgcggcaatgtgcatgtgctgaagccgaattacgtgtgcttctttggatatccaagcttcaagtatagccaccctcatcactttctcaagaccactgctgcgctgagggggcaggtggtgcagttcaaattgtctgacataggagagggtatacgagaggttactgtgaaggagtggtatgtcaaggaaggtgatacagttagtcagttcgacagcatctgcgaggtccagtcagacaaggcctccgtgactattacaagccgatatgatggggtaattaagaagctgtattacaacttggacgatattgcttatgttgggaagcctctggtagacattgagactgaagcgctcaaagacagcgaggaagatgtggtagaaacacccgctgtgtcccacgatgagcacactcaccaagagatcaagggccggaagacactcgctacgccggccgttcgccgcttggccatggaaaacaacatcaagctttccgaggtcgtgggatccggaaaggacgggagaatactcaaagaggatatcctcaattacctggaaaagcagacgggtgctattctcccaccatctcctaaggtggagattatgccccctccgcctaagcccaaggatatgacagtgcccatcctcgtatctaagccaccagtttttaccggcaaggataaaaccgaaccaattaaaggctttcaaaaagccatggtcaagacaatgagtgctgccctgaaaataccccatttcggttattgcgacgaaatagatttgaccgagctggtcaagctgagagaagagctcaagcctatcgcctttgcccgggggatcaaacttagttttatgccgttcttccttaaagctgcaagcctgggactgttgcagttccccatccttaatgcttctgtggatgagaattgtcaaaatatcacatacaaggcatcacataatatcggtattgcgatggacacggaacagggcctgatcgtgccaaacgtgaagaacgtacagatttgttcaattttcgacatcgccaccgagctcaaccggctgcaaaagctggggtccgtgagtcagctttcaaccactgacctcactggcggaacgttcaccctgtcaaacattggctctatcgggggaacgtttgccaagccggtgatcatgccgcccgaggtagcgatcggagccttgggctcaataaaggcaattccacgctttaatcagaagggagaagtttacaaggcccagattatgaacgtaagctggagtgccgaccaccgagttatagacggagctacgatgagtcggttcagtaatttgtggaaatcttatctcgaaaatcccgcgttcatgctgcttgacttgaaa

SEQ ID NO: 249969 - DNA, 1446 bp, Artificial Sequence
  Description of Artificial Sequence: Synthetic coding sequence
atggccgcggtacgaatgcttaggacttggagtaggaacgctgggaaactgatatgcgtgagatattttcagacttgcggaaatgtacatgtgcttaaacctaactatgtatgtttctttgggtacccctctttcaaatattcccatccccatcacttccttaagactacagcggccctaagggggcaggtcgtccagttcaaactttctgatatcggggaagggatccgggaggttactgttaaagagtggtacgtcaaagaaggagacacagtgagtcagttcgatagtatctgcgaggtccagagtgacaaagcctcagtcactataacttctagatacgacggggttatcaagaaactctactataatctagacgacatcgcttatgttggaaaacccttggtggatatcgaaactgaggctttaaaagatagtgaagaagatgttgtggaaacacccgcagtgtctcatgatgaacatacacaccaagaaatcaaagggcgaaaaactcttgccactcccgcagtccggcgacttgcaatggaaaataatataaaactatccgaagtcgtggggtctggaaaggatggacgaatcttaaaagaagatattctgaactatcttgaaaaacagactggggccatcctgcccccctctcccaaagtggagatcatgcccccacctcctaaaccaaaagatatgactgtgcctatattagtgagtaaaccacctgtttttacaggaaaggataaaacagagccaattaaagggtttcagaaagcaatggtaaaaactatgtcagcagctctgaaaataccccactttgggtattgcgatgagatagatcttacagaactcgtgaaattgcgggaggaacttaagcccatagcttttgcccgcgggataaaactgagtttcatgccattcttcctgaaagcagcgtccctaggactcttacagttcccaatcctgaacgcttcagtggatgaaaactgtcagaacatcacttacaaagcctctcacaatatcgggatcgctatggatacagaacaaggacttatcgtccccaatgtgaaaaatgtccagatatgttcaatcttcgatattgccacagagctcaacagacttcagaagctgggaagtgttagtcaactttccactacagatcttacgggagggacatttactctttccaatatcggatccatcggaggaactttcgccaaacctgtcatcatgcctcctgaagtggcaataggggccctagggtctatcaaagccataccccggtttaatcagaaaggggaagtttataaagcccagataatgaacgtgtcctggagtgctgatcaccgcgtaatagatggggccactatgagtaggttttcaaatctctggaaatcctacctcgaaaatccagccttcatgctcctggatctgaaa

SEQ ID NO: 249970 - DNA, 1446 bp, Artificial Sequence
  Description of Artificial Sequence: Synthetic coding sequence
atggccgccgtccgcatgctgaggacctggtccaggaatgcgggtaaactgatctgtgtgcggtattttcagacatgtggcaatgtgcacgtcctcaagcccaactatgtctgcttctttgggtatcccagctttaagtatagccacccccaccatttcctcaagaccaccgcagcgctccgcggtcaggtggtacaattcaagttgtctgacatcggagaagggattagagaggtaacggtgaaagagtggtatgtgaaggaaggtgacacggtgtctcagtttgatagcatatgcgaggtgcagagcgataaggctagcgtcaccatcacgtcaaggtatgacggagtaattaaaaagctttattataacttggatgacattgcctacgtagggaaacccctggtggatatcgagaccgaggccttgaaagactccgaggaagacgtggtagaaacaccagctgtgtctcacgatgaacacacacatcaagagattaaggggcgtaagaccctggccactccagccgttaggaggcttgccatggagaacaacataaagctgtcggaggtggtgggcagcggcaaagacggaagaatcctgaaagaagacattttgaattacctcgaaaagcagactggggccattctccctccttctccgaaggtggagattatgcccccaccccccaaaccaaaagacatgaccgtccctatcctagtctctaagccgcccgtttttacagggaaggacaagaccgaacctataaaggggttccagaaggcaatggtgaagactatgtcggccgcacttaagataccccattttgggtactgtgatgaaatcgatctcacagagctcgtcaagcttagggaagagctaaagcctattgcctttgccaggggcatcaaactgtcattcatgcccttctttctgaaagccgcctcactcggcctgttgcagttccccatcctaaacgcgagcgtggacgaaaactgtcaaaatatcacatacaaggcttcgcacaatataggcatcgccatggataccgaacagggcctgattgtaccgaacgttaagaatgtgcaaatctgctccattttcgatatcgcaaccgaactcaatagactgcagaagttgggctcagtgtcccagttaagtaccaccgacttgacaggtgggaccttcaccttgagtaacatcgggtccattggaggaacctttgcaaagcctgtgattatgccgcccgaggtcgccatcggtgcgctgggctcgatcaaagccatccctaggtttaatcaaaaaggagaggtctataaggcgcagatcatgaatgtgtcctggagcgcagaccaccgggtgatcgacggcgccactatgtcccgcttttccaatctctggaagtcttacctggaaaacccagctttcatgctgctcgatttgaag

SEQ ID NO: 249971 - DNA, 1446 bp, Artificial Sequence
  Description of Artificial Sequence: Synthetic coding sequence
atggccgccgttcgaatgcttaggacatggagcaggaatgccggcaaattgatctgcgtcaggtactttcagacatgtgggaatgtccacgtgctgaagccaaactacgtctgcttctttggctaccctagtttcaaatatagtcatccacaccacttccttaagaccactgcagcgctgcgcggccaagtggtccagtttaagctctctgacattggtgagggaatcagagaggtcactgttaaggagtggtatgtcaaggaaggtgacaccgtgtcccagtttgatagcatttgcgaggtccaaagcgataaggcctcagtgacaatcacatcaagatacgatggggtgatcaaaaaactctattacaatctcgatgatatcgcctatgttgggaaacctctggtcgacatagaaacagaagctctgaaggactctgaagaggatgttgtggaaacccccgccgttagccacgacgaacatacgcatcaggagataaaaggacggaaaaccctcgcgacacctgccgtgcgcaggcttgccatggagaacaatataaaacttagtgaggtggtcggatctgggaaggatggacggatacttaaagaggatatcttgaactaccttgagaagcagaccggcgcaatcctcccgccttcacctaaggtcgagattatgcctccaccaccaaagcctaaagacatgaccgtacccatcctggtgtctaagcctcctgtgttcaccgggaaggataaaaccgagccaattaagggctttcagaaagctatggtgaagaccatgtcagcagcgctgaagataccacacttcggatattgtgacgaaattgacctgacggaactggtgaagctgcgcgaggagctgaagcctattgctttcgctcgcggaattaagctgtcctttatgccttttttcctgaaagctgcctctcttggactgttgcagttcccaatcctgaacgcatcagtagacgagaattgccaaaacataacgtataaggcttcacataacattggcatagccatggatacggagcaggggctcatcgttcctaacgtaaagaacgttcaaatatgtagcattttcgacattgcaaccgaactcaatcggctgcagaagcttggaagcgtatctcaactgtcaaccactgaccttactggggggacttttaccctcagtaatatcggaagtattggcgggacattcgcgaagccagtgataatgccaccagaggtcgctataggagccctgggaagcatcaaagccatcccacgcttcaaccagaaaggggaggtgtacaaggcacagatcatgaatgtcagctggagcgccgaccaccgcgtgatagacggtgccaccatgagccgcttctctaacctgtggaagagttacttggagaaccctgctttcatgctgttggacctgaag

SEQ ID NO: 249972 - DNA, 1446 bp, Artificial Sequence
  Description of Artificial Sequence: Synthetic coding sequence
atggctgccgtcaggatgctgagaacttggtctagaaacgcgggcaaactcatttgcgtgaggtatttccaaacttgtgggaacgtgcacgtgcttaagcccaactacgtctgtttcttcggctacccaagctttaaatatagtcacccacatcatttcctcaaaacaacagctgcactgaggggacaagtcgtgcagtttaaactttcggacatcggtgagggaatccgcgaagtcacagtgaaggaatggtatgtcaaggagggagacactgtgtcccagttcgatagtatttgcgaagtccagtcagataaagctagcgtaacaattacgagccgctatgatggcgtgataaaaaaactctactataatcttgatgatattgcttacgtgggcaagccattagtggacattgagaccgaagcccttaaagacagcgaggaggatgtcgttgaaacgccggctgtgtcccatgacgaacacacccaccaagaaataaaaggacgaaaaaccctggcaacaccggccgttagaagactcgcaatggagaacaacattaagttgtccgaagtggtcggcagtggaaaagacggaaggatcctgaaagaagacatcctgaactacctggaaaaacagaccggggccatcctcccgccgtcacctaaagttgagattatgccgcctccaccaaagcccaaggacatgacagtacctatcctggtctcaaaaccgcccgttttcaccggaaaggacaagacagagccaatcaaaggcttccagaaggccatggtgaagaccatgagcgcagcattgaaaattcctcactttggttactgcgatgaaatcgatctcacagagctcgtgaagctccgcgaggagctgaaacctatcgctttcgctagaggaatcaagcttagcttcatgcccttctttctgaaggctgcaagtctggggcttctgcagtttcctatcctcaacgcaagtgtggatgaaaactgccagaatatcacctataaagctagtcacaacatcggcatcgctatggacacagagcaaggactcatcgtgcctaacgtgaagaacgtacagatctgtagtatctttgacatcgcaaccgagttgaaccgcctgcagaagttagggtctgtctcccagctcagcacaactgacctcactggaggaacctttaccctcagcaacattggatcaattgggggaacttttgcaaaacccgtcatcatgccccctgaggttgcaatcggcgccttgggaagtatcaaggctattcctagatttaaccaaaaaggcgaggtctacaaggcccaaattatgaacgtaagctggagcgccgaccaccgggtgatcgatggcgcaacaatgagccggttcagcaatctgtggaaaagctacttggagaaccctgccttcatgcttttggacctgaag

SEQ ID NO: 249973 - DNA, 1446 bp, Artificial Sequence
  Description of Artificial Sequence: Synthetic coding sequence
atggccgcagtaaggatgttaagaacgtggagtaggaatgccgggaagctcatctgtgtgaggtatttccagacatgtgggaacgtacacgtcctgaaacctaattatgtttgcttttttggatatccttccttcaaatattcccacccacatcacttccttaaaacaactgccgcacttagagggcaagtggttcagtttaagctgtcagacatcggagaaggaatccgagaggtcactgtaaaagagtggtatgtgaaagaaggggatacagtgtcccagttcgattcaatatgtgaagtccaatcagacaaagcctccgtgacaattactagtagatacgacggggtgattaaaaaactatattacaacctggatgacatcgcctatgtcgggaaacctcttgtagacattgaaacagaagccctcaaagattcagaagaagacgtggtcgaaactcccgcagtttctcatgatgaacatactcatcaggaaataaagggacggaaaactctggctactcctgctgtgcggagactagctatggaaaacaacataaaactctccgaagtcgtagggtctggaaaagacgggcgcatcctaaaagaagatatcctcaattatctcgagaaacagactggggcaatattgcctccctcaccaaaggtggaaatcatgcctccaccccccaaaccaaaagatatgactgtgcctatcctggtgagtaaaccccctgtatttacagggaaagataagacagaaccaatcaaagggtttcagaaggccatggtaaaaacaatgtctgcagcactcaaaatccctcattttgggtactgtgatgaaattgacctaactgagctagtgaagctcagagaagaattaaaaccaatcgccttcgctagaggaataaaactctcctttatgccatttttcctcaaagccgcttctctgggactcctacagttccccattctgaacgctagtgtggatgaaaattgtcagaatatcacgtataaagcaagtcacaatatcggaattgcaatggacactgaacaggggctgatcgttccaaacgtaaaaaatgtacagatttgctccatcttcgatattgccacggaactgaaccggcttcagaagctaggatcagttagtcagctttctactactgatttaacgggggggacattcacactatcaaacataggatcaatagggggaacatttgcaaagcccgtgataatgcctccagaagtggctattggagcactgggatcaatcaaagcaataccccgattcaatcaaaaaggggaggtttacaaagcccagattatgaatgtgtcctggtcggcagatcatagggtcattgatggagcaacaatgtccaggttttccaatctatggaaatcctacctagaaaacccagcattcatgcttctggatctcaaa

SEQ ID NO: 249974 - DNA, 1446 bp, Artificial Sequence
  Description of Artificial Sequence: Synthetic coding sequence
atggctgcggtccgcatgcttcgcacctggagtagaaatgcaggaaagctgatctgtgtcagatacttccagacctgcggcaacgtgcacgttctaaagcctaactacgtttgtttcttcgggtacccaagctttaaatactctcatccacatcactttctgaagacaaccgctgcccttagaggccaggtggtccagtttaaactgagcgatatcggtgagggtatccgggaggtgactgtgaaggaatggtacgtgaaggagggggacactgtgtctcaattcgacagcatctgtgaagtacaatccgataaagcttctgtaaccattacaagtcgctacgacggcgtgatcaaaaagttgtactacaacctggacgatatcgcgtatgtcggcaagcccctggtggacatagaaaccgaggccctgaaggactctgaggaggacgttgtggaaactccagctgtaagccatgacgaacacacacaccaggagataaaaggaaggaagacactggcaaccccagctgtgaggaggttagcaatggaaaacaacatcaagttatcagaggtggttggaagtggtaaggatggtaggattcttaaagaggatatcttaaactatctggagaaacagaccggagcaatcctgcctccatcacctaaagtggagattatgccaccacctcctaagcccaaggatatgactgtgccaatactggttagtaagccgccagtattcaccggaaaagacaagacagaaccgatcaagggatttcagaaagctatggtgaagactatgtccgcagctttgaaaatcccccattttggctattgcgatgaaatcgacctcaccgagctcgtaaagctccgggaggagcttaagccaatagcttttgccagagggatcaaactttcttttatgccttttttccttaaggctgcgtcactgggattgctacaatttcccatcctgaacgcttctgtagacgaaaactgtcaaaacatcacctataaagcatcgcataatatcgggatcgccatggacaccgaacaaggcctcatcgtgcccaatgtcaagaacgtgcagatctgctccatctttgacatcgccactgaactcaacagattgcaaaaacttggctctgttagccagctttctaccaccgacctgactggaggtacattcaccctgtccaatatcggcagtatagggggcacgttcgccaaacctgtcattatgcctccagaggtggccatcggggcactgggatctataaaggccattcctagatttaaccaaaaaggcgaggtctacaaagcccagatcatgaacgtgtcctggagcgcagatcatcgggttattgacggagcaacgatgagcagatttagcaacctctggaaaagctatctcgagaaccctgccttcatgctgcttgacctgaaa

SEQ ID NO: 249975 - DNA, 1446 bp, Artificial Sequence
  Description of Artificial Sequence: Synthetic coding sequence
atggctgcggtgaggatgcttcggacgtggtcaagaaacgccggaaagcttatctgcgtacgctacttccagacctgcgggaatgtccacgtattgaaaccaaattacgtctgctttttcggatatccgtcgtttaagtacagccatccccaccattttctcaagaccaccgctgccctacgcggtcaggtcgtgcagttcaagctttccgacattggagaaggtatccgcgaggtcaccgtgaaggagtggtatgtgaaggagggtgacaccgtaagccaattcgattcgatttgcgaggtgcaatccgacaaagcaagtgtcaccatcacctctagatacgatggagtgattaagaagctgtactacaacctcgatgatatcgcgtacgtcggcaaaccactcgtcgacatcgagactgaggctctgaaagattccgaggaagatgtggtcgaaacaccggctgtgagtcatgacgagcacacacaccaggagataaaaggtcggaaaacccttgccactcccgcagtgcgtcggctggccatggagaataacataaagctgagcgaagtggtggggtccgggaaggacggtcgaattctgaaggaagatattctgaattacctggagaaacaaactggtgcgattttgccaccgtcaccaaaggtggaaattatgcctcccccccccaagcctaaggatatgacagtgcctatactggtctccaaacctcctgtcttcacagggaaggataagacagagccaataaaagggttccagaaggcaatggtaaaaacgatgtctgccgccctgaaaattccgcacttcggctactgtgacgagatcgatcttacagagttagtgaaactgagagaggaactgaaaccgattgcattcgctcggggcatcaagttaagcttcatgccgttcttcctcaaggcagcatccttgggcttgctgcaatttccgatcctgaatgcatcagttgacgagaactgtcaaaatataacatacaaggcctcccataacattggcatcgctatggacaccgagcaagggctaatagtccccaacgtgaagaatgtccagatttgcagcatcttcgatatcgccacagaactgaaccgtttacaaaagctcgggagcgtaagtcagttgtctacgactgatctcactggaggcacgtttacgttgtccaacatcggaagtattgggggcacctttgcgaaaccggtgattatgccacccgaggtcgctatcggggccctgggcagtatcaaggcgatcccccggttcaaccagaagggggaggtttataaggcgcaaataatgaatgtctcgtggagcgctgaccacagagttatcgacggagcgactatgtcgaggttctctaacctttggaaaagctacctcgaaaaccccgcttttatgctgctggatctcaag

SEQ ID NO: 249976 - DNA, 1446 bp, Artificial Sequence
  Description of Artificial Sequence: Synthetic coding sequence
atggccgctgtgaggatgctgcgcacgtggtcacggaatgccgggaagttgatctgtgtgcgctactttcagacgtgcggaaacgtgcatgtccttaagccgaattacgtgtgcttctttggatacccatcgttcaagtattcacacccacatcatttcctcaagactaccgcagcgctgagaggccaagttgtgcagtttaagctcagcgacatcggagagggaatccgggaagtgactgtgaaggagtggtacgtgaaagaaggcgacaccgtcagccaattcgacagcatttgtgaagtgcagtccgataaagccagcgtgaccattacctcacgctacgacggagtgatcaagaagctgtactacaacctcgacgacattgcctacgttggcaaaccgctcgtggacatcgaaactgaggctctgaaagattcggaggaggacgttgtggagactccggcagtgtcccatgacgagcacacccaccaagagatcaagggacgaaaaaccctggctacccctgccgtgaggcggctggctatggagaacaacatcaaactgtcggaagtggtgggatccggaaaagacggacgcatcctcaaggaagatattctgaattaccttgagaagcagaccggtgctatcctgccaccgtccccaaaggtcgagattatgcctccaccacctaagccgaaggacatgaccgtccccatcctggtgtctaagccgcctgtctttactggaaaggataagactgaaccgatcaaggggttccagaaagcgatggtcaagactatgtccgctgcactgaagatcccccacttcggttactgcgacgaaatcgatctgaccgaactcgtcaaactgcgcgaagaactgaaaccgattgcgtttgcacgggggatcaagctgtccttcatgccgttcttccttaaggccgcatcgctcggcctgctgcagttccctatcctcaatgccagcgtggatgaaaactgccagaacatcacttacaaggcgagccacaacatcggaatcgcgatggataccgaacaaggattgatcgtgccgaacgtcaaaaacgtccagatctgctcgatcttcgacatcgccactgaactcaacagattgcagaaactcggatcggtgtcacaactgtcgaccacggatctgactggtgggactttcaccctctcaaacattggctcaatcggaggtacctttgccaagccagtgatcatgcctccggaagtcgccatcggagccctgggctcgattaaggcgatcccgagattcaatcagaagggcgaggtgtacaaagcccaaatcatgaacgtgtcctggtccgcggatcaccgggtcatcgacggcgcaactatgagccgcttctcgaatctttggaagtcctatttggagaatcccgccttcatgctcttggatctgaag

SEQ ID NO: 249977 - DNA, 1446 bp, Artificial Sequence
  Description of Artificial Sequence: Synthetic coding sequence
atggccgcggtgcgcatgctgaggacatggtctcgcaatgcaggaaagctgatctgcgtgcggtactttcagacctgcggcaatgtccatgtgcttaagcctaattatgtgtgtttcttcggctacccctcctttaagtacagtcacccccaccatttcctgaaaactaccgcggcactcaggggacaggtggtacagtttaagcttagcgatatcggagagggaattcgcgaggtgaccgtgaaggagtggtatgttaaagaaggagatacagtctctcagtttgattctatctgcgaggtgcagtcggataaagctagtgtgacaatcacttctaggtacgacggggtgattaagaaactgtactacaatctggacgacatcgcctacgttggcaaaccattggtcgacatagagaccgaagccctgaaggattccgaggaggacgtggttgagacgccagccgtgagtcacgatgagcatacccatcaagagattaaaggacgaaaaactctggcgactccagcagtgcgaagattggccatggaaaataacatcaaactttccgaggtagtgggatctggcaaagatggcagaatcctcaaggaagatatactgaactatctggagaaacaaacaggcgctatcctacctcccagccccaaagtggagattatgcctccgcccccgaaacccaaggacatgactgttcctatcctggtgagcaagccaccagtgttcaccggcaaggataaaaccgagcctatcaagggatttcaaaaagccatggtgaagaccatgtcggcagcgctaaaaatccctcactttggctattgcgacgagatcgatctgacagaactcgtgaaattacgcgaagaacttaagccaatcgcatttgctagaggcatcaagctcagctttatgcctttttttctgaaagccgcttctcttgggctccttcagtttccaatccttaacgcgagtgtcgacgaaaattgccaaaacattacctataaggccagccacaacattgggattgccatggatactgaacagggtttaatcgtcccgaatgtgaaaaatgtccagatctgcagcatctttgacattgcaacagagctgaataggcttcagaagctgggcagtgtgtcacaacttagcacaaccgacctgactggcggaacattcaccttaagcaacatcggatcaatcgggggtacgtttgctaagccagtaattatgcctcccgaagtggctatcggcgcgctgggaagcatcaaagcaataccccgctttaaccagaaaggagaggtttataaagctcaaatcatgaacgtttcttggagtgccgatcaccgcgtgatagacggtgccacaatgtcccgtttcagcaacctgtggaagtcatatttagagaaccctgccttcatgttgctggaccttaaa

SEQ ID NO: 249978 - DNA, 1446 bp, Artificial Sequence
  Description of Artificial Sequence: Synthetic coding sequence
atggccgccgttagaatgttacgtacctggagccggaacgccggcaaactgatctgcgttagatacttccagacctgcggcaatgtgcatgtgttgaagccgaattacgtgtgcttctttggctatccttcgtttaagtattcacaccctcaccatttcttgaagaccaccgctgctctcaggggacaggtggttcaatttaaactgagcgacatcggtgaggggatccgcgaggtgacagtcaaagaatggtacgtcaaagaaggggacaccgtcagccagttcgattccatttgcgaagttcaatccgacaaagcaagtgtgacaataacaagcaggtacgatggagttatcaaaaaactttattataacctggacgacatagcatacgtcggcaaacctctggtggacatcgaaacagaggcactcaaggacagcgaggaagacgttgtggagactccagcagtcagccatgatgaacatactcaccaagagatcaagggaagaaaaacgctagcaacaccggctgtccgcaggctcgccatggaaaacaacataaagttgagcgaagtggtaggctctggaaaagacggccggatcctgaaagaggacatcctgaattatctcgagaagcaaacgggcgctattctgccaccgtctcctaaagtagaaatcatgccgcctccaccgaaaccgaaagatatgacagtgccgatccttgtgagtaagccgccagtctttacaggaaaagacaagacagaaccaatcaaaggctttcaaaaggctatggtcaagacaatgagcgcagcgttgaaaatcccccatttcggatactgtgacgaaatcgatcttaccgagttggttaagctgagagaggagctgaagccaatcgcttttgcacgcgggattaagttgagcttcatgccattctttcttaaagcagccagcctgggactgcttcagtttccgattctgaatgcctccgtggatgagaactgccagaacatcacatataaggccagccataacatcggcatcgcaatggacacagagcaaggattgatagtgccaaacgtcaaaaacgttcagatttgttcaatctttgacattgctaccgaacttaaccgcctgcaaaaattaggttccgtctcccagttaagcactaccgatcttaccggaggcactttcactttgtctaacatcggatccatcggaggaacctttgcgaaaccagtcataatgcctcctgaagtggccattggcgctctgggcagcatcaaagccatcccgaggttcaaccagaagggcgaagtttataaagctcaaatcatgaatgtgagctggagcgccgatcacagagtgatcgatggggcaaccatgagcagattctctaatttgtggaaaagctacctggaaaaccctgcattcatgctcttggatctgaag

SEQ ID NO: 249979 - DNA, 1446 bp, Artificial Sequence
  Description of Artificial Sequence: Synthetic coding sequence
atggctgctgtgagaatgttacggacctggtcaaggaatgctggcaagctgatttgcgtcaggtacttccagacctgtgggaatgtccatgtgctgaagcctaactacgtatgcttcttcggatacccaagtttcaagtacagccacccacatcactttctgaaaactacagctgccctgcgcgggcaggtcgtgcagttcaagttgagtgatatcggtgagggcataagggaggtgaccgttaaggagtggtatgttaaagaaggcgacaccgtcagccaatttgattccatctgtgaggtgcagtcggacaaagcatctgttactatcacatctcggtatgacggcgtgatcaagaaactctactataacctggatgacattgcatatgtcggaaaaccattggtcgatatagagactgaggcgttgaaggatagcgaggaggacgtagtggaaactcctgctgtcagccacgatgaacatacacaccaggagatcaagggccggaagactcttgcaacgcccgccgttagaaggctggctatggagaacaatatcaagctttctgaagtcgtgggcagtggaaaggacggtcggattctcaaggaggacattctgaactatttggaaaaacagaccggcgctatccttcccccatcgccgaaagtggaaatcatgcctccaccaccaaagcccaaagatatgactgtccccatcctggtttctaagccacctgtgtttacaggcaaagacaaaaccgaacctattaaggggtttcagaaagctatggtcaagaccatgagcgccgctctcaagatcccccacttcggctattgcgatgagatcgatttaactgaattggttaaacttagagaagagctaaagccgatcgcctttgctcgggggatcaaattaagtttcatgcccttctttctgaaggctgcaagcctggggttgctgcagtttcccattctgaacgccagtgtggacgagaactgccagaacattacttacaaagcatcccacaacattgggatcgccatggacacagagcaggggcttatagtccccaatgttaaaaacgtgcagatttgtagtatctttgacatagccacagaactgaacagactgcagaaattgggctcagtgtcgcagctctccactaccgacctcaccgggggcacatttaccctcagcaacattgggtctattgggggcacttttgccaagccagtgatcatgccccccgaagtggcaatcggtgctcttggctctatcaaggccattccaagatttaaccaaaaaggggaagtgtacaaggcacagatcatgaacgtctcatggtccgcagaccaccgtgtcattgacggagccaccatgagcaggttctccaacctgtggaagtcctatctggagaatcccgccttcatgctcctggacctgaag

SEQ ID NO: 249980 - DNA, 1446 bp, Artificial Sequence
  Description of Artificial Sequence: Synthetic coding sequence
atggcggccgtgcggatgctccgtacgtggtcaaggaacgcaggcaagctgatttgcgtacggtacttccagacctgcggcaacgtgcacgtcctgaagccgaactacgtgtgcttctttggatacccgagcttcaaatattcccatccccaccactttttaaagacaacagctgccctgagggggcaggtggtccaatttaagctgtcagacatcggggaagggattcgcgaagtgacggtcaaggagtggtacgtgaaagaaggtgacaccgtgagccagttcgattctatttgtgaggttcagagcgataaggctagtgttactattactagcagatacgatggcgtgataaaaaagctgtattataatctagacgacattgcgtacgtgggaaaacccttagtggatatagagactgaggctttgaaggacagcgaggaggatgtggtggagacccccgcggtgtctcatgacgaacacacacatcaagaaataaaggggaggaagactctggcgaccccagctgtgaggcggctggctatggagaacaacatcaagctgtctgaggttgtgggtagtggtaaagatggaagaattctcaaagaggatattctcaactacctggagaagcaaactggtgccattctgccaccgtctcctaaggtggagattatgcctccccctccaaaacctaaggacatgacagtgcccatcctggtaagtaaaccccctgtgttcaccgggaaggacaagactgagcccattaagggattccagaaagcaatggtgaagaccatgagtgcagcactcaaaatcccgcacttcggctactgtgacgagatcgatctgactgagctcgtgaagttgagagaggaactgaaacctatagcgtttgcaaggggaattaagttgtcttttatgcccttcttcctcaaagcggctagcttgggccttctccagttcccgattctgaacgcctcagtcgacgagaattgccaaaatatcacctataaagcctcccacaatattgggatcgccatggataccgagcagggccttattgtgccaaacgtcaaaaacgtgcagatttgctccattttcgatatcgcaaccgaattgaacaggctgcagaaactcgggtccgtgtctcagctgagcactactgatcttaccggtggtaccttcacattgagtaacattggctctattggtggcacctttgcaaagccagttatcatgccccctgaggtcgctatcggagcgctcggaagtatcaaagccataccgaggtttaatcagaaaggagaggtgtacaaagcacaaatcatgaacgtctcatggtctgccgatcatagagtcatagatggggccacaatgtcaaggttcagtaacctatggaaatcttaccttgagaatccggcatttatgttactggaccttaaa

SEQ ID NO: 249981 - DNA, 1446 bp, Artificial Sequence
  Description of Artificial Sequence: Synthetic coding sequence
atggccgcagtccggatgcttaggacctggtcgcgaaatgcgggaaaactgatatgcgtgagatactttcaaacttgtggtaacgtgcatgtgctcaaacctaactacgtctgcttcttcggttacccttcgtttaagtactcgcatcctcatcattttcttaagactaccgcagcacttcgcggacaagtggtccagtttaagctttcggacattggagaaggaatcagagaggtgaccgtgaaggagtggtatgtcaaagagggcgataccgtttcacaattcgacagcatttgtgaagtgcagtccgataaggcatccgtgactattacctcaagatacgacggagtgattaagaagctgtactacaaccttgatgacatcgcctacgtgggaaaaccacttgtggatatcgaaactgaagcactcaaggatagcgaagaagatgtggtggaaactccggcagtgtcacacgatgagcacacccatcaagagattaagggccgtaagaccttggcaaccccagccgtgcgcagactggctatggaaaacaacataaagctgtcagaagtggtcgggtcaggaaaagatgggaggattctcaaagaagatattctgaactatcttgaaaagcaaaccggtgcaattcttccaccatccccaaaggtggaaatcatgccgcctccacccaaaccaaaagacatgaccgtgccgattctcgtctccaagcctcccgtgtttactggaaaggataagaccgagcccattaaggggttccagaaggcgatggtcaaaaccatgtcagcagccctcaagatcccccattttggatactgcgatgaaattgacctgacggaacttgtgaagctgagggaagaactgaagcctatcgcatttgctcggggtatcaaattgagctttatgcctttctttttgaaagcagcgtcgctggggcttcttcaatttccaattctgaatgcgtcggttgatgagaattgtcagaacataacttacaaggcctcccacaacatcggtattgcgatggacactgagcaaggcctgattgtgcctaacgtcaagaatgtgcaaatctgtagcatctttgacattgcaactgagctcaatcgactgcagaagctgggatccgtctcgcagcttagcacgactgatctcactgggggaaccttcactctgtccaacatcggttcgattggcggtacgttcgctaagcctgtcataatgcctccagaggtggccatcggcgcactgggctccatcaaagcaataccccggtttaaccaaaaaggagaagtctacaaggcacagatcatgaatgtcagctggagcgccgatcaccgcgttattgatggtgccaccatgtcgagattttctaatctttggaagtcctacctcgaaaaccctgcattcatgttgctggacctcaag

SEQ ID NO: 249982 - DNA, 1446 bp, Artificial Sequence
  Description of Artificial Sequence: Synthetic coding sequence
atggcagcagtgcgcatgttgaggacctggagcagaaacgccggcaagctgatttgtgttagatatttccagacctgcgggaacgtccatgtccttaagccaaattacgtgtgtttcttcggttatccatccttcaaatattctcatccacatcactttctgaaaactactgccgccctgcgggggcaggtggtgcagtttaagctctccgacataggcgaagggattcgggaggttacagtgaaagagtggtacgtgaaggaaggcgataccgtgagccagttcgatagcatctgtgaggtgcaaagcgataaggcaagcgtgaccattacgtctcgctacgatggtgtgataaagaagctgtattataatctggacgatatcgcctacgtggggaagcctctggttgacattgaaacagaggctttgaaagattctgaggaggatgtcgtcgaaacccccgctgtatcccacgacgagcatacacatcaggagattaagggtagaaagacgctcgccacacccgcagtccgccggttggccatggagaataatatcaaactttcagaggtggtaggcagtggcaaagacggaagaatcctgaaagaggacatcctcaattacttggagaaacagaccggagccatactgcccccatcccctaaagttgagatcatgccaccccctcccaagcccaaagatatgactgtgccaattttggtgtctaagccgcctgtcttcaccggaaaagataaaacagaacccatcaagggatttcagaaggccatggtcaagactatgagtgctgctctcaaaatcccccactttggatactgcgacgagatcgatctgaccgaacttgtgaaactccgcgaggagctcaagcctatcgcgttcgcacgggggattaaattgagtttcatgcctttttttctgaaggccgcttccttggggctcctgcagttccccatcctgaatgcttcagtggatgagaactgtcagaatatcacttataaggccagccacaatattggaatcgctatggacacggaacagggcttgatcgtccctaacgtgaagaacgtccagatctgttccatctttgacatcgctacagagctgaatcggcttcaaaagttgggatccgtgtctcagctctctactaccgatctgaccggcggaacgttcacgctctcaaacatcggcagtatagggggcaccttcgcaaagccagtgataatgccaccagaagtagctattggcgccctggggagcattaaagcaatccccaggttcaaccagaagggggaagtctacaaggctcagataatgaacgtgtcatggtctgccgaccaccgcgtcatagatggggctactatgagccgcttctccaatttgtggaaatcttatctggaaaaccccgcctttatgcttctggatctgaaa

SEQ ID NO: 249983 - DNA, 1446 bp, Artificial Sequence
  Description of Artificial Sequence: Synthetic coding sequence
atggcagcagtgcgcatgctgcgcacatggagccgcaacgctggaaaacttatatgcgtccggtactttcaaacttgtggaaatgttcatgtcctgaagccaaactacgtttgcttttttgggtacccgagcttcaaatactctcacccccaccacttcctgaaaaccaccgctgcgctgagaggacaggtcgtccagtttaagctgtctgatatcggggaaggtattcgggaagtgaccgtgaaagagtggtacgtcaaggaaggcgataccgtgtcacaatttgacagcatctgtgaagtgcagagcgacaaggcgagcgtcacaatcacatcacgctacgatggcgtgatcaaaaagctgtactataatcttgacgatattgcttacgtaggcaagccgttggttgatatcgaaaccgaggccctgaaggatagtgaggaggatgtggtggagacccccgctgtgtcccatgatgagcatacccaccaggagatcaagggcaggaagactttggctacccctgctgttaggaggctagcgatggaaaataacattaaattgtcagaggtcgtggggtcaggaaaggatggcagaattctcaaagaggatattttgaattacctggagaaacagaccggggctatcttacccccaagccctaaagttgagatcatgcctccccctcctaaacctaaggatatgactgtgccaatcctcgtcagcaagcccccagttttcaccggtaaggataaaactgagccgatcaaaggatttcagaaggccatggtgaaaaccatgagcgccgctttgaagatcccccactttggatactgcgatgagatcgatctcaccgaacttgtgaaactgagagaggagctcaagcccattgctttcgccaggggaattaaactcagttttatgcctttctttcttaaagccgcatccttgggattacttcagtttcccatcctgaacgcgagcgtggatgagaactgccagaatatcacatacaaagcatcacacaatatcggaatcgcaatggataccgaacagggactcatcgtgccaaacgttaaaaacgttcagatttgcagcatctttgacattgccaccgagcttaacaggctgcaaaagttaggatcagtcagccagctgagtaccacagatttgaccggcggaacctttacactctctaacatcggcagtattggtggaaccttcgcaaaaccagttattatgcctcctgaagtggcaatcggagcactgggcagcatcaaagcaatccctagattcaaccagaaaggcgaagtatataaggcacagatcatgaacgtgagttggagcgctgatcacagggtgatcgatggcgctaccatgtctagattctccaacctgtggaagagttacctggagaaccccgccttcatgcttctggatctgaag

SEQ ID NO: 249984 - DNA, 1446 bp, Artificial Sequence
  Description of Artificial Sequence: Synthetic coding sequence
atggcggcggtacggatgctgagaacttggtctagaaatgcgggcaagctgatttgcgtacggtatttccaaacttgtggaaatgtgcacgtattgaagcccaattatgtctgtttctttggctaccccagctttaagtactcccacccccatcacttcttaaaaaccaccgcagccctgcgcggtcaagttgtgcagttcaaactaagtgatatcggtgaggggatacgcgaagttaccgtgaaggagtggtatgttaaagagggagacaccgtcagtcaattcgattccatctgcgaagtccagagcgataaggctagcgtcaccattacgtcccgatatgatggggttattaagaaactgtactacaatctggatgacattgcctacgttggtaagccccttgtcgacatcgagacggaagcccttaaggattccgaagaggacgtcgttgagacccctgcagtgtcacacgacgaacatacacaccaggagattaagggacggaaaaccctagccacaccagccgtgcgcaggctggcaatggagaacaatatcaaactctccgaggtggtggggtctggaaaggatgggcgaattcttaaggaggacattctgaactatctcgagaaacagaccggtgccatactgcctcccagcccaaaggtcgagatcatgcctcctccacccaagcccaaagacatgactgtgcctattctagtgagcaagccacccgtgtttaccggcaaagacaagaccgaacccattaaagggtttcagaaagccatggtgaagacgatgtccgccgcgttgaaaatcccccattttgggtactgcgacgagattgacctcactgaattggtcaagctccgcgaggagctgaaaccaatagcatttgccagagggattaagctgtcctttatgccattctttctgaaggctgcaagtctgggcctactccagtttccaatactgaacgcgtccgttgatgagaattgtcagaatattacatataaagcatctcataacatcggcatcgcaatggatacggagcagggcctgattgtgcccaacgtcaagaacgtacaaatctgcagcatattcgatattgccaccgaattgaatcgcctgcagaagctgggatcagtttcgcagttgagtacaacagacctgactggcgggaccttcaccctgtccaatattggatccattggagggacgttcgccaagcccgtaatcatgccccctgaagtagctatcggtgcgctcgggagcatcaaggcaattccccgcttcaatcagaaaggtgaagtgtataaagcccagattatgaatgtttcttggtctgcagaccaccgtgtgatcgacggggcgaccatgtccagatttagcaacctttggaaatcatatctcgaaaacccagcttttatgctgctggatttgaag

SEQ ID NO: 249985 - DNA, 1446 bp, Artificial Sequence
  Description of Artificial Sequence: Synthetic coding sequence
atggccgctgtccggatgctgaggacttggtcccggaatgcaggaaaattaatatgcgtccgatattttcagacttgtgggaatgtgcatgtactgaaacccaattatgtatgtttttttggatatccttctttcaaatactcacaccctcaccacttcctcaaaacaacagccgccctgcgaggacaggtcgttcagtttaaactgtccgatatcggggaaggaatccgagaggtcactgtcaaggaatggtacgtaaaagaaggagatacagtttctcagtttgattccatctgtgaggttcagtcagataaagcgtctgtgacaattacttcccgatacgatggggttataaagaaactttattacaacctcgatgatatagcatacgtgggaaaaccactagtggatattgaaactgaagctcttaaagatagtgaagaagatgtggtcgaaactccagcagtctctcacgatgaacacactcaccaggaaatcaaagggaggaaaacacttgcaactcctgctgtacggcggttagctatggaaaataatatcaaactctcagaagtcgtgggatctgggaaagatgggcgaatactgaaagaagatatcctcaattacctggaaaagcagacaggggccatcctgcctccatcgccaaaagtcgagattatgcccccaccccctaagccaaaagatatgactgtacccattcttgtctctaaaccaccagtatttactgggaaagataaaacagaaccaattaaagggtttcagaaagcaatggtaaagacaatgtctgcagctctaaaaataccacattttggatattgtgatgaaatagacctcacagaactcgtgaaactaagagaagagctcaaacccatagcttttgcacgggggatcaaacttagttttatgcccttttttctgaaagcagccagtcttggactcctacagttccccatattaaacgcttctgtggacgaaaattgccagaacattacttataaagcctcccataacatcgggatagctatggatactgaacagggactgatcgtgcccaacgtgaaaaacgtgcagatatgtagtatttttgatatagccacagagctgaacaggctccagaaactggggtccgtatcacagctgtctactactgatctaactggaggaactttcactctctctaatatcgggagtatcggagggactttcgccaaaccagttatcatgccccccgaagtggctatcggagcattagggtccataaaagctattccccggttcaaccagaagggagaagtgtataaagcacagataatgaacgtttcatggtccgccgatcatcgggtgatagatggagcaacaatgtcccgcttctccaacctttggaaatcgtacttagagaaccctgcgtttatgctcctcgatttaaaa

SEQ ID NO: 249986 - DNA, 1446 bp, Artificial Sequence
  Description of Artificial Sequence: Synthetic coding sequence
atggccgccgtgcggatgcttagaacttggtcccgaaacgccggtaagctgatctgtgttcgctatttccagacttgcgggaacgtgcacgtgttgaagcctaattatgtatgtttcttcgggtatcctagcttcaaatattctcacccccatcatttcctgaagaccaccgctgccctgcgcggacaggtcgtgcagtttaagctgtctgatattggcgaggggattcgggaggtcaccgtcaaagagtggtacgtgaaagagggggataccgtgtcccagttcgactccatttgcgaggtccaatccgacaaagcctccgtcactatcacctcccggtacgatggcgtcatcaaaaagctgtattataatctcgatgatattgcatacgttggaaaaccactcgttgatattgaaacagaggctctgaaagactcagaagaggatgtcgtggagacgcctgccgtctctcacgatgagcacacccatcaggagataaaaggaaggaaaacattggccacccctgcagtccgccgcctcgctatggaaaacaacatcaaattgtcagaagtcgtcggatctgggaaggacggacggatcctgaaggaggatattctcaactacttggagaagcagacaggggctatccttcccccatcccccaaggtggaaatcatgcctcccccgcccaagccaaaggatatgaccgtcccaatcctggtatccaagcctcccgtttttaccggaaaggacaagaccgaacctatcaaaggctttcagaaggccatggtcaaaacgatgagcgctgcactcaagatcccgcatttcgggtattgcgatgaaattgacctgaccgaattggtgaagctccgagaagagctcaagcctatagcattcgctcggggaataaaactgagcttcatgccatttttcctcaaagccgcctcccttggactgctccaattccccatcctgaatgcttccgtggacgagaattgccaaaacattacctacaaggcctcccacaatatcgggatagcgatggacaccgagcaggggctcattgtgccgaacgtgaaaaacgtccagatatgctcaatcttcgatatcgctaccgagctgaatagactgcagaagctgggctccgttagtcagctgagtacaaccgatcttactggggggactttcacgctgagcaatatcggctctatcggtggaacctttgctaagcccgtgattatgcccccagaggtcgcgataggtgctctgggcagcataaaggctattcccagatttaaccagaagggcgaagtgtacaaggcacagataatgaacgtgtcttggagtgccgaccacagagtcatcgacggtgctactatgagtcgattctcaaatctttggaaatcttatctggaaaatccagcgtttatgctcctcgacctgaaa

SEQ ID NO: 249987 - DNA, 1446 bp, Artificial Sequence
  Description of Artificial Sequence: Synthetic coding sequence
atggcagctgtaaggatgctgcgcacttggagcagaaacgctggcaaacttatctgcgtgagatactttcaaacttgcggtaatgtgcatgtgttaaagcctaactacgtctgtttctttggatatccttcgtttaaatactctcatccccatcactttcttaaaacgacagctgccctaagaggtcaggtggtgcagttcaaactgtccgacatcggcgagggcatccgagaagtgacggtgaaagaatggtacgtgaaagagggagacaccgtgtcccagtttgattccatttgcgaggtccagtccgataaggcctcagtcactataacatcgcgctacgacggcgtgatcaaaaagctgtattataacctggatgacatagcctacgtcggaaagcccctggtcgacatcgagaccgaggccctgaaggacagtgaggaagatgtggtggagactccagcagtctctcacgacgaacatacccaccaggagattaaaggtcggaaaactctcgccaccccggcagtacgccgtttggcaatggagaacaatatcaagctgagtgaggtagttgggtctggcaaggacggtcggattcttaaagaggacatactgaactatttggagaagcagactggagccattctgcctccttcaccaaaggtcgaaattatgcctccccccccaaagccaaaggacatgacagtacccattctggtgtccaagccccccgtgttcacgggaaaagacaaaaccgaacccattaaaggctttcagaaggccatggtcaaaacgatgtctgcagcgctcaaaataccacatttcgggtactgtgacgagatcgatcttactgagttggtaaagctgcgggaggagctgaagcctatcgctttcgcgcgcggcatcaaattgtcctttatgccattttttctgaaggcggcttccttaggactactgcagtttcctatcctgaatgcatcggtcgatgaaaattgccagaatatcacatacaaggcctcccacaatatcggcatcgctatggacaccgagcaggggctcatcgtccccaatgtcaagaacgtgcagatttgttcaatatttgatattgctacggaactgaaccgacttcaaaaactgggaagcgtatcccagctcagcacaactgatctcaccggggggacatttactttgagcaacattggaagcattggcggtacttttgccaaacccgttattatgcccccggaagtggcaatcggtgccctcggatctatcaaggcgattcccaggttcaatcaaaagggcgaagtgtacaaggctcagattatgaacgtgagttggtcagctgaccatagagtcatagatggtgccacaatgtcgaggtttagcaacctctggaagtcctacttggaaaatcctgcgtttatgctgctggacctgaag

SEQ ID NO: 249988 - DNA, 1446 bp, Artificial Sequence
  Description of Artificial Sequence: Synthetic coding sequence
atggcagcagtacggatgcttagaacatggtctagaaacgcaggaaaactgatctgcgtgcggtatttccaaacttgtggtaacgtgcacgtcctgaagccgaactatgtgtgctttttcggatatccatccttcaagtattcccacccccaccacttcctcaagaccacggcggcgttaagaggacaggtggtgcagttcaagctgtccgatatcggggaaggaatacgcgaggttactgtcaaagaatggtatgtgaaagagggggacaccgtttctcagttcgactcaatatgtgaggtacagtccgacaaggcatccgtgacgatcacatcacggtacgacggcgtgatcaagaaactgtactataatttagatgacattgcgtatgtggggaaaccattggtggacatcgaaactgaggccctgaaggatagtgaggaggatgtagtcgagacaccagcagtgtcccatgatgaacacactcaccaggaaattaaaggccggaaaaccttagccaccccagccgtcagacgcttggctatggagaacaatatcaaactgtccgaggttgtcgggagcgggaaggacggacggatcctgaaggaggacatcctgaactatctggagaagcagacaggggctattctcccaccgtcacccaaagttgagataatgcccccacccccaaagcccaaggatatgacggtgcccatactggtgtcaaaaccccccgtcttcaccggcaaggataagactgagccaataaaaggcttccagaaggcaatggtgaaaactatgtctgctgctctcaagataccacacttcggatactgcgatgaaatcgacctgactgagttggtaaagctccgcgaggaactcaaacccatcgcctttgcccgtgggatcaaattatctttcatgcctttcttcctgaaagccgctagcctgggcctactgcagtttcccatcttgaacgcttcagtcgatgagaattgtcagaatataacatataaagcgtcccacaatattgggattgcaatggatactgagcagggcctaattgtgcccaatgtgaagaatgtgcaaatctgttccatcttcgatattgcaacagaactgaataggctacagaagctcgggtctgtctcccagctaagtactactgatctgacgggtggaacatttacacttagcaatattggctctatcggtggcactttcgctaaacctgtcatcatgcccccagaggtagccatcggggccttgggcagtattaaggcgatcccacgcttcaatcagaaaggagaggtctacaaagcccagatcatgaatgtttcctggtccgcagatcatagggtgatcgatggagcaaccatgtctcgattcagtaacctatggaaatcttatctggagaatcccgcattcatgcttctggacctgaag

SEQ ID NO: 249989 - DNA, 1446 bp, Artificial Sequence
  Description of Artificial Sequence: Synthetic coding sequence
atggccgctgtgcgcatgctccgaacttggtcaagaaacgctgggaaacttatctgtgtacgctatttccagacatgtggaaacgttcacgtattaaaacctaactacgtctgtttcttcgggtatccttcattcaagtatagtcacccccaccattttctcaaaacaacagctgcactgagggggcaggtggtgcagttcaaactttccgatataggggaagggattcgagaagtgacagtgaaagaatggtacgtcaaggaaggggatacagtgtcacagtttgattcaatctgcgaagtccagagtgataaagcttcggtcactatcacatcaagatatgatggagtcatcaaaaagctgtattataatctagatgatattgcttacgtggggaaaccattagtagatatcgaaactgaagcattaaaagatagtgaagaggatgttgtggagacaccagctgttagtcatgatgaacatactcaccaggaaattaaagggcgaaaaacactggccactcctgccgtaagacgcctcgctatggagaacaatataaaactctcagaagtagtcgggtcaggaaaagatggaaggatccttaaggaagacatacttaactatctggaaaaacagacaggggccatattacccccctctcctaaagtagaaataatgccccctcctcccaaacccaaggatatgactgtgcccatcctcgtaagtaaacctccggtatttacaggaaaagataaaacagaacctatcaaaggatttcagaaagccatggtaaaaactatgtcagccgcccttaaaatcccccactttgggtactgtgatgaaatcgatctgacagagctcgttaaactgcgggaggaactcaaaccaattgcttttgcaagggggatcaaactttcctttatgcccttttttctcaaagctgcctcactcgggcttttacagttccctatactgaacgcctccgttgacgaaaactgtcagaatataacttataaagcctcccataacataggaattgccatggatactgaacagggactgatcgtgcctaacgtgaaaaatgtgcaaatatgctcaattttcgacatcgctacggaacttaaccggctacagaagctcgggtcagtgtctcagctatccactactgatcttactgggggaacatttacactatctaacataggatcgatcgggggaacatttgctaaacctgtgatcatgcctcccgaagtggccataggagcactgggaagtatcaaagccataccaagatttaaccagaaaggggaggtgtacaaagctcagataatgaacgtgagttggtccgccgatcaccgggtaatcgacggggcgacaatgagtaggttttccaatttgtggaaatcttatttggaaaaccccgccttcatgcttctagacctgaaa

SEQ ID NO: 249990 - DNA, 1446 bp, Artificial Sequence
  Description of Artificial Sequence: Synthetic coding sequence
atggcggcagtgaggatgctgcggacatggagcaggaatgccggtaagctgatctgtgtgcggtacttccaaacgtgtggtaatgttcacgtgctgaaacccaactacgtctgcttctttggctaccctagcttcaagtactcccaccctcaccattttcttaagacaacggcagcgctgcgggggcaggtggtgcagtttaaactcagtgatatcggcgaaggaatccgcgaagtcaccgtgaaggaatggtatgtaaaagaaggcgacaccgtctcccagtttgacagcatctgcgaggtgcaaagcgacaaagcgtcggtgactattacttccagatacgacggagtgatcaagaagctgtactacaatctggatgacattgcttacgtcggcaagccgctggtggatatcgaaacggaagccctgaaggattcggaggaggacgtcgtggagacccccgcggttagtcatgatgaacacactcatcaggagataaaaggcagaaagaccttggctaccccagcagtccggcgcctggctatggagaacaacatcaagctgtcggaggtggtgggaagcggcaaggacggaaggatcctaaaagaagatatccttaactatttagaaaagcagaccggtgctatcctgcctccaagccctaaagtggagattatgcccccccccccaaagccgaaggatatgacggtgcctattttggtgagtaagccgccagttttcaccggcaaggacaaaacagagccgattaaaggatttcagaaagccatggtgaaaactatgtctgcagcgctgaaaattccacatttcggctactgtgacgaaattgatctcacagagttagttaaactcagagaagaactcaagccaattgccttcgcacggggcataaagttatccttcatgcctttcttcctgaaagccgctagcctggggttgctccaattccccatcctgaacgcctcagtggacgaaaactgtcagaacatcacttacaaagccagccataatatcggtatcgccatggatacagaacagggcttgatcgtcccaaacgtgaagaacgtgcagatttgcagcatatttgacatcgctacagagctcaacagactgcagaagcttggaagtgtgtctcagctgtctacaactgacttgacaggtggcactttcactctgtctaacataggtagtataggagggaccttcgccaagcctgtaatcatgccgccagaggtggctatcggcgccttaggatcaattaaagcgatccccagattcaaccagaagggcgaggtatataaagcgcaaattatgaacgttagctggagcgccgaccacagagtcattgatggcgccacgatgagtcgcttctcgaatctctggaagtcctatttagagaaccctgctttcatgctgctggatctcaaa

SEQ ID NO: 249991 - DNA, 1446 bp, Artificial Sequence
  Description of Artificial Sequence: Synthetic coding sequence
atggccgctgtaaggatgctaaggacatggagtcgcaacgcagggaaactgatatgtgtacgatatttccagacatgcgggaatgttcatgtgctgaaacccaactacgtctgcttttttgggtatccttctttcaaatattctcacccccaccattttcttaaaacaacagccgccctcaggggacaggtcgtccagtttaaactctccgatattggggaagggataagggaagtcacagttaaagaatggtatgttaaagagggagatacagtttctcagttcgattctatctgtgaagtacagtccgataaagcctctgtgactataacatcaagatatgatggagtcataaagaaactttattacaatcttgatgatattgcgtacgttgggaaaccactcgtcgatatcgaaacagaagcccttaaagattccgaagaagatgtagtcgaaacacccgctgtgtcccatgacgaacatactcatcaggaaataaaaggaagaaagacactcgccacgcccgcagtcaggaggctagctatggaaaataatattaaactctccgaagtggtcggatccgggaaagatgggaggattcttaaggaagatatcttaaactatctggaaaagcaaacaggggccatactgcctccctctcccaaagtagagattatgccacctccccctaaacctaaagacatgactgtccccatcttggtgagtaaacctcccgtcttcacagggaaagataaaactgagcctattaaggggtttcagaaagcaatggtgaaaacaatgtctgcagcgctcaagatacctcatttcgggtattgtgatgaaatcgatctaactgaacttgtgaaattacgcgaggaactgaaacccatcgcttttgccaggggaatcaaactgtcatttatgccattttttttaaaagccgcgtccctgggactactccagttccccatacttaacgcttcagttgatgaaaattgtcagaacatcacatataaggcaagtcataatataggaatagcaatggatactgaacagggacttattgtacccaacgtcaaaaatgtgcagatatgttctatcttcgatatcgccacagaactcaaccgacttcaaaaattaggatcagtgtcccagctgtccactacagatctgacagggggaacatttacactgtctaacataggatcgattgggggaacattcgctaaaccagtcatcatgccccccgaagtagcgatcggggcactcgggtcaatcaaagctattcctaggtttaaccagaaaggagaagtgtacaaagcccagatcatgaatgtgtcttggtctgccgatcatcgggtcatagatggagcgactatgtctcgattctccaacctctggaaatcctacttggaaaacccagcttttatgttgctcgatctaaag

SEQ ID NO: 249992 - DNA, 1446 bp, Artificial Sequence
  Description of Artificial Sequence: Synthetic coding sequence
atggcagctgttagaatgctcagaacttggagcaggaacgcaggcaagctgatctgtgttcgatacttccagacctgtggcaatgtgcatgtcttgaagcccaactacgtgtgctttttcggctatccgagtttcaagtactcacatccccaccacttcctgaagactacagcagccctcaggggccaggtggtgcagttcaagcttagcgacatcggcgaaggcatccgggaagtaactgtgaaagagtggtacgtgaaggaaggagacacagtgtcccagtttgattcaatttgtgaggtccaaagcgacaaggccagcgtgactattaccagtcgttatgatggcgtaatcaaaaaactgtattacaatctggacgacatagcctatgtcggcaaacctttagtggacatcgaaactgaagcacttaaggactctgaggaggacgtagtggagacaccagccgtgtctcacgacgaacatacacatcaggagattaagggacgcaaaactcttgcaactcccgcggtccgccgtttggcaatggagaataatatcaaactgtcggaggtggtgggttcaggcaaggacggtagaattctgaaagaggacatactaaattatctggaaaaacagacaggggcaatcttgccccccagcccaaaagtcgagattatgccccccccaccaaaacccaaggacatgactgtgcctatcttggttagtaagccccccgttttcactggaaaagacaagaccgaacccataaaaggattccagaaggcaatggtcaagacaatgtcggctgctctcaaaattccccactttggttactgtgacgagattgatctgaccgaactggttaagttgcgcgaagagctgaagccaatcgcttttgccaggggcataaaacttagttttatgcctttctttcttaaggcagcaagcctgggactactccagtttcctatcttaaatgcttcggttgacgagaattgccaaaatatcacttacaaagccagccacaacataggaatagctatggacactgaacaggggttgattgtgcccaacgtcaaaaacgtacagatctgcagcatcttcgatatagccactgaactgaacaggctacagaagttgggatctgtttctcagttgagcaccactgacctgactggcgggacatttaccctctctaatatcggaagtattggaggtaccttcgcaaagcccgtgattatgccaccagaggtcgccatcggggccttgggtagtattaaggccatcccaagatttaaccagaagggcgaagtttacaaggcacagattatgaatgtatcttggtcagctgaccatagagtgatagacggggcgaccatgagtagattctctaatttatggaagtcatacctcgagaatccagcctttatgttgctggaccttaaa

SEQ ID NO: 249993 - DNA, 1446 bp, Artificial Sequence
  Description of Artificial Sequence: Synthetic coding sequence
atggctgctgtgaggatgttgagaacctggtccaggaacgctggaaaacttatttgcgtgcggtattttcagacatgcggcaacgttcatgttctgaagccaaattacgtttgcttcttcggatacccttctttcaagtactctcatccgcatcattttctgaagacaactgcggcactccgcgggcaagtcgtgcagtttaaactcagcgatataggtgaagggataagggaggtgaccgtaaaagagtggtacgtgaaggagggagatactgtgagccagtttgactcaatatgtgaggttcagagtgacaaggcttctgtcaccattacatctcggtacgacggtgtgatcaagaaattgtactataacctggacgatatcgcatatgttgggaagccacttgtggatatagagacagaagccctgaaggattctgaggaggacgtggtcgagactccagccgtcagccacgacgaacatacccaccaagagatcaaaggccgcaagactttggccacaccggcggtgcgacgccttgccatggagaacaacatcaaacttagcgaagtggtaggatcaggtaaagatggaaggatcctcaaagaggacattttgaactatcttgaaaaacagaccggagccattctgcctccctcaccaaaagtcgagattatgccacctccacctaagcctaaagatatgactgtcccaatccttgtgtcaaagcctccagtatttacgggaaaggacaagactgaacctatcaaaggatttcagaaagcaatggttaaaaccatgtccgcggctcttaagatccctcattttggctactgtgacgagattgatctgacagaacttgttaagctgagagaggaactgaaacctatcgctttcgcacgcggcatcaaactttcattcatgccattctttctgaaagccgctagcctgggactgctgcagttccctattctcaacgcttccgtggatgagaattgtcagaacattacatacaaagcctctcacaatataggcatcgctatggacaccgagcagggcctcatcgtgcctaacgtcaagaatgtgcagatatgcagcatttttgacatcgcaaccgaactcaaccgcctccagaagttgggaagcgtgagccaactgagtacaaccgatctcactgggggaaccttcactttgtcgaacatcggcagtattggcggcaccttcgctaagcccgtgatcatgccacccgaagtggcaatcggcgcactggggtctatcaaggctattccaaggttcaaccaaaaaggggaggtttacaaggctcaaatcatgaacgttagctggtccgcagaccacagggttatagacggcgcgactatgtccaggttctctaacctctggaaaagctacctggagaaccctgcatttatgttgctggaccttaaa

SEQ ID NO: 249994 - DNA, 1446 bp, Artificial Sequence
  Description of Artificial Sequence: Synthetic coding sequence
atggctgcggttagaatgcttagaacctggagccgtaacgccgggaaattgatctgtgtgcgatatttccagacatgtggaaatgtgcacgtcctgaaaccaaattacgtttgtttctttggctaccccagcttcaaatattcacacccacaccacttccttaagacaacagcagccctccgtggacaggtggtgcagtttaagttgagtgacattggggaagggatccgtgaagtgaccgttaaggaatggtacgtgaaggagggcgacaccgtgagccagttcgattccatctgcgaggtgcagtctgacaaggcaagcgtgaccattacctcccggtatgacggagttatcaaaaaactctattataatctcgacgatatcgcatacgtaggcaagcccctagtcgacatcgagacagaggcactgaaggattctgaagaagacgtcgtggagaccccagctgtcagtcacgatgagcacacccaccaggagataaaggggcggaaaactttggccaccccggctgtgcggcgactggctatggaaaacaacataaaactgagcgaggttgtggggagcggcaaggacgggcgtatcttaaaagaggatattctgaactatctcgaaaaacagaccggggccatactgccacctagtccgaaggtagaaatcatgcctccaccaccaaagccaaaggatatgaccgtccctattctcgtttctaagcccccagtgttcacaggaaaggacaaaacagagcccattaaaggatttcagaaggccatggtgaagaccatgtcagccgccctcaaaattccacactttggatattgtgatgagattgaccttactgagcttgtgaagctcagagaggaacttaagcctatagctttcgccagggggatcaagctgtcttttatgcccttcttcctcaaggccgcttctctgggattactgcaattcccaatcttaaatgcttcagtcgacgagaactgtcagaacatcacctacaaggcctcacacaacatagggattgcgatggacaccgagcagggtctgatagtgccaaacgtgaagaatgtacagatctgctctatctttgacatagccaccgagctgaatagattgcagaagcttgggtctgtgtcacaactctccaccaccgaccttacaggaggaacattcacactctctaatattgggtcaatcggagggacgttcgccaaaccagtcatcatgccacccgaagtggctattggcgcacttggatccatcaaagcaatcccgcgatttaatcagaaaggggaggtgtataaagcccaaataatgaatgtttcctggtctgctgaccaccgggtcatcgacggcgcgactatgtcccggttttctaatttatggaagagctatctggagaacccagctttcatgctgctggacttgaag

SEQ ID NO: 249995 - DNA, 1446 bp, Artificial Sequence
  Description of Artificial Sequence: Synthetic coding sequence
atggctgccgtgcgaatgttacgcacttggtctcgcaatgccgggaaattaatatgcgtgcggtatttccagacatgtggaaacgtgcatgtccttaagcccaactatgtctgcttctttgggtatccttcgttcaagtattctcatccccaccatttcctaaaaactacagcagcacttcgggggcaggtggttcagtttaaactttctgacatcggagagggaatccgggaagtgactgtaaaagagtggtatgtgaaagaaggggatacagtctcgcagttcgattctatatgtgaggtacagagtgataaagccagtgtcacaatcacttccaggtatgatggagtgatcaagaaattatactataatcttgacgacatcgcctacgtggggaaacctctagtagacatagaaactgaagcactcaaagactcggaggaggatgtcgtagagacacccgccgtatcccatgatgaacacacacaccaggaaattaaagggcgaaaaacactggccactccggcagtgcgccgtctggccatggaaaacaacatcaaattgagtgaagtagtcggatccgggaaggatgggcggattttaaaggaagacatactaaactatctagaaaaacagacaggggcgatactgcccccgtctcctaaagtggaaatcatgccaccaccaccaaaacccaaggatatgacagtgcctatattggtatcaaagcctcccgtctttacagggaaggataaaactgaacccattaaagggttccaaaaagccatggtgaaaactatgtcggccgccctaaaaataccccattttgggtattgtgatgaaatagatctgactgaactcgtgaaactccgggaagagcttaagcccatagctttcgccaggggaatcaaactgagttttatgcccttcttcctcaaagcagcatccctgggactgctccagttccctatcctgaatgcctcagtggatgaaaattgtcagaatatcacttataaagcttctcataacataggaatcgccatggatactgaacaggggctcatcgtccccaacgtaaaaaacgtgcagatatgtagtatctttgatattgctacagagctgaacaggctccagaaacttggatcagtgtcacagctgagtacaactgatctcactggaggaacttttacacttagtaatattgggtctattggggggacttttgcaaaacctgttattatgccccccgaagtagctattggagcactcgggtcaattaaagctatcccacggtttaatcagaaaggagaggtctataaagcgcagataatgaatgtgtcttggtctgctgatcatcgagtgatcgatggggccacaatgtcaagattctccaatctgtggaagtcgtatctcgaaaaccctgcattcatgctgctggacttaaag

SEQ ID NO: 249996 - DNA, 1446 bp, Artificial Sequence
  Description of Artificial Sequence: Synthetic coding sequence
atggccgcagtccggatgctacgcacgtggtctcggaacgccgggaaactcatctgcgtgagatatttccaaacttgtggaaatgtccacgtgttgaagcctaattatgtttgcttctttggatacccctcctttaaatattctcatcctcaccactttctgaaaacaactgcagctctcaggggacaggtggttcagtttaaactctccgatatcggagaagggattcgagaggtgacagttaaggaatggtatgtcaaagaaggggatacagtgagtcagttcgattcgatctgtgaggtccaatctgataaagctagtgtaacaatcacttcaaggtatgatggagttataaaaaaattatattacaatctagatgatattgcatatgttgggaaacctttggtggacatcgagacagaagcactcaaagattccgaagaggatgtagtcgaaacacccgctgtgtcccacgatgagcatacacaccaggaaatcaagggacggaaaactctcgctacacctgccgttcgacgcctggccatggaaaataatattaaactttctgaagtggtcggatctgggaaggatgggagaatcctcaaagaagatattctaaattatctcgaaaaacagacaggagccatactaccaccttcccccaaagtggaaatcatgccccctccacctaagcctaaagatatgacagtgcccatcctcgtttctaaaccccctgtgttcacgggaaaggataaaacagaacctataaagggatttcagaaagcaatggtgaagacaatgtccgcagcattaaaaataccacattttgggtattgtgatgaaatcgatctaacagaacttgtgaagcttcgggaggaacttaaacccattgcatttgcacggggaatcaaactttccttcatgccctttttcctaaaagccgctagtctcgggctccttcagtttccaatcctcaatgcatccgtagatgaaaactgtcagaacattacatacaaagccagtcataatatagggatagcaatggatacagaacagggactcattgttccaaatgtaaaaaatgtgcagatctgcagtatatttgatatcgccactgaactgaaccggctccagaaactcggaagtgtctctcagttatcgacgacagatctcactgggggaacatttactctgtctaatatcgggtcaatcggagggacttttgcaaaacccgtgataatgccaccagaagtcgccatcggagccctggggagtatcaaagctattcctcgatttaatcagaaaggagaagtgtacaaagcacagataatgaacgtaagttggtccgccgatcaccgcgtcattgatggagctactatgagtaggttctctaatttatggaaatcctatcttgaaaaccccgctttcatgctcctggacttaaaa

SEQ ID NO: 249997 - DNA, 1446 bp, Artificial Sequence
  Description of Artificial Sequence: Synthetic coding sequence
atggcagcagtacgtatgctcagaacatggtcgagaaatgccggaaagctgatctgcgttcgatacttccagacgtgcggcaacgttcatgtactgaaaccgaattacgtgtgtttcttcggatacccctctttcaaatactcccatcctcaccacttcttgaaaaccacagccgcactccgcgggcaggttgtgcagttcaaattatctgatatcggtgagggcattagagaagtaacagtaaaggagtggtacgtcaaagagggggacaccgtgtctcagtttgattccatctgcgaggttcaatctgacaaagccagcgtcacaataacttcccggtatgatggcgtgattaaaaagctttactacaatttggatgacatcgcctatgtgggaaaacctctggttgacatcgaaacggaagctcttaaagactccgaagaggacgtcgtcgaaacccccgcagtgagccatgatgaacacacccatcaagagatcaaaggccgcaaaactctggctaccccagctgtcagacgtctggctatggaaaataacattaaactgagtgaagtggttggcagcgggaaggatggtaggatcctgaaggaagatatcttgaattacctggagaagcagacgggcgccatcctccccccatctccaaaagtcgagatcatgccacctcctcctaaaccaaaagacatgacagttcccattttggtgtctaaaccccctgttttcacggggaaggataaaaccgagccaatcaagggcttccaaaaagctatggtcaaaacaatgtccgcggcattaaaaattccccacttcggatactgcgacgaaatagatctgaccgagctagtcaaactaagagaggagctcaaaccaatcgcgtttgcccggggtatcaagctctcgtttatgcccttcttccttaaggcagcctctctcggtctcctccagtttcccattctgaacgcatctgttgacgaaaattgccagaacataacgtacaaggctagtcacaacataggaatagccatggataccgaacagggactcatcgtgccgaatgtcaaaaatgtccagatctgcagcatattcgatatcgccaccgagctgaaccgcttacagaagctgggttctgtgtcacagctctcgacgacggacctcactggcgggactttcacgctgtccaacatcggctccattggaggtacttttgctaaaccagtcatcatgccacccgaagtcgccattggcgccctggggtctattaaggccattcctaggttcaatcagaagggtgaagtgtataaggcccagattatgaacgtctcgtggtccgctgaccaccgcgttattgatggagcgacgatgagccggttctctaacctgtggaagtcttacctagaaaaccctgcctttatgcttttggacctgaag

SEQ ID NO: 249998 - DNA, 1446 bp, Artificial Sequence
  Description of Artificial Sequence: Synthetic coding sequence
atggcggcagtgagaatgctccggacttggagtcgaaatgccggaaagctaatttgtgtgaggtactttcagacgtgtggaaatgtacatgtgttaaaacctaactatgtgtgcttctttgggtatccatctttcaaatatagtcacccccatcactttctcaaaacaactgccgcactcagaggacaggtggtgcagtttaagctcagtgatataggagagggaatccgggaagtgacagtcaaagagtggtatgtcaaagaaggggatacagtttcgcagtttgattcaatctgcgaggtgcagagtgacaaagcctctgtgacaataacatccagatatgatggagtgataaaaaagctgtattataacctagatgatatcgcctatgtggggaaacctctagtagatatcgagacagaagcactcaaagattccgaagaagatgtcgtggagacaccagcagttagtcatgatgaacatacacatcaggagatcaagggaaggaagactcttgctacaccagcagtgcgccggctcgccatggaaaacaacataaagctcagtgaagtggtggggtctgggaaagatggacgcattttaaaagaagacatactaaactacctggaaaaacagacaggagcaatcctcccaccttccccaaaggttgagataatgcccccaccccctaaacctaaggatatgacagtgcctatactggtgtcaaaaccaccagtcttcactgggaaagataaaactgaacctataaaaggattccagaaagccatggttaaaacaatgtccgcagccctgaaaatcccccatttcggatattgtgatgaaatagatttaacggaactcgtcaagctcagggaggaactcaaaccaatagccttcgcgcggggaatcaaactttctttcatgccattcttcctaaaggcggcttctctagggctgctccagtttcccattttaaacgcctccgtcgatgaaaattgtcagaatattacatataaagcctctcacaacataggaatagctatggacacagaacaggggctcatagtacctaacgtgaagaatgtgcagatatgttctatattcgatatcgccactgaacttaaccgactccagaaactcgggtctgttagtcagcttagtacaacagatttgactggggggacattcactctctctaacattggatctattgggggaacatttgccaaacccgttattatgccccctgaagtagccatcggggccctcggatcaatcaaagccatacctcgcttcaatcagaagggggaagtgtacaaagctcagatcatgaacgtgagttggtcagcagatcaccgggtaatagacggagccactatgtcacggttttccaatttatggaaatcttatcttgagaacccagcttttatgcttctcgatttaaaa

SEQ ID NO: 249999 - DNA, 1446 bp, Artificial Sequence
  Description of Artificial Sequence: Synthetic coding sequence
atggccgccgttcgtatgcttcggacgtggtctcgcaatgccggcaagctgatctgtgttagatacttccagacctgcggtaatgtgcacgtgctaaagcctaactacgtatgctttttcggatatcctagcttcaaatatagtcacccacatcacttcctgaagacaactgcagctcttcgcgggcaggtggttcagttcaagctcagcgacatcggggaaggcattcgggaagtcaccgtcaaagaatggtatgtcaaggagggggacacagtgtcccagttcgattcaatatgcgaggtccagagcgacaaagcttcagtgaccattacctcacgatacgatggcgtcatcaaaaagctgtactataacctggacgacattgcttatgttggaaagcccctcgtcgatattgagactgaagcactgaaagattccgaggaagacgtcgtcgagacacccgctgtttcccacgatgaacatacacaccaagagatcaaaggccggaagacccttgcgacgcccgcagtccgtaggttggcaatggagaacaacattaaactgagcgaggtcgtcgggtcaggcaaggatggccggatattaaaagaggacattttaaattacctagagaaacagacgggggcaatcctgcccccctcacccaaagtggagattatgcctcctcccccaaagcccaaagacatgacagtccccatcctggtgtcaaaacccccagtgtttactgggaaggacaagacagagcccattaaaggattccaaaaagccatggtgaaaactatgtcagctgcactgaagattccccattttgggtactgtgacgaaattgatttaaccgagctggtcaagcttagagaggagctgaagcccattgcatttgcacgtggtattaagctgtccttcatgcctttttttcttaaggctgcctcgctgggtttgctgcaattccctattctgaatgctagtgtcgacgaaaattgtcagaacattacttacaaggcctctcataatatcggaatagctatggatacagaacaggggttaatcgtgccgaatgtcaagaatgtgcagatttgctcaatcttcgacatcgcaacggagctgaatcggctccagaagctgggatctgtcagtcagctgtccaccacggatctgaccggggggacgtttactctctccaatatcggatccattgggggcacattcgctaaacccgtgataatgccccccgaagtggcaatcggcgctctgggatctatcaaggccatcccacgctttaaccagaagggagaggtgtacaaggctcagatcatgaatgtgagttggagtgccgatcatcgcgtgattgacggcgctaccatgagccgtttctcaaacctgtggaaatcctatctcgaaaaccccgcttttatgctactggacttgaaa

SEQ ID NO: 250000 - DNA, 1446 bp, Artificial Sequence
  Description of Artificial Sequence: Synthetic coding sequence
atggccgcagtgcggatgctgcgcacttggtcgcggaatgccggaaagctgatttgtgtgcggtactttcaaacttgcggaaacgttcatgtccttaaaccgaattacgtgtgtttctttggttatccctcgtttaagtacagccaccctcatcacttccttaagaccaccgcagcgcttcgtgggcaggtggtgcaattcaagctgtccgatatcggcgaagggatcagggaggttaccgtgaaggaatggtatgtcaaggagggagatacggtttcgcaatttgacagcatttgcgaagtccaatcggacaaggcatccgtgaccattacctcaagatacgatggtgtgatcaagaagctgtactacaatctcgatgacattgcgtacgtcggcaaacctctggtggatattgaaaccgaggcacttaaggattcagaagaagatgtcgtcgaaacgcctgccgtgtcacatgacgaacatactcatcaagagataaagggacgaaagactctggcgacccctgcagtcaggagactggcgatggagaacaacatcaagctttcggaagtggtcggctccggaaaggatgggagaatactgaaagaagatatactgaactacctcgagaaacagactggtgcaattcttccgccctcccctaaagtggaaatcatgcctccaccacccaagccaaaggacatgaccgtcccaattctggtgagcaaacctccggtctttaccggaaaggacaaaaccgagcctatcaagggttttcaaaaagcaatggtcaaaacgatgtccgcagcattgaaaatcccacacttcggatactgcgacgaaatcgacttgaccgaacttgtgaagcttcgcgaagaattgaagcccatcgcatttgctagagggatcaagctgagctttatgccattctttcttaaggcagcatccctcggactgcttcaattccctattctcaacgcatcggtggatgaaaactgtcagaacattacttacaaagcatctcacaacattggcattgctatggatactgagcaaggcctgattgtgcctaatgtgaagaacgtgcagatctgtagcattttcgatattgccaccgaactgaatcgactccaaaagctcggtagcgtgtcgcagctttcaaccactgatctgactggaggaacttttactctctcgaacatcggtagcatagggggtacttttgcaaagcccgtgatcatgccaccagaagtggccattggagcacttggttccataaaggccattcctcgctttaaccagaaaggagaggtgtacaaagcccagattatgaatgtgtcatggtcggcggaccatcgtgtgattgatggcgctaccatgtccagattttcaaatctctggaagagctaccttgagaacccagccttcatgcttctggatctcaag

SEQ ID NO: 250001 - DNA, 1446 bp, Artificial Sequence
  Description of Artificial Sequence: Synthetic coding sequence
atggcagccgtgcggatgctgcggacttggtcacggaatgccggaaaactcatttgtgtgcgctactttcagacgtgcggtaacgtgcacgtcctcaagccgaactacgtgtgcttctttggctatcctagcttcaagtattcgcacccccatcatttccttaagaccactgcggcactgcgcggacaagtggtccagttcaaactgtcagacattggagaaggcatccgcgaggtgactgtgaaagaatggtacgtgaaggagggagacaccgtctcacagttcgattccatttgcgaagtgcagtcagataaggcctccgtgaccatcacctcgcgttacgatggcgtcatcaaaaagctgtactacaatcttgatgacattgcctacgtgggcaaaccattggtggacatcgaaactgaagccttgaaagatagcgaagaggacgtggttgagacgccagccgtgtcgcacgacgagcacacccaccaagaaatcaaaggacgcaagaccctggctaccccagccgtccgcagactggcgatggaaaacaacatcaagctctccgaagtggtgggcagcgggaaggacggacgcatccttaaggaagatattctgaattacttggaaaagcaaaccggtgccatcctcccaccgtcgccgaaggtcgaaatcatgcctcctcccccgaagccaaaggacatgactgtgccgattttggtgagcaagcccccagtgttcaccggaaaggacaaaactgaaccgatcaagggattccagaaggcgatggtcaagaccatgtcagcagctctgaagattccacattttggatactgcgacgaaatcgacctgactgagctggtcaagctcagagaggagctcaaaccgatcgccttcgccaggggaatcaaactgtccttcatgccgtttttcctcaaggcggcatcgctgggcctgttgcagttcccgatcctcaatgcgtccgtggacgagaactgtcagaatatcacttacaaggcttctcacaacattggtatcgcaatggacaccgagcagggcctgatcgtgccgaacgtcaagaacgtccaaatctgctccatcttcgatatcgcaactgagctgaataggctgcaaaaactcggcagcgtctcccaactgtcgactaccgatctgactggagggaccttcacgctgtcgaacatcggaagcatcggaggtacctttgctaagccggttatcatgcctccggaggttgcgatcggagccctcgggtccatcaaggcaatccctagattcaatcagaagggggaggtgtacaaagcccagatcatgaacgtgtcctggtcggctgatcatcgggtgatcgacggagcgactatgtcgcggttttcaaacctctggaagagctaccttgaaaaccccgctttcatgctgctcgatctgaaa

SEQ ID NO: 250002 - DNA, 1446 bp, Artificial Sequence
  Description of Artificial Sequence: Synthetic coding sequence
atggctgccgtgaggatgctccgaacatggtccaggaatgctggaaaactaatctgtgtgcggtacttccagacctgtggaaacgttcacgtgttaaaacccaattatgtgtgttttttcgggtatccatcgttcaagtattcacatcctcatcattttctcaagaccactgccgccctgcgcggtcaggtggtgcagttcaagctcagcgacattggcgaagggatacgagaagttaccgtcaaggaatggtacgtgaaagagggagacacggtttcccaattcgattccatctgcgaggtgcagtccgataaggctagcgtcacaataacttccagatacgatggggtcatcaagaaactgtactataacttggacgatattgcttacgtgggtaagccccttgtcgatattgagaccgaagccctgaaggatagcgaggaggacgtagtagagacaccggctgtgtcccacgatgagcacactcaccaggagatcaaaggccggaagacccttgctactcctgccgtacggaggctggctatggagaataacatcaaactctccgaagtggtggggagtgggaaagatggtcggattctgaaagaagatatactgaactacctggaaaaacaaactggagccatcctgccgccttcccctaaggttgaaatcatgccccctccaccaaaacccaaggatatgactgtacccattcttgtcagtaagccgcctgtctttaccggcaaggacaaaaccgagcctattaagggattccagaaggccatggtcaagacaatgagtgccgctttaaagatcccacattttggctactgcgacgagattgatctgacagagctggtgaaacttagggaagagctgaaaccgatagccttcgccaggggcatcaagctgtcattcatgccattctttctcaaggccgcatctcttgggcttttacaatttccaatcttgaatgcaagcgttgacgaaaactgccagaacatcacctataaagcaagccataatatcggaatcgccatggacactgaacagggcctgatcgtccccaatgtcaagaatgtccagatttgttccatttttgatatcgcaacagaactcaatcgcttacagaaattgggctcagtatctcagctgagcaccaccgatttaacaggcggcactttcaccctcagtaatatcgggagtattggaggcaccttcgcgaagcccgtgatcatgcctccggaggtcgccattggggctctgggatccattaaggctattccccgcttcaaccagaaaggagaagtctataaggctcaaataatgaatgtcagctggagtgctgaccaccgggtgatcgatggggccaccatgagtcggtttagcaatctctggaaatcctatctcgagaatcctgcatttatgctgctggacttaaaa

SEQ ID NO: 250003 - DNA, 1446 bp, Artificial Sequence
  Description of Artificial Sequence: Synthetic coding sequence
atggctgccgtgcgcatgctccgcacctggagcaggaacgcaggaaagttgatctgcgtgagatacttccaaacttgcgggaatgtgcacgttttaaagcccaactacgtatgcttctttgggtatcctagcttcaaatactcacaccctcaccattttcttaagactaccgctgctcttcgtggacaggtggtacaatttaaactctcggatataggggaaggtatcagggaagtaaccgtgaaagagtggtatgtgaaagaaggtgacactgtttcacagtttgattcgatttgtgaagtccagagtgacaaggcgagcgttaccattacatcaagatacgatggcgtcatcaaaaaactttactacaacctggacgacatcgcatacgttggcaagccactggttgacatcgaaactgaagcactcaaggatagcgaggaagatgtagttgaaactcccgctgtgtctcacgatgagcacacccatcaagaaatcaaaggacggaagaccctggctactcctgctgtgcggagactcgctatggagaacaacatcaaactgtctgaagtggtgggctcaggcaaagatgggcgcattcttaaggaggatatcttgaactacctggaaaaacagactggggctattctcccaccaagcccaaaagtggagatcatgccacccccgcctaaacctaaggacatgacagtccccatccttgtttccaagccgccggtcttcaccggtaaggacaaaaccgaacctataaagggattccagaaagctatggtgaaaaccatgagcgccgctctgaaaatcccacatttcggatattgcgacgagatcgatctcacggaattggtgaagcttcgggaggaactcaagccaatcgctttcgcgaggggcatcaagctgagctttatgcccttctttctgaaagccgcttcgctgggcctgctccaatttcccatcttgaacgcttcagtcgatgaaaattgccagaacataacatataaagcctcacacaacattgggatcgctatggataccgagcagggactaatcgtgcccaatgtcaaaaacgtgcaaatttgttccatctttgatattgctacagaactgaatcgactgcagaaattagggtccgtgagtcagcttagtaccactgatctcaccgggggaacctttacgctcagcaatatagggtcaatcggtggaacatttgccaaaccagtgatcatgcctcccgaagtcgctatcggcgcactcggatccattaaagcaataccccggttcaaccaaaaaggggaagtgtacaaagcccagattatgaacgtcagttggagcgccgaccacagagtgattgacggcgcaacaatgtctcgctttagcaacctctggaagtcgtatctggagaatccagcgtttatgctcctggatcttaag

SEQ ID NO: 250004 - DNA, 1446 bp, Artificial Sequence
  Description of Artificial Sequence: Synthetic coding sequence
atggctgctgtgaggatgttgagaacctggagccgtaacgctgggaaactgatctgtgtgaggtactttcaaacatgcggaaatgttcacgtgttgaagcctaattacgtgtgctttttcggttacccttcatttaagtactcacatccgcaccatttccttaagaccactgcggccctgagaggtcaagtggtgcaatttaaattgtccgatattggtgaaggaatcagagaggtaaccgtgaaagaatggtacgtcaaggaaggagatactgtgtcccagttcgatagcatatgtgaagtgcaatcagataaggcaagtgttacgatcacctctagatatgatggagtgattaagaagctgtactataacctcgatgacatcgcttacgtgggaaagcccttagttgacattgagactgaggccctgaaagacagtgaagaggatgtggttgaaactccagctgtttctcacgatgagcatactcaccaggagattaaaggaagaaagactttagctacccccgccgtcaggagactcgccatggagaacaatatcaagttgagtgaggtggtcggttcgggcaaagacggccgcattctgaaagaagatatcttaaattacctggagaagcagaccggagctatcctgccaccatctcccaaggtagagatcatgccaccaccgcccaaaccaaaagacatgacagtgcctattctggtgagcaagcctcccgtctttacaggaaaggataagaccgagccaattaaaggattccagaaagccatggtaaagaccatgagtgctgccttaaagattccgcactttgggtactgcgacgagattgacctcaccgaactggtgaagctgagagaggagttgaaacctatcgcttttgctaggggtataaagctttcttttatgcctttctttttaaaagcggcttcactgggactgctgcagttcccaatcctcaatgctagcgtcgatgagaattgtcaaaacattacatataaagcttctcacaatataggcatcgccatggataccgagcaggggttaattgtgcctaacgtaaagaacgttcagatatgctcgatctttgatatcgctaccgaacttaataggcttcagaaactgggaagtgtctctcaactcagtaccaccgacctgactggcggaacatttacactgagcaatataggatctatcggcggtactttcgccaaaccagtgatcatgcctccagaggtggccatcggcgctcttgggtccatcaaagctatccctcgctttaatcaaaaaggcgaagtctataaggctcagatcatgaatgtgtcatggtcagccgaccatagggtcatcgacggagccacaatgtcgagatttagcaacctgtggaagagttatctagaaaaccctgcttttatgctgctggaccttaaa

SEQ ID NO: 250005 - DNA, 1446 bp, Artificial Sequence
  Description of Artificial Sequence: Synthetic coding sequence
atggccgccgtgagaatgcttcgtacctggtcccgcaacgctgggaaactcatctgtgtgcggtattttcagacatgcggaaatgtccacgttctcaagccgaattacgtatgtttctttggttacccttcttttaagtactcccaccctcaccattttttgaagaccaccgccgcactgagaggccaagtggttcagttcaagctcagcgatatcggcgaggggatccgtgaggtcacagtgaaagagtggtacgtgaaagagggagacacagtctcccagttcgactctatatgcgaggtgcaatcagataaggccagcgtcacaattacgagcaggtatgacggtgttatcaagaagctatactacaacctggacgacattgcttacgtaggtaagccattagtcgacatcgagaccgaagcactgaaagactctgaggaggacgtggttgagaccccggcagtctcccatgacgagcatactcaccaggagattaagggacggaaaacgttagccaccccagccgttagacgcctggccatggaaaataacatcaagttgtccgaggtggtcgggtctggaaaggacgggcggattctgaaggaggatatattgaactatttggagaaacagacgggcgccattctcccaccgagtcctaaggttgagattatgccacccccccccaagcctaaagatatgaccgtccctatactggtgtcgaaaccgccagtgtttaccgggaaggacaaaacagaaccgattaagggctttcagaaggcaatggtgaagacgatgtccgccgccctcaaaataccccactttggatattgtgacgaaattgaccttacagaactggtgaaactcagggaagagctgaagccaatcgcatttgcgcggggcatcaaactttcatttatgcccttctttctgaaggcggccagtctcggcctgctgcagttcccaatcctcaacgcctccgtggacgagaactgccagaacattacatataaggcctctcacaacataggaatcgctatggatacagagcaggggttgattgttcccaatgttaagaacgtgcagatttgctcaattttcgatatagctaccgagctgaatagactgcagaaactgggatcagtctcccagttatccacgaccgacctcacgggtgggacattcaccctgagcaacattggatctatcggcggcacgtttgccaagcccgtgattatgccacccgaggtcgcaattggagcccttggctctatcaaagcaatccccagattcaaccagaagggggaggtttataaggcccagattatgaatgtatcttggtccgctgatcacagagttattgacggcgcgacgatgtccagattcagtaatttatggaaaagctacctggagaatccggcatttatgctattagacctgaag

SEQ ID NO: 250006 - DNA, 1446 bp, Artificial Sequence
  Description of Artificial Sequence: Synthetic coding sequence
atggctgctgtgcgaatgctgcgaacctggagccgcaacgcgggcaaattaatctgtgtgaggtatttccagacatgtgggaacgtgcatgtccttaaacctaactacgtgtgtttcttcggctacccctctttcaagtactcccaccctcaccacttcctaaagacaactgccgcactccgcggtcaggtggtgcagtttaagttgtctgacatcggggaaggcatacgagaggtgacagtcaaagaatggtacgtgaaagaaggcgatactgtttcccaatttgactccatctgtgaggtgcagtccgacaaggcctcagtaaccatcacatctcgctacgacggtgtgatcaaaaaattgtactacaacctggatgacatagcatacgtgggcaaacctcttgtggacatcgagaccgaagcactcaaagattcggaggaggatgtcgtggagacaccggccgttagtcacgacgaacacacccaccaggaaattaaagggagaaagaccttggcgacacctgccgttagaaggttggccatggagaacaatatcaaactgtccgaagtcgtggggagcgggaaggacggaagaattctgaaggaagacatcctgaattaccttgaaaagcagacaggggccatcctcccgccctctcccaaagtggagatcatgccacccccgcctaaacccaaagatatgactgtccccattcttgtatccaagccccctgtgttcaccggcaaagacaagaccgaacccattaagggatttcagaaagccatggtcaagacaatgtctgctgcattgaagatccctcactttggatactgtgatgagatcgacttgaccgagctggtcaagctcagggaggagctgaaaccgatcgccttcgctagggggatcaagttgtcattcatgcccttctttctgaaagccgctagccttggcttgctacaatttccaatcctgaacgcgtccgtcgatgaaaattgccagaatattacttacaaggcctctcacaacatcggtatagctatggataccgagcaggggctcatcgtccctaatgtgaagaatgttcagatctgtagcatctttgatattgccactgagctgaaccgcctgcaaaagctgggatccgtgtctcagctgagcactaccgacctgacaggaggtacgttcaccctttccaacatcggctctatcgggggaacctttgccaaaccggtgatcatgcctcccgaggtagcgattggcgctctcggttctatcaaggccatcccacggtttaatcagaaaggagaagtttacaaggcgcagatcatgaatgtgtcttggtccgcagatcaccgcgtcatcgatggggcgaccatgtctcgcttcagtaatctttggaaaagctacctcgagaatccagcgtttatgctgctggatctgaaa

SEQ ID NO: 250007 - DNA, 1446 bp, Artificial Sequence
  Description of Artificial Sequence: Synthetic coding sequence
atggcagccgtcaggatgttgcgcacatggagcagaaacgcgggaaagctcatatgcgttcggtacttccagacctgcggaaatgtccacgtgctgaagcctaactatgtttgtttcttcggataccccagtttcaaatacagccacccacatcacttcctgaaaactaccgccgcgctgcgcggacaagtagtgcagttcaagttaagtgatattggcgagggaataagagaagtgacagttaaggagtggtatgtaaaagagggagatacagtcagtcagttcgatagcatatgcgaagtacagtccgacaaggcatctgtgaccattacctcacggtatgatggcgtgattaaaaaactgtattacaatttggacgacattgcttatgtagggaagccgctggtcgatattgagaccgaggctttgaaggactcagaggaggacgtggttgaaacccccgccgtttcacatgacgagcatacgcatcaggaaataaaaggccgaaaaacactagcaacacctgctgtgcgcagactggcaatggaaaataacatcaagctgtcagaggttgtggggtcaggcaaggatggaaggatcctcaaagaagacattctcaactatttggaaaagcagacaggagctatactgccgccgtcccccaaggtggagataatgcctccaccacccaagcctaaggacatgacagtgcctatactagtctccaagccacctgtttttacagggaaggacaagaccgagcccatcaaaggatttcagaaggctatggtaaaaaccatgtctgccgcccttaagattccccattttgggtactgcgacgagatagacctgaccgagttggtgaagcttcgagaggagctcaagccaatcgcgtttgccagggggattaaactgtccttcatgccctttttccttaaagctgctagcctgggactgctgcagtttcccattttgaacgcttccgtcgacgaaaattgccaaaatataacctataaggccagtcacaacataggaatcgcaatggatacggagcagggactcatcgtgccaaacgtgaaaaatgtgcaaatctgctctatttttgatattgccacggaactcaataggctccaaaaattaggatcagtaagccagctgtccacaaccgacctaaccgggggcacgttcaccctgagcaacataggttccataggagggacatttgccaaaccagtgatcatgcctcccgaagttgctataggggcgcttgggtctattaaggcaattccaagatttaatcagaagggggaggtctataaggcccagatcatgaacgtatcctggtccgctgatcatagagtcatcgatggtgccactatgagtcgcttcagtaacctgtggaagtcctacctggagaaccctgcattcatgctgttagacctgaag

SEQ ID NO: 250008 - DNA, 1446 bp, Artificial Sequence
  Description of Artificial Sequence: Synthetic coding sequence
atggccgcggtgagaatgcttcggacctggtcaagaaacgccgggaagttgatttgtgtcaggtacttccagacatgcggtaacgtgcacgtgctgaagccaaactacgtatgcttcttcggttacccatccttcaagtactcccacccccatcacttcctgaaaactacggctgccctgagaggccaggtggtgcagttcaagctttctgacatcggggaaggcatcagggaggtgacagtcaaagaatggtatgtaaaggagggcgataccgtgagtcagtttgatagcatatgcgaggttcagagtgataaggcatcagtcaccattactagccggtatgacggggttatcaagaagctgtactacaacctcgacgatattgcctacgtaggtaagcccctcgtggatatcgagaccgaagcactgaaagattcagaagaggacgtcgtggagacacctgccgtgagccacgacgagcacacccatcaggagataaagggtcgcaaaacactcgctactccggcagtgagaaggctcgcaatggagaacaacatcaagctgagtgaagtcgttggatccggaaaggatggaaggatcctcaaggaggacatcctcaattaccttgagaagcagacaggcgcaatcctgccacctagcccaaaagtcgagatcatgccacctcctcccaaacctaaggacatgacagtgcccattttggtcagtaaaccacctgtgttcacaggtaaggacaagaccgaaccaattaagggatttcagaaagctatggtaaaaactatgagtgccgcacttaaaattccacactttggctactgtgatgagattgatctgacagagttggtgaaattgcgcgaggaactgaaaccgattgcctttgcgcgcggcataaagctctcattcatgccttttttcctgaaggctgctagcttgggcctgttgcaatttccgatccttaacgcctcagtggacgaaaactgccaaaacatcacgtataaagcctcacacaatatcggtatagctatggacacagagcagggcctcatcgtgcctaacgtcaaaaacgtgcagatatgcagcatcttcgacattgctacggaattgaatagactgcagaagctcggatccgttagccagctctccactaccgaccttacagggggaacttttaccctgtcaaatatcggatcaattggagggacatttgccaaacccgtcattatgcctcctgaggtggcgatcggggccttgggatctattaaggccattcctcggttcaaccaaaagggagaagtgtataaggcccagatcatgaatgtgagttggtcagccgaccatcgcgtcatcgacggagccacaatgagccggttctccaacctgtggaagtcctaccttgagaaccccgcattcatgcttctggatctcaaa

SEQ ID NO: 250009 - DNA, 1446 bp, Artificial Sequence
  Description of Artificial Sequence: Synthetic coding sequence
atggccgcggtccggatgctgagaacatggtctagaaacgccggtaaactgatctgtgtgcggtatttccagacctgcgggaacgtccacgtcctgaagcctaactacgtctgctttttcggctatccatcattcaagtattcccacccgcaccattttctgaagaccaccgcagctctgagaggccaggtcgtacagttcaagctgtctgacatcggtgaggggatccgggaggtaactgtcaaggaatggtatgtcaaggaaggcgacaccgtttcccagttcgattccatctgtgaggtacagagtgacaaggcttccgttacgatcacgtcaaggtatgatggtgttatcaaaaagctgtattacaatctggacgacatcgcatacgtcggaaaaccactggtcgacatcgagaccgaggctctcaaggattccgaggaagacgtcgtagagaccccagctgtttcccacgacgaacacacccatcaggaaatcaaggggagaaagacactggctacccccgctgtacgcaggctggccatggaaaataacataaaactgtccgaggtcgtgggaagcggtaaggatggccgcattctgaaggaggacattctcaattacctggaaaaacaaaccggagccatattgcctccatcccctaaagtagagattatgccccctccacctaaacccaaagacatgaccgtgcctatactggtgtccaagccaccagtgtttaccggaaaggataagacggagcccattaaggggtttcaaaaggccatggtcaagacaatgagcgctgccctgaaaataccccatttcgggtactgcgacgagatagatctgactgagcttgtaaaactgagggaggaactcaagcctattgcgtttgcacgaggtattaaactgtcttttatgcccttctttctgaaggccgcatccttgggacttctccagttccctattttgaatgcgtcagtcgatgaaaactgccaaaacatcacgtataaagccagccacaatattggaattgccatggacactgagcagggtctgatcgtgcctaacgtgaagaacgtgcagatatgttcaatcttcgatatcgcaaccgagcttaatagattgcagaaacttggttcagtgtcccagctgagtacgaccgacctgaccggagggaccttcacactgagcaacattgggagcattgggggtactttcgctaaacccgttatcatgccgccagaagtcgccataggggccctgggcagcataaaagccatacccaggtttaaccaaaaaggtgaggtgtacaaggcacaaataatgaatgtcagttggtccgcggaccatcgagtgatcgacggtgctaccatgtccagattcagcaatctgtggaaaagctatttggagaatccggctttcatgctgctggacctcaaa

SEQ ID NO: 250010 - DNA, 1032 bp, Artificial Sequence
  Description of Artificial Sequence: Synthetic coding sequence
atggtccgcgcccgacaccaaccgggagggctctgtctgctgcttcttctgctttgtcagtttatggaggacaggagtgcccaggccggaaactgctggcttagacaagccaagaacgggcgctgccaggtgctgtataaaactgaactctctaaggaagagtgctgctccaccggcaggctatctacgtcatggacagaggaggacgtcaatgataacacactgttcaagtggatgatctttaatggaggcgcacccaattgtattccttgcaaagagacttgtgagaacgtagattgcgggccgggaaaaaagtgccgaatgaacaagaaaaacaagccgagatgtgtgtgtgctcccgactgttctaacatcacttggaagggacccgtgtgtggcttagatggcaagacctaccggaatgagtgtgcactgcttaaggcccgttgtaaagagcagcctgaactggaggtccagtatcagggacgatgtaagaagacctgcagagacgtcttctgcccgggctcctctacttgtgttgtcgatcagaccaacaacgcctactgcgttacctgcaatagaatatgccccgaacccgcgtcgtccgagcagtacctgtgcgggaacgatggcgtaacttattcttctgcctgtcacctgagaaaggccacatgccttctgggcaggtctataggactggcgtacgaaggtaaatgtattaaagcaaaaagctgtgaggatatccaatgtacaggcgggaagaagtgtttatgggacttcaaggtaggcaggggacggtgcagcctctgtgacgaactctgcccagacagtaaaagcgatgaaccagtgtgtgcatcggacaacgccacctatgcaagcgagtgcgccatgaaagaggcggcctgttcctcgggcgtcctgctcgaagtgaagcattctggaagctgcaattctattagtgaagataccgaggaggaggaagaagacgaggaccaggactatagttttcccataagctccatccttgaatgg

SEQ ID NO: 250011 - DNA, 1032 bp, Artificial Sequence
  Description of Artificial Sequence: Synthetic coding sequence
atggtccgtgctaggcaccaacctgggggcctctgcctcctactgctgctcctgtgtcagtttatggaggaccgctccgcccaggccggtaattgctggctcaggcaagcaaagaatgggcgctgccaggtgctgtataagacagagctgagcaaggaagaatgttgctctacaggaaggctgtccacatcgtggaccgaagaggacgtgaatgacaacacccttttcaagtggatgatcttcaatggaggggctccgaattgtatcccttgtaaggagacttgtgagaatgtggattgcggaccagggaagaaatgcaggatgaataagaagaataaacccagatgcgtctgcgccccagactgttctaatataacctggaagggacccgtgtgtgggctggacgggaaaacctaccgcaatgaatgtgccctcctcaaagcacggtgcaaagagcagcctgagttggaggtgcaataccagggccgctgcaagaaaacatgcagagacgtcttctgccctgggtcatcaacctgcgtggtggaccaaactaataacgcctattgcgtgacttgcaaccgaatctgccccgaaccagcgtccagtgaacagtatctgtgcggcaacgacggtgtaacttactctagtgcatgccacctgcggaaagctacctgcttgctggggcgaagcatcggactggcctacgaaggtaaatgtatcaaggctaagtcttgcgaggacatccagtgcactggtggcaagaaatgtctgtgggacttcaaggtcggaagaggacggtgctccctttgtgacgagctgtgtcccgattccaaaagtgacgagccggtgtgcgctagtgataacgcaacttatgcaagcgaatgcgccatgaaagaagccgcctgcagctcaggggtcctattagaggttaaacactctggctcttgtaacagcataagtgaggacactgaggaggaagaagaggacgaggatcaagactactcctttcctatcagctctattctggaatgg

SEQ ID NO: 250012 - DNA, 1032 bp, Artificial Sequence
  Description of Artificial Sequence: Synthetic coding sequence
atggtgagagccagacaccagccaggcggtttgtgcttgctcctactgctactgtgtcagtttatggaggatagatcggctcaggccgggaattgttggctgagacaggccaagaatgggcgttgccaggtgctatacaagactgagctgagcaaagaggagtgttgctcaacaggacgcctgtccacgagttggacagaagaagacgttaacgacaataccttgttcaagtggatgattttcaacggcggggccccaaactgcataccctgtaaagaaacctgcgaaaatgtagactgcgggcccggaaagaaatgccgtatgaacaagaagaataagccacgatgtgtctgcgctccggattgcagcaatatcacctggaaaggacccgtgtgtggtttggatggaaagacctacaggaacgaatgtgcccttctgaaggcccgttgcaaggaacagcccgagctcgaggtgcagtatcagggccgctgtaagaagacgtgtcgcgatgtcttctgccccggcagcagcacttgcgtggtggaccagacaaacaatgcctactgtgtgacatgcaatcgaatctgcccggaacctgccagcagcgagcagtacctttgcggtaacgacggagtcacgtacagctctgcgtgccatctgaggaaagccacgtgcctgcttgggcgctctattggcctggcgtacgaagggaagtgcatcaaggcgaagagttgcgaggatatccagtgtacaggaggtaagaagtgtttgtgggacttcaaggttggtaggggcaggtgcagcttatgtgatgagctgtgtccagactcgaagagcgacgagccagtatgtgccagtgacaatgctacttacgccagcgagtgcgcaatgaaggaagccgcatgtagctccggcgtgctcctggaggtgaaacattccggcagttgtaattctatctccgaagatactgaagaagaggaagaggatgaggatcaagattacagttttcctatttcatcaatcctcgaatgg

SEQ ID NO: 250013 - DNA, 1032 bp, Artificial Sequence
  Description of Artificial Sequence: Synthetic coding sequence
atggtccgggccaggcaccaacccggaggcctatgcctgctattattgctgctgtgccagtttatggaggaccggtcagcccaggccggcaactgttggctgcgacaggcaaaaaacggccggtgtcaggtgctctacaagaccgaactcagtaaggaagagtgctgtagcaccggccgccttagcacatcttggactgaggaggacgtgaacgataatacactttttaaatggatgatctttaatgggggcgcacctaactgtattccctgcaaggagacctgtgaaaatgttgactgcggcccgggcaaaaagtgccgcatgaacaagaaaaataaaccccggtgcgtctgcgcccctgactgttctaacataacatggaagggaccggtctgtggcctggatggcaaaacctacagaaacgagtgcgcactcttaaaagcacgctgtaaggagcaaccagagcttgaggtgcagtatcagggtaggtgtaagaagacttgcagagacgtgttttgcccgggaagttccacgtgcgtcgtagatcaaaccaataatgcttactgcgtgacatgcaaccgcatatgccccgagcccgccagcagcgagcagtacctgtgcggcaatgacggagtaacgtatagtagtgcctgccacctgagaaaggccacttgtctgctgggcaggtctataggtctggcctatgagggtaagtgtatcaaggctaagagctgcgaggatatccagtgcaccgggggcaaaaagtgtctttgggacttcaaggtgggcagaggcagatgtagcctgtgcgatgaactttgcccagacagtaaatctgatgagcccgtctgtgccagcgataacgccacatatgccagcgaatgcgccatgaaggaggctgcctgttcctctggtgtgctgctcgaagtcaagcattcgggatcctgtaactctataagcgaggacaccgaggaggaagaggaagacgaggaccaggattatagcttccccatttcatctattctcgagtgg

SEQ ID NO: 250014 - DNA, 1032 bp, Artificial Sequence
  Description of Artificial Sequence: Synthetic coding sequence
atggtccgcgcccggcaccaacctggaggattgtgcctcttgctcctgctgctttgccagtttatggaggacagaagcgcacaggccgggaactgttggctgcgccaggctaagaacggtcgttgtcaggtactctacaagaccgagctttcgaaggaagagtgctgttctaccgggagactctcaaccagctggaccgaagaagatgtcaacgataacaccctgttcaaatggatgatctttaacggtggagcgcccaattgtatcccctgcaaagaaacttgcgaaaacgttgattgcggaccgggaaaaaagtgccggatgaacaagaagaataagccgcgctgcgtatgcgcacctgactgttcaaatatcacctggaagggaccggtgtgcgggctggacggaaaaacttacagaaacgaatgtgctctgctgaaagcgcggtgcaaggagcagcctgaactcgaagtgcagtaccaaggcaggtgcaaaaagacttgccgcgacgtgttctgcccgggctccagcacttgtgttgtggatcagacgaacaatgcttactgcgtgacttgcaaccgcatctgcccggagccagcctcatccgagcaatacctgtgcgggaatgatggagtgacctatagttccgcctgtcatctgagaaaggccacgtgtctcttgggccggtcgattggactggcatacgaaggcaagtgtatcaaggcaaaatcctgtgaggacatccagtgtactggaggaaagaagtgcttgtgggatttcaaggtcggcagaggtcggtgctcactctgcgatgagctgtgcccggactcgaaatctgacgaaccagtgtgcgcgagtgacaacgcgacctacgcgtcggaatgcgctatgaaggaagccgcctgctcgtcgggagtgcttttggaagtgaaacactccggtagctgcaattcgatttccgaggacactgaagaggaggaagaagatgaggaccaagactacagcttcccaatcagctcgatactggagtgg

SEQ ID NO: 250015 - DNA, 1032 bp, Artificial Sequence
  Description of Artificial Sequence: Synthetic coding sequence
atggttcgcgctcgacaccagccggggggactgtgcttgctactgctgttactgtgccagtttatggaggaccggtctgctcaggcaggcaactgctggctgagacaggccaagaatggccgttgccaggtgctttacaagactgagctgagtaaggaagagtgttgttcaactggccggctctctaccagctggactgaagaagacgtcaacgacaacacgctgttcaaatggatgatttttaatgggggagctcctaattgtatcccatgtaaggaaacctgtgagaatgtggattgtgggcccgggaagaagtgccgcatgaataagaagaataagccacgctgtgtttgcgcccctgactgttctaatatcacctggaaaggaccagtgtgcggacttgacgggaaaacgtatcggaatgagtgtgcccttctgaaggctcgatgtaaagagcaacccgagctagaggtgcagtatcaaggccggtgcaagaagacatgccgcgatgtgttttgcccaggtagttctacctgcgtggtcgaccagacgaataacgcttattgcgtaacatgtaataggatatgtccagagcctgcctcgtcagaacaatacctgtgcggaaacgacggagtgacatactctagcgcatgccatctacgcaaagcaacctgtctcctgggtcgaagcattggactcgcttacgaaggcaaatgcattaaagccaagagctgcgaggatatccaatgcactggagggaagaagtgcctctgggacttcaaagtcgggcgaggacgctgcagtttatgcgatgagctgtgcccggattccaagtccgacgagcccgtgtgcgcctccgacaatgcaacatacgcgagtgaatgtgccatgaaagaggctgcttgctccagcggcgtactactcgaggtgaaacatagcggctcttgtaactcaatctccgaggatacagaagaagaggaagaagacgaggaccaagactactcatttcccataagttcaatccttgagtgg

SEQ ID NO: 250016 - DNA, 1032 bp, Artificial Sequence
  Description of Artificial Sequence: Synthetic coding sequence
atggtcagggccaggcaccaacccggcggtttgtgcctcctgttgttgctcctttgccagttcatggaggatcgttcagcacaggctggaaactgctggcttaggcaggcaaagaacggtcgctgccaggttctgtacaagacagaactgtcaaaggaagaatgttgttccaccggccgtctgtccacttcctggacagaggaagacgtcaatgataacaccttgttcaaatggatgatcttcaacggtggcgcaccaaactgcattccttgcaaggagacttgtgagaacgtggactgcggccccggaaagaagtgcagaatgaacaaaaagaacaagccacgctgcgtctgtgccccagattgttcaaatattacatggaagggaccagtctgtggacttgatggaaaaacttaccgcaacgagtgcgcactgctgaaggcccgttgcaaggagcagccagaactcgaggtgcaataccagggacgctgcaagaagacttgcagggacgtcttctgccccggttcttcaacatgcgtagtggatcaaaccaacaatgcctactgtgtcacctgtaaccgtatctgccccgagcccgcttcttctgagcagtacctgtgcggcaacgatggtgtgacatactcttccgcctgccaccttagaaaggccacctgcttgcttggcaggagcatcggcctcgcctacgaaggcaagtgcattaaggccaagtcttgtgaggatatccagtgcactggaggcaagaagtgtctgtgggacttcaaagtaggcaggggacgctgctccctctgcgacgaactttgtcccgattctaaatctgacgagcccgtgtgtgctagcgataatgcaacttacgcatctgagtgcgccatgaaagaagccgcttgctcatcaggtgtccttctggaggtgaagcacagcggatcttgtaactccatctcagaggataccgaggaggaggaagaggacgaagatcaggactattccttcccaatctccagcatcctggagtgg

SEQ ID NO: 250017 - DNA, 1032 bp, Artificial Sequence
  Description of Artificial Sequence: Synthetic coding sequence
atggtccgagcgcggcatcaaccgggcggcttgtgccttctcctcctgctgctgtgtcagtttatggaagataggtcggctcaagcaggaaactgctggctcagacaagccaaaaatgggcggtgtcaagttctgtacaaaacggaactcagcaaagaagaatgttgtagcaccgggcgcctgtcaacttcctggaccgaggaggatgtgaatgataatactcttttcaaatggatgatctttaatggcggtgccccaaactgtatcccatgtaaggaaacctgtgaaaacgtggattgcggaccgggcaagaagtgtcgaatgaacaagaagaataagccacgttgcgtgtgtgcgcctgactgttcgaatatcacgtggaagggccctgtctgcggacttgatggaaagacttaccgtaacgaatgcgcactgttgaaggcacgttgcaaagagcagcctgaacttgaagtccagtaccagggtcggtgcaaaaagacctgtcgtgatgtcttttgtccaggatctagtacttgtgtcgtggaccaaaccaacaacgcctactgtgtgacctgcaacagaatctgtcctgagcccgcatcgtcggaacagtacctttgtggaaacgacggcgttacgtactcatcggcgtgccacttgcggaaggcgacttgccttctcggacgaagcataggactcgcttacgagggaaagtgtattaaggccaagtcatgcgaagatattcaatgcactggaggcaagaaatgcctgtgggactttaaggtgggccgtgggagatgttctttgtgtgacgaactgtgcccagacagcaagtcagatgagcctgtttgcgcaagcgataacgcaacctatgcatcagagtgtgcaatgaaagaagcagcatgctcgagcggagtgctgcttgaagtgaagcattcaggttcctgtaactcgatctccgaagataccgaagaagaggaggaagatgaagatcaggactactccttccccatttccagcattttggagtgg

SEQ ID NO: 250018 - DNA, 1032 bp, Artificial Sequence
  Description of Artificial Sequence: Synthetic coding sequence
atggtgcgggcacgccaccaaccgggcggactctgccttctcctgctgcttttgtgccaattcatggaggacaggagcgcccaggccggcaactgttggctgcgccaggctaaaaacggacgctgccaggtcctgtacaaaaccgaactttcgaaagaagagtgttgctcaactggacggctgtcaaccagctggactgaggaggatgtcaatgacaacactctgttcaaatggatgatcttcaacggtggcgcgccaaattgcatcccgtgtaaagaaacctgcgaaaacgtcgactgcggaccagggaaaaagtgccggatgaacaaaaagaacaagccgcgctgcgtctgcgcgccggattgtagcaacatcacttggaagggaccagtgtgtgggctggatggaaagacctatcggaacgagtgtgcgcttctgaaggcacggtgcaaggagcagccggagcttgaggtccaataccaaggccgctgcaaaaagacctgtcgtgacgtattttgcccgggatcgtccacttgtgttgtggaccagactaacaatgcgtattgtgtgacctgtaatagaatctgccctgaacctgcatcctcagagcaatacctttgcggtaacgatggagtgacctactcatcggcttgccatctgcgcaaggcaacctgcctcctgggacgctctatcgggttggcgtacgaaggcaaatgcatcaaggcgaagtcttgcgaagatatccaatgcactggtggaaagaagtgcctctgggatttcaaggtgggccgggggcgctgcagcctgtgcgacgaactgtgcccggattccaagagcgacgagcctgtgtgtgcgtctgacaacgccacttacgcatcggagtgtgccatgaaggaagcagcatgttcctccggagtcctcctggaagtgaagcactccggctcatgcaatagcatttccgaggatactgaagaagaagaggaggacgaggaccaggactactcgtttcccattagctcgatcctggagtgg

SEQ ID NO: 250019 - DNA, 1032 bp, Artificial Sequence
  Description of Artificial Sequence: Synthetic coding sequence
atggttcgcgctcggcatcaacctggtggactctgtttgctgctccttctgttgtgtcagtttatggaggatcgctcggcacaagcagggaattgctggctcagacaggcaaagaacggacgctgtcaggtcctctataagactgaactgtcaaaggaagagtgttgttcgaccggcagattgtcaactagctggaccgaggaggacgtgaatgataacaccttgttcaagtggatgatcttcaacggaggggccccaaactgtataccatgcaaggaaacttgcgaaaacgtcgattgtggcccaggcaagaagtgtcgtatgaataagaaaaacaaaccccgctgtgtctgcgcccctgattgttctaacattacgtggaaaggtcccgtgtgcggtctggacggtaagacgtatcggaacgaatgtgcacttctgaaagctcgatgtaaagaacaaccagagttggaagtgcagtaccaaggacgatgtaagaaaacttgcagagatgttttttgtcctggttcgtcgacctgtgtggtggatcaaaccaacaacgcgtactgcgtcacgtgcaatcgtatctgtcccgaacctgccagctcggaacaatatctgtgtggtaatgacggagtcacttacagctccgcgtgtcacctcaggaaagcaacctgcctgcttggtaggtctattggactcgcatacgaaggaaaatgcattaaggcgaagtcgtgtgaggatattcagtgtacgggtggaaagaagtgcctttgggactttaaggtgggacgaggaagatgttcactttgtgacgaactgtgtccagacagcaagtcggatgaacctgtctgtgcctctgacaacgcaacttatgcttccgagtgcgccatgaaggaagcagcatgctcgtcaggtgtgcttcttgaagtgaagcattccgggtcgtgcaatagcatctcggaagatactgaagaagaggaggaggacgaagatcaagattacagctttccgatctcctcgattctggagtgg

SEQ ID NO: 250020 - DNA, 1032 bp, Artificial Sequence
  Description of Artificial Sequence: Synthetic coding sequence
atggtgagagcgaggcaccagcctggcggactgtgcttgttgctgcttctactgtgtcagtttatggaggatcgcagcgctcaagcaggcaactgctggttacgccaggccaagaatggacgctgccaagtgctgtataagaccgaactgagcaaggaggaatgctgcagtactggccggctgtccacaagctggacagaggaggatgtcaacgataacaccctgttcaagtggatgatctttaatggcggggcccctaactgcatcccttgtaaggaaacgtgtgagaacgtcgattgcggacctgggaagaaatgtaggatgaacaagaagaacaaaccgagatgtgtgtgcgcacctgactgttctaacattacttggaaaggacccgtgtgcggcctggacgggaagacttaccggaacgagtgcgctcttttgaaggcgcgatgtaaggagcagcccgagctggaggtgcagtaccagggcaggtgcaaaaagacatgtagggacgtcttttgtcccgggagttctacgtgtgtagtagaccagacgaataacgcctattgtgtgacttgtaacaggatctgccccgagccagcctcatctgagcagtatctgtgcggaaatgacggggttacatattcgtcggcttgccaccttcgcaaggctacttgcctgctaggcagatctatcggcctggcctacgaaggtaaatgtataaaggccaagagttgtgaagacatacagtgcacagggggcaagaagtgtctatgggattttaaagtgggacgcggacggtgtagcctgtgtgacgagctgtgcccagacagtaagtcagacgagcctgtctgtgctagcgacaatgctacctacgcttcggagtgcgcaatgaaagaggcggcctgttcctccggagtccttctcgaggtgaaacactccgggtcttgtaatagcatttccgaggacactgaggaagaagaagaagacgaggatcaggattactcgtttcctatttcttctattctggagtgg

SEQ ID NO: 250021 - DNA, 1032 bp, Artificial Sequence
  Description of Artificial Sequence: Synthetic coding sequence
atggtgcgagccagacaccagccaggagggctttgcttgcttcttttgctactgtgtcagtttatggaggatagaagcgctcaagctggaaactgttggcttagacaggcaaagaacggcaggtgtcaggtgctctataagactgaactgagcaaggaggagtgctgttctaccgggagactctccacaagctggactgaggaggacgtgaacgacaataccctctttaaatggatgatctttaacggaggcgctcctaattgcataccatgcaaagaaacttgcgagaacgttgattgtggaccggggaaaaaatgccgtatgaataagaagaacaaacccagatgcgtctgtgcacccgactgctctaacataacttggaaaggtcctgtatgtgggcttgacggtaagacatacaggaacgaatgcgcacttctgaaagcgcgatgtaaggaacaaccagagctggaggtccagtaccagggtcggtgcaaaaagacctgcagagacgtgttttgtccaggtagcagtacctgtgtggtggaccagacaaataatgcatactgcgttacctgcaatcggatctgcccagagcctgcttcttctgaacagtacctctgcggcaacgatggagtgacctattcgtcagcttgtcacttgaggaaagccacttgcttgctcgggcgctcaatcggcctcgcgtatgagggcaagtgtattaaggctaaatcatgtgaggatattcagtgtacagggggaaagaagtgcttgtgggatttcaaggtgggcagaggcaggtgtagcctctgcgatgagctctgtcctgactcaaagtccgacgaacctgtttgcgccagtgataacgccacatatgcatctgagtgcgctatgaaagaagccgcttgctctagtggagtactcctggaagtgaaacatagcggaagttgtaacagcatctccgaagatacggaagaggaagaggaagacgaggaccaggattacagctttccaataagtagcatcctggagtgg

SEQ ID NO: 250022 - DNA, 1032 bp, Artificial Sequence
  Description of Artificial Sequence: Synthetic coding sequence
atggtcagggcccggcatcaacccgggggtctgtgcctcctgctgctgctcttgtgtcagttcatggaggaccgaagcgcccaagcagggaattgttggttgagacaggctaaaaacggaaggtgccaggtgctgtacaaaaccgaattgtcaaaagaggagtgctgctcaacggggcggctcagcactagttggacagaagaggacgtgaatgacaacaccctgttcaagtggatgatatttaatggaggagcgcctaattgtattccttgtaaggaaacatgcgaaaatgtggattgcggccctggcaagaagtgtcgtatgaataagaagaataagccgcgttgcgtgtgcgcccctgactgttcgaacatcacctggaaggggcctgtgtgtgggctggacggtaaaacttacagaaacgaatgtgccttactgaaggcacgctgtaaagagcagcccgaactcgaagtccagtaccagggccgctgtaaaaagacctgtagagacgtattctgcccagggagctctacctgcgtcgttgaccagacgaacaacgcttactgtgtgacctgcaatcggatctgtccagaacccgcatctagcgaacagtacttgtgcggtaacgacggcgtaacctacagttctgcttgtcatctgcgtaaagccacatgcctgctggggcggtccattggccttgcctatgagggcaagtgtattaaagcaaaatcctgtgaagacatccagtgtacaggcggcaagaagtgcctatgggatttcaaggtcggacgggggagatgcagcctatgcgatgagctatgccccgactctaagagcgacgagcctgtgtgtgcctccgacaatgctacctatgctagcgagtgcgccatgaaagaggccgcttgtagtagtggcgtgctacttgaagtgaaacacagtggctcgtgcaacagcatctccgaggataccgaagaggaggaggaggatgaagaccaggattatagttttccgattagtagtatcctcgagtgg

SEQ ID NO: 250023 - DNA, 1032 bp, Artificial Sequence
  Description of Artificial Sequence: Synthetic coding sequence
atggtccgagcgcgacaccagcccggcgggctgtgcctcctcctgcttctgctttgtcagtttatggaagaccgctcagcccaagctggcaattgttggctaagacaggctaagaatgggcggtgtcaggtcctctataagaccgaattgagcaaagaagaatgttgttccacgggcaggctgtcaacatcatggaccgaagaagatgtgaacgacaacaccctgttcaagtggatgatcttcaatggcggagcgcccaattgtataccgtgcaaggaaacctgcgaaaacgtagactgcggtcctggtaagaagtgccgtatgaacaagaagaataaaccgcgttgtgtctgtgcgcctgactgtagtaacatcacatggaaggggcctgtgtgcggtttagacgggaagacctacagaaatgagtgtgcccttctcaaggcccgatgtaaggagcagcccgagctcgaggtacagtaccagggcagatgtaagaagacgtgcagggatgttttctgccccggatcctccacctgcgtggtcgaccagacaaataacgcgtactgcgtgacatgtaatcgcatatgtcctgaaccagcatcctccgagcaatacctctgtggcaacgacggagtcacctactccagtgcttgccacctcaggaaggccacatgcctgctgggccgcagtatcgggctcgcctacgaagggaaatgcatcaaggccaaatcatgtgaggacatccagtgtaccggcggcaagaagtgtctgtgggacttcaaggtgggccggggacgatgcagtctgtgcgacgagctctgtccggactcgaaatctgacgaacccgtttgtgcttcagacaatgctacctatgctagtgaatgcgccatgaaggaagctgcctgcagtagtggggtcctcctggaggtgaagcactcaggaagttgcaactccatttctgaagataccgaagaagaagaggaggacgaagatcaggactactcttttccgatatcttctatactggagtgg

SEQ ID NO: 250024 - DNA, 1032 bp, Artificial Sequence
  Description of Artificial Sequence: Synthetic coding sequence
atggtgagagcgcgacatcagcccgggggactctgcctactgttacttctcctttgccagtttatggaggatcgttctgcccaggccggaaactgttggcttcgacaggccaagaacgggcgctgtcaggtgttatataaaactgaactatccaaggaggaatgttgttccaccggccggctaagcacaagctggactgaggaagatgtcaacgacaatacgctgtttaagtggatgattttcaacggaggagctccgaactgtattccgtgtaaagagacctgtgagaatgtggactgcggccccggaaaaaaatgcaggatgaacaagaagaacaaaccgagatgtgtgtgcgccccagactgttccaacatcacttggaagggaccagtctgcggcctagatggtaaaacctacagaaacgaatgcgccctcctaaaggccaggtgtaaggaacaaccagaactagaggttcagtaccaaggtaggtgcaagaaaacctgccgggatgtgttctgccccgggagtagtacatgtgttgtggatcaaactaataacgcctattgcgtaacctgcaaccgtatttgtcctgaacccgccagctctgagcagtatttatgcggtaatgacggcgtgacatacagcagcgcttgtcatcttcgcaaagcaacctgcctgctgggccgatcaatcgggctagcctacgaaggcaagtgcataaaggcaaagtcttgcgaggacattcagtgtacagggggtaaaaagtgtctgtgggacttcaaagtcggtcgcggccggtgttccctttgcgatgaattatgtcctgacagtaaatccgacgaacccgtgtgcgccagcgacaatgcaacatatgcatccgaatgtgctatgaaagaggctgcatgtagctccggcgttctcctggaagttaaacactctggttcttgtaattcgataagcgaggacacagaggaagaagaggaagacgaagatcaggattatagttttcccatatctagcatcctggagtgg

SEQ ID NO: 250025 - DNA, 1032 bp, Artificial Sequence
  Description of Artificial Sequence: Synthetic coding sequence
atggtgagggcccgtcatcaacctggcggcctgtgcttactactcctccttttgtgtcagttcatggaggataggtcagcccaggccgggaactgctggttgagacaggccaagaatgggagatgccaggtgctctacaaaaccgagctgtcgaaggaagagtgttgcagcaccggacggctgagtacttcttggacagaggaggatgttaatgataatacgttgtttaagtggatgatctttaatgggggcgcccccaactgcataccatgtaaggaaacatgtgagaatgtggattgtggccccggcaagaaatgccgcatgaacaagaagaataagccgagatgtgtgtgcgccccggactgtagtaacatcacatggaagggccccgtttgtgggctagacggcaaaacttatcggaatgagtgcgccctgctgaaggcccgttgtaaagagcagcctgagcttgaagtgcagtaccagggccgctgcaagaagacatgtcgagacgtgttctgccccggaagcagtacttgcgtggttgatcagaccaataatgcgtactgtgtcacctgtaaccgtatctgtcctgaaccagctagttctgaacagtatctgtgtggtaacgacggcgtcacatattcctctgcttgccatctgaggaaggctacttgtcttcttgggcgttccatcggactcgcctacgagggcaaatgcataaaagccaaatcctgcgaggatatccaatgcaccggtggaaagaaatgcctgtgggactttaaggtgggtaggggcagatgttctctatgcgacgaactctgtcccgactctaaatctgatgagccggtgtgcgctagtgataacgccacgtatgcctctgagtgtgccatgaaagaggccgcctgttcatctggcgtgctcctagaggtaaagcattccggtagctgtaattcaatctcagaagacacagaagaggaagaggaggacgaagatcaagattatagcttccccatctcttcaatcctcgaatgg

SEQ ID NO: 250026 - DNA, 1032 bp, Artificial Sequence
  Description of Artificial Sequence: Synthetic coding sequence
atggttcgagcacgccaccaaccgggtggactgtgtctcctcctgctgctgctttgtcagttcatggaggatcgttcggctcaggcgggaaattgttggcttcgtcaggccaagaatggacgctgccaggtcttatacaaaaccgagctctctaaggaggagtgttgcagtaccggcagactgtcaacttcctggactgaggaagatgtaaatgataatactcttttcaagtggatgatcttcaatggtggcgcaccgaattgtattccatgtaaggagacgtgcgaaaacgtggactgcggccctggcaaaaaatgcagaatgaataagaagaataaaccgagatgcgtgtgtgccccagattgcagtaacattacctggaaaggccctgtttgtggactggacggcaagacctaccgtaacgagtgcgcgttgctaaaggcacggtgcaaggaacagcccgaactagaggtacagtaccagggacgctgtaagaagacttgccgtgacgtgttctgtcccggatcttcgacatgcgtcgtcgaccagactaacaacgcatactgcgttacttgcaaccgtatctgcccagaaccagcatcctcagaacagtatctgtgcggaaatgatggtgtcacatactcgtcagcgtgtcacctccgcaaggcgacatgtttgcttggcaggtctattggactcgcgtatgaaggtaaatgtatcaaggcaaaaagctgtgaggatattcaatgtaccggtggtaaaaagtgtctttgggatttcaaggtcggccgaggacggtgctctctctgtgacgaactgtgccctgattcaaaatccgatgaacccgtatgcgcctcagacaacgccacatatgctagcgagtgcgcaatgaaggaagcagcctgctcttccggtgttcttcttgaagtcaagcactcaggttcgtgtaacagtatctcagaagatactgaagaggaggaagaggatgaggatcaagactattcattcccaatctcctcgatcctcgagtgg

SEQ ID NO: 250027 - DNA, 1032 bp, Artificial Sequence
  Description of Artificial Sequence: Synthetic coding sequence
atggtccgtgcaagacaccagccaggaggcctgtgcctcttgctgctgctgttgtgtcagtttatggaggatcggagtgcccaggcagggaattgttggctacgtcaggctaaaaacggaagatgccaagtgctgtacaaaaccgagctgtcgaaggaagaatgctgcagcaccgggaggcttagtacgtcatggacagaggaggacgtgaatgataacacattgtttaagtggatgatctttaatgggggcgctcctaattgtattccatgcaaagagacgtgcgagaatgtggattgcggtcccgggaaaaaatgccggatgaataaaaaaaacaagccacggtgcgtctgtgctcctgattgttccaatattacctggaagggaccagtctgcggactagatggcaaaacctacaggaatgagtgcgccttactcaaggcacgatgtaaggagcagccagaactggaagtgcagtaccaagggaggtgcaagaaaacatgccgagatgtcttctgtccaggttccagcacctgcgtggtcgaccagacaaacaatgcatattgtgtgacatgtaataggatctgccccgaacccgccagttccgaacagtacctgtgcgggaatgacggcgtgacttacagctcagcctgccacttaagaaaggcaacctgtctattgggccgctctatcggccttgcctacgaaggcaagtgcataaaagcgaaatcttgtgaggatatccagtgcacgggcggaaagaaatgcctgtgggatttcaaagtgggaagaggaagatgttcgctatgtgacgaactctgtcccgactccaagtctgacgaacccgtgtgtgccagcgacaacgccacctatgcttccgagtgcgctatgaaagaagcggcctgtagcagcggcgtgctccttgaagtgaagcactcagggtcatgtaattccatttcagaagataccgaggaggaagaggaggatgaggatcaggactacagcttccctatttcgagcattctggagtgg

SEQ ID NO: 250028 - DNA, 1032 bp, Artificial Sequence
  Description of Artificial Sequence: Synthetic coding sequence
atggtgcgggcgcggcaccaacccggcggcctttgcctgctcttactactgctctgccaatttatggaggaccgcagcgcgcaagctgggaactgctggttgaggcaggctaagaatggcaggtgccaagtactgtataaaacagagttgtccaaagaagaatgttgcagtacagggaggctgtccacctcctggacagaggaagacgtgaacgataacactctgtttaagtggatgatctttaacggcggggccccgaactgcattccatgtaaggagacctgcgagaatgtggactgcggcccaggtaaaaaatgccggatgaacaagaagaacaagcctcggtgtgtatgcgctcccgactgcagcaacatcacttggaagggccccgtgtgtgggttggacggcaagacctatcggaacgaatgcgcactactaaaagctaggtgcaaagagcaacctgaactagaggtgcaataccagggtcgctgcaagaaaacctgcagggacgttttctgtccgggatccagcacttgcgtggttgaccagaccaataatgcgtactgcgtcacttgcaaccgtatctgcccggaaccagcttcttcggaacagtatctgtgcggaaatgacggcgtcacttatagctctgcatgtcacctccgaaaggctacatgcctgcttgggaggtccataggactggcttatgaagggaagtgcatcaaggctaagtcctgcgaggacatccagtgtacaggcggaaagaaatgtttgtgggactttaaggtaggcagggggcggtgctctttatgcgatgaactttgtcctgattccaagtcagatgagcccgtgtgcgcctctgacaacgccacgtacgccagtgaatgcgccatgaaggaggcagcctgttccagcggtgtcctcctcgaagttaaacatagcgggtcatgtaattccatatctgaggatacagaagaggaggaggaggacgaagaccaagattactcgttcccaatctcctccattctggaatgg

SEQ ID NO: 250029 - DNA, 1032 bp, Artificial Sequence
  Description of Artificial Sequence: Synthetic coding sequence
atggtgagagcaaggcaccagccgggcggactgtgcctgctcctgttgcttctgtgccagttcatggaggaccgctccgcgcaggccggcaactgctggcttagacaggctaaaaacggcagatgccaagtgctgtataagaccgagctgtccaaagaagagtgttgcagtactggtcggctgagtacctcatggacagaggaagacgttaacgataacaccctgttcaagtggatgatttttaacggcggcgcacccaactgcatcccctgtaaggagacctgcgaaaatgtggattgtggtccagggaaaaaatgtagaatgaacaagaagaacaaacctagatgcgtttgcgctcccgattgctctaatataacatggaagggccctgtctgtggattagacggaaaaacttacaggaacgaatgcgccctcttgaaagcaagatgtaaggagcaacctgagctggaggtgcaataccagggccggtgtaagaagacttgccgagatgttttctgcccgggctcatcaacctgcgtagtggaccagaccaacaacgcttactgtgtcacctgcaacaggatttgccccgaacctgctagttcagagcaatacttgtgcggcaacgatggcgtgacctacagtagcgcctgtcatctgcggaaggccacatgccttctgggacgctccattggactcgcttacgaaggaaagtgcatcaaagccaaatcatgcgaggatatacagtgtacaggaggcaaaaagtgtctatgggactttaaggtggggagaggcagatgctccctgtgtgacgagctctgccctgattcgaaaagtgacgagcctgtctgtgctagcgacaatgccacttacgcatctgaatgtgctatgaaggaagctgcttgtagctccggggtgctgctggaagtgaagcatagcgggagttgtaattctatcagcgaagacactgaagaggaggaagaagacgaggaccaggactacagttttcccattagttccattcttgagtgg

SEQ ID NO: 250030 - DNA, 1032 bp, Artificial Sequence
  Description of Artificial Sequence: Synthetic coding sequence
atggtgagagcaaggcaccagccaggtggcctgtgccttttgctcctcctgctgtgtcagtttatggaagatagatcagctcaggcaggaaattgctggctgcgccaagccaagaatggtagatgtcaggtactgtacaaaactgaactgtcgaaagaagaatgctgttcaactggccgcctctccactagctggaccgaggaggacgtgaatgataacacgctgtttaagtggatgatattcaatggtggcgcccccaactgcattccctgtaaagaaacttgtgaaaatgtcgactgtggaccaggtaaaaagtgccgcatgaacaagaagaacaagcctcgttgcgtttgcgccccagactgctcaaacattacttggaagggccctgtctgcggtcttgatggaaagacctaccggaacgagtgcgccctcttgaaggcaaggtgcaaggaacaacctgaactggaagtgcaataccaaggcagatgtaaaaagacctgtagggacgtattttgtcccggatcctcgacctgcgtggtggaccaaaccaacaacgcttactgtgtcacctgtaatcgaatctgtccagagcctgcatcctcggaacagtacctctgcggaaacgatggtgtgacctactcgagtgcatgtcatcttagaaaagcaacttgtcttttggggcgctccatcggccttgcgtacgaaggaaagtgtattaaggcgaagagctgtgaggatatccaatgtaccggagggaagaagtgcttgtgggacttcaaggtgggacgggggcgttgcagtctgtgtgatgaactttgtccggactccaagagcgatgaacctgtctgtgcaagcgataacgccacgtatgcatctgaatgtgcgatgaaagaagcagcctgttcaagcggggtgctccttgaagtgaaacattccggatcctgtaactcaatttcagaagataccgaagaagaggaggaggatgaggaccaggattactcttttcctatatctagcattctcgagtgg

SEQ ID NO: 250031 - DNA, 1032 bp, Artificial Sequence
  Description of Artificial Sequence: Synthetic coding sequence
atggtccgcgcgaggcatcagcctggcggcttgtgcctgctgttacttctgctatgtcagttcatggaggaccgaagtgcccaagccggaaactgctggcttcgacaggctaagaacgggcgttgccaagttctgtacaagacagagttgagtaaggaggagtgttgttcaaccggacgtctgtctacctcttggactgaggaggacgtgaacgataatactctctttaaatggatgatcttcaacggtggagctcctaactgcataccgtgcaaagaaacttgcgagaacgtggattgtgggcccggcaaaaagtgccgcatgaataagaaaaataagccccgctgtgtatgtgcaccggactgttctaatatcacctggaaaggacctgtctgcggtctggacggaaaaacatatcgcaacgagtgcgctctgctgaaagcgcgctgcaaagagcagcccgagctcgaagtgcagtatcagggccgatgtaaaaagacttgtagagacgtgttttgtccaggaagttccacctgcgtcgttgaccaaacaaacaacgcctactgcgtgacatgcaaccggatctgtcccgagccagctagctccgaacagtacctttgcgggaatgatggagttacatactctagcgcctgtcaccttaggaaagcaacgtgcctgcttggacgctctatcggactcgcatatgaaggaaaatgcataaaggctaaatcttgtgaggacatccaatgtacaggaggaaaaaaatgcttgtgggacttcaaggttggcaggggaagatgtagcctttgcgacgaactatgtcctgactctaaatccgacgaacccgtttgcgctagtgataacgcaacttatgcttcagaatgcgcaatgaaggaagctgcgtgctcttcaggagtcctcctagaggtgaagcattccggcagctgtaactccattagcgaagatacggaagaagaagaggaggacgaagatcaagattatagctttcccatctcaagcattctggagtgg

SEQ ID NO: 250032 - DNA, 1032 bp, Artificial Sequence
  Description of Artificial Sequence: Synthetic coding sequence
atggtgagagcacggcaccagccaggtggactgtgtctgctcctgctgctcctgtgccagttcatggaggaccgctcggcccaggctggaaactgctggctgcgacaggccaagaacggacgctgccaagtgctgtacaaaactgaactgtccaaagaagaatgctgtagcaccggacggctgtcgacttcctggactgaagaggacgtcaacgataatactctgtttaagtggatgatcttcaacggtggagcgccgaattgcatcccgtgcaaagagacttgcgaaaacgtggactgcggaccgggcaagaagtgccggatgaacaaaaagaataagccgcgctgcgtgtgcgccccagactgctctaacatcacgtggaagggtccggtgtgcggactcgatggcaagacctaccggaacgaatgcgcgctcttgaaggcacggtgtaaagagcaaccggagctcgaggtgcagtaccagggtcgctgtaagaaaacttgccgcgatgtgttctgcccaggaagcagcacctgcgtcgtggatcaaaccaacaacgcctactgcgtcacctgcaaccgcatatgcccggagccggccagctccgaacagtacttgtgcgggaatgatggagtgacttactcatccgcatgccatctgcgaaaggcaacttgcctgctcgggaggtcgatcggcctggcctacgaaggaaagtgtatcaaggcgaagagctgcgaggacatccaatgcacggggggaaagaagtgcctctgggatttcaaagtgggacgcggacgctgctcactgtgcgatgaactctgcccagatagcaagtccgacgagcccgtctgtgcctccgataatgctacttacgcctcggaatgtgccatgaaggaggcggcatgctcatcgggagtgcttctggaggttaagcattcgggatcttgcaactcaatctcagaagataccgaggaggaagaggaggatgaagatcaggactacagctttcccatttcttcaatcctggagtgg

SEQ ID NO: 250033 - DNA, 1032 bp, Artificial Sequence
  Description of Artificial Sequence: Synthetic coding sequence
atggtcagagccaggcatcaacctggcggattgtgcttgctgctgctgctcctctgtcagttcatggaggacaggagcgcacaggccggaaactgctggctgcgccaagctaagaatggaagatgccaggttctctacaagaccgagttgagtaaggaggaatgctgttccactggcaggcttagcacttcctggactgaggaagatgtaaacgacaacaccctttttaagtggatgatctttaatggtggagcgcctaattgcatcccttgcaaggagacgtgcgagaacgtggactgtggtcccggcaaaaagtgtaggatgaataagaaaaacaaacccagatgtgtgtgcgctcctgattgtagcaatattacttggaagggaccagtgtgtggcttggacggtaagacctaccgcaacgagtgcgccttgttgaaggcccgctgcaaagaacaaccggagctggaggttcaatatcagggtcgctgcaaaaagacctgcagagacgtgttctgccccggttctagcacgtgtgtagtggaccaaacaaacaacgcttactgcgtgacctgcaatcgcatctgccctgaacctgcgagttctgaacaatacctgtgcggaaatgacggagtaacttattcctccgcatgtcatctgcgcaaggctacgtgcctcttgggtaggtctattggtctggcctacgaaggcaagtgcatcaaagccaaaagttgcgaagacatccagtgtaccggtggtaagaagtgcctgtgggacttcaaagtgggtagaggaagatgcagcctctgcgacgaattgtgtccagacagcaaaagtgacgagcctgtttgtgcatccgacaatgccacgtacgcatctgaatgcgctatgaaagaagccgcctgtagctccggcgtcttgcttgaagtgaagcatagcggcagctgtaatagtatctctgaagacacagaggaggaagaggaggacgaggaccaagactacagtttccccattagcagtatcctggagtgg

SEQ ID NO: 250034 - DNA, 1032 bp, Artificial Sequence
  Description of Artificial Sequence: Synthetic coding sequence
atggtgcgggcccggcatcagcccggcggtctgtgcctcctgctgctgctcctctgccagttcatggaagataggtccgcgcaggccggcaactgctggctgcgccaggccaagaacgggcgctgtcaagtgctgtacaagactgaactgagtaaggaggaatgctgctcaaccgggcgactgtcaaccagctggacggaggaggacgtcaacgataacaccttgttcaaatggatgatcttcaacggcggagcgcctaattgtattccctgtaaggaaacctgcgaaaatgtcgactgcggtccgggcaagaaatgcagaatgaataagaaaaacaagccgaggtgcgtctgtgcaccagactgctcgaacatcacctggaagggaccagtgtgcggattggatgggaaaacttacagaaatgagtgtgcgcttctgaaagcacgctgtaaggagcaaccggaacttgaggtgcaataccagggacggtgcaaaaagacttgcagagatgtcttttgcccgggatcctcaacttgtgtggtggaccagactaataatgcctactgcgtgacctgcaaccgcatttgtccggagccagcttcatctgaacagtatctgtgcggaaacgacggtgtcacttactcctccgcatgccacctccggaaagctacgtgcttgctcgggcgctcgatcggactcgcgtacgaaggaaagtgcatcaaggccaagagctgcgaggatatccagtgtaccggaggaaagaagtgcctgtgggacttcaaggtgggacggggccgctgctcgctctgcgacgagctgtgccctgactcgaagagcgacgaaccggtgtgtgcgtcagacaacgctacctacgcctcggaatgtgccatgaaggaagcagcctgctccagcggcgttcttctggaggtgaaacacagcggatcctgcaactccatctcggaggatactgaagaagaggaagaagatgaagatcaagactactcgtttcctatcagctcgatcctggagtgg

SEQ ID NO: 250035 - DNA, 1032 bp, Artificial Sequence
  Description of Artificial Sequence: Synthetic coding sequence
atggtaagagcacgacaccagcccggaggattgtgcctgctactgctgctgctgtgccagtttatggaggaccgatccgctcaggcggggaactgctggcttcggcaggccaagaacggtcggtgtcaagttctctacaaaaccgaactttcaaaggaggaatgctgcagcaccggacgcctatccacctcctggaccgaagaggatgtcaatgacaacaccctttttaagtggatgatcttcaacggcggtgcccccaactgcattccatgtaaagagacttgcgagaatgtcgattgcggacctggcaaaaagtgccgtatgaacaagaagaacaaacctcggtgcgtgtgtgctccagattgttctaatatcacctggaagggccctgtgtgcgggttggatgggaagacatatcgtaatgaatgtgctctgcttaaggcacggtgcaaggaacagccagaactggaagtccagtaccaggggagatgtaagaagacatgtcgggatgtgttttgccccggctcctcgacttgtgttgtggaccagaccaataacgcctactgcgtgacctgtaatagaatctgccccgaacccgcatctagcgaacagtatctctgtgggaacgacggcgtgacctattcttccgcatgtcaccttcgaaaggccacctgccttttaggcagaagtatcggtctggcgtacgaagggaaatgtattaaggccaagagctgtgaagatattcagtgtacaggcggaaagaaatgcctgtgggattttaaggtgggcagggggcgctgttcactttgtgatgagctgtgccccgattcaaaaagcgacgaaccggtatgtgctagcgataacgctacgtatgccagcgaatgcgccatgaaggaggcagcttgttcctccggagtgctgctggaggtgaagcatagcggatcctgtaattccatctcggaagatacagaggaggaggaggaggatgaagaccaggactattctttccccatctcctccattctcgagtgg

SEQ ID NO: 250036 - DNA, 1032 bp, Artificial Sequence
  Description of Artificial Sequence: Synthetic coding sequence
atggtgcgtgccaggcatcaacctggaggtttgtgcttgttgctcctcctcctgtgccagttcatggaggaccgttcagctcaggctggtaactgctggctccgccaggcaaagaacggcagatgccaagttctttacaagacagagttgagtaaagaagagtgttgtagcactggtcgtttgtctacaagctggactgaagaggacgttaatgataatacattgttcaaatggatgatcttcaacggaggcgcacccaattgtatcccttgcaaagagacctgtgaaaacgtggactgcggccctggaaagaaatgccgtatgaataaaaaaaataaacccaggtgcgtgtgtgctcccgactgtagcaacatcacctggaagggccccgtgtgcggattggatggaaaaacatatcgtaatgagtgcgcattgctcaaggctcgttgtaaggaacagcctgagttggaggtgcagtatcaaggcagatgtaaaaagacatgcagagacgtcttctgtcccggttcttcaacctgcgtagtcgaccagactaacaatgcatactgcgtgacttgcaaccgtatttgccctgaaccagccagctccgagcaatatttgtgtggtaatgatggcgtaacatactcctctgcttgccatttgaggaaggctacatgtctgctgggtagatccatcggcctggcttacgagggaaaatgtatcaaggcaaagtcctgcgaggatatccagtgtaccggtggaaagaagtgtctttgggactttaaagtgggaaggggaagatgctcattgtgcgacgaactctgtccagattctaaatcagacgagcccgtttgtgctagcgacaacgctacatacgcctcagagtgtgccatgaaagaggctgcctgctcttctggagtgctgctggaggtcaagcatagtggcagttgcaactccatttcagaagatacagaggaggaagaggaggatgaggaccaggactacagcttccctatctccagtatcctggagtgg

SEQ ID NO: 250037 - DNA, 1032 bp, Artificial Sequence
  Description of Artificial Sequence: Synthetic coding sequence
atggtccgcgcccgccatcagcccggaggactgtgtctgcttctcctgctgctgtgccagttcatggaagataggtccgcccaggccgggaactgttggttgcgacaagctaagaatgggaggtgccaagtgctgtataaaacggagctcagcaaagaagaatgttgctctaccgggcgcctgagcacaagctggactgaggaagatgtcaatgataataccctgtttaagtggatgattttcaacgggggggcacccaactgtataccctgcaaagagacttgtgaaaatgtggactgtggcccgggtaaaaaatgtagaatgaacaagaagaacaaaccaagatgcgtctgtgccccagactgtagcaatatcacttggaaaggtcccgtttgcggactcgacggcaagacgtacagaaatgagtgcgcccttctgaaagctaggtgcaaggagcagccagagctagaggtccaatatcagggaaggtgcaaaaagacttgtcgggatgtattctgccctggctccagcacgtgcgtggtcgaccagactaataacgcatactgcgtaacctgcaaccgaatctgcccggagccagcatcttcagaacaatacctgtgcggcaatgacggagtgacctactcctccgcctgccatctccgcaaggcaacgtgcctgcttggaagatccataggcctcgcgtacgagggcaagtgcattaaagctaagagctgtgaagacatacagtgtacggggggcaaaaagtgcctatgggatttcaaggtgggcaggggaagatgttccctctgtgatgagctgtgcccggatagtaagagtgacgagccagtctgcgcgtccgataacgccacctacgcatccgagtgtgcgatgaaagaggcagcttgctcttctggcgtcctgctcgaggtgaagcattcaggttcctgcaactccatctccgaggatactgaagaagaggaggaagacgaggaccaagactactcttttcctatttcaagcattctggagtgg

SEQ ID NO: 250038 - DNA, 1032 bp, Artificial Sequence
  Description of Artificial Sequence: Synthetic coding sequence
atggtccgggctcgacaccagccgggggggctgtgtctactcctgctgctcctgtgtcagttcatggaggaccgatccgcacaagccgggaactgctggctgcgacaggccaaaaacgggcgatgtcaggtgctgtataaaaccgagctgagcaaggaggagtgctgttctaccgggcggcttagtaccagctggacagaagaggatgtaaacgataatactctgttcaagtggatgatctttaacgggggagccccaaattgtataccctgcaaagaaacctgtgagaacgtcgactgcgggccaggtaagaaatgtaggatgaacaagaaaaataaacctaggtgcgtctgtgctcctgattgtagcaatattacatggaagggccctgtgtgcggcctggacggcaagacgtacaggaacgagtgcgctctcttaaaggcccgatgtaaggagcagcccgagcttgaagtgcaataccagggaagatgtaagaagacttgccgcgacgtcttctgtccagggtcatccacgtgtgtggtagatcaaacaaacaacgcctattgcgtgacctgcaatcggatctgccctgagccagcaagttcagagcagtatctgtgcggaaacgatggtgtgacctacagttccgcttgccacctgaggaaggccacctgcctgttgggacggagcatcggactggcctacgaaggaaagtgcattaaggctaagtcctgcgaagatattcagtgtaccggaggcaagaaatgcctctgggactttaaagtcggccgtggaagatgtagcctgtgcgatgagttatgtcctgatagtaagtccgatgagcctgtctgtgcctccgacaacgctacttacgcatctgagtgtgctatgaaagaggctgcctgctctagtggcgtgctgctggaggtcaagcacagtggatcctgtaatagtatctctgaagacacggaggaggaggaggaggatgaagatcaagattactcgtttccgatctcctccattctagaatgg

SEQ ID NO: 250039 - DNA, 1032 bp, Artificial Sequence
  Description of Artificial Sequence: Synthetic coding sequence
atggtcagggctcgccaccagccgggcggactgtgtctcctgttactgctgctctgccaatttatggaggaccgttctgctcaagcaggaaactgttggctgcgtcaagcaaaaaacggacgctgtcaggtactgtataaaacagagctctctaaagaagagtgctgttcaaccggacgcttgagcacttcctggacagaggaggacgtcaatgacaacacactattcaaatggatgatctttaatggaggggcccctaattgtatcccctgtaaagaaacgtgtgagaacgtggactgcggtccaggcaaaaaatgtagaatgaacaagaagaacaagcccagatgcgtgtgcgcccctgattgcagcaacattacgtggaagggccccgtgtgtggactcgacggtaagacctatagaaatgagtgcgccctgctaaaagcccgctgcaaggaacagcccgaactagaggttcagtaccaggggagatgcaagaagacgtgtcgcgatgtgttttgcccaggatcatctacctgcgtagtggaccagactaacaacgcctattgcgttacatgtaacagaatttgccccgagcctgcatccagcgaacagtacttgtgtggaaacgatggcgtgacctattcctccgcctgtcatcttcgaaaggccacatgcctgctggggcggagtattggcctcgcatacgagggaaaatgtataaaagccaagtcctgtgaggatatccagtgcactggcggcaagaaatgcctctgggattttaaagtcggccggggaaggtgtagcttgtgcgacgaactgtgcccggactccaagtcagacgagcccgtctgcgccagcgacaacgcaacatacgccagtgagtgcgctatgaaggaggctgcgtgcagcagcggggtgttactggaagtcaagcactcggggagctgcaactcgattagtgaggatacagaggaagaggaggaagacgaggatcaggactattcttttccaatttcctctatcttagagtgg

SEQ ID NO: 250040 - DNA, 1032 bp, Artificial Sequence
  Description of Artificial Sequence: Synthetic coding sequence
atggtgcgagctaggcaccagcccggtggcctgtgtttgcttctgctactgctgtgccagtttatggaggaccggtctgcacaggctgggaactgctggctcaggcaggctaagaacggacggtgtcaggtgctgtacaagacagagctgtccaaagaagagtgctgtagcaccggacggctgagcactagttggacagaagaggacgtgaacgacaatacactgttcaagtggatgatcttcaacgggggagctccaaattgtatcccatgtaaggagacatgtgagaatgtcgactgcggccctggcaaaaaatgcagaatgaataagaaaaataagcccagatgcgtttgtgctcccgactgtagcaatattacatggaagggtcccgtctgtggcctggacggcaaaacatacagaaatgaatgtgctcttttgaaggcacgctgcaaagagcagccggagctcgaggtgcagtatcaaggccgctgtaagaaaacttgtagagatgtattttgccctggttcaagcacttgtgtggtggatcagaccaacaacgcttattgtgtcacttgcaataggatttgccccgagccagcctccagcgaacagtatctgtgtgggaacgatggagtcacatatagttccgcgtgccacctgcgcaaggccacctgtttgcttggccgaagtatcgggctggcctatgaaggcaaatgcataaaggccaaaagttgcgaagacattcaatgtacaggcggcaaaaagtgtctgtgggatttcaaggtggggcgcggacggtgtagcctgtgtgacgaactgtgccccgattccaaatcagacgaacctgtgtgtgcatccgacaatgcgacatacgcttcagaatgcgctatgaaagaagccgcctgctctagtggggtgctgctggaggtcaagcactctggtagttgcaacagcattagtgaggataccgaagaggaggaagaggacgaagaccaagattatagcttccctatcagcagtattctggaatgg

SEQ ID NO: 250041 - DNA, 1032 bp, Artificial Sequence
  Description of Artificial Sequence: Synthetic coding sequence
atggtgagagcaaggcatcaacccggtggactctgtctgcttctcctccttctctgccaattcatggaagatcgtagtgcccaggcaggaaactgctggctgagacaagcgaaaaatggacggtgtcaggtgctctataagaccgagctgagcaaggaggaatgctgcagcacgggccgcctttcgacctcatggacggaagaagatgtgaatgacaacactttgttcaaatggatgatctttaatgggggtgcgcctaactgtattccttgtaaggaaacttgtgaaaacgtcgattgtgggcctggaaagaagtgtagaatgaataagaagaataagcctcgctgcgtgtgtgccccagattgctccaacattacgtggaaaggaccagtgtgtggcttggatggaaaaacctaccgcaatgagtgtgcccttttgaaggcgaggtgcaaggagcaacccgagcttgaggtccaataccagggacgctgcaagaaaacctgccgcgacgtcttttgtccgggaagctccacctgcgttgtggatcagactaacaacgcatactgcgtgacttgtaaccggatttgtccagaaccagcatcctccgaacagtacctttgtggaaacgatggtgtcacctactcaagcgcatgccatcttcgtaaggcaacctgtctgctcggaagatcgattgggctggcatacgagggtaagtgtataaaggcgaagagctgtgaagatatccaatgtaccggaggtaagaagtgtttgtgggactttaaagtgggtaggggacgctgttccctctgtgacgaattgtgtcctgactccaaaagcgacgaacctgtgtgtgcgtccgataacgcaacttacgcctccgaatgtgcgatgaaggaagccgcatgttcctccggagtgctccttgaagtgaagcatagcggttcatgtaactccatttcagaagataccgaggaagaagaagaggatgaggatcaagactactcctttcctatctcgtccatcctggaatgg

SEQ ID NO: 250042 - DNA, 1032 bp, Artificial Sequence
  Description of Artificial Sequence: Synthetic coding sequence
atggtcagagcgagacatcaacccggaggtttgtgtctcttgctgttgctcctctgtcaattcatggaggatcgttcggctcaggcaggaaactgttggcttcgtcaagcaaagaacggtcgttgccaggttctttacaaaactgaactgagcaaggaagaatgttgttctaccgggaggcttagcacctcatggaccgaggaagatgtcaacgacaacactctgtttaagtggatgatctttaatggaggggcacccaattgtattccatgcaaggaaacctgcgaaaatgtggactgtggcccgggaaagaagtgtcgcatgaacaaaaagaacaagcctcgatgcgtgtgtgcacctgactgctctaacattacttggaagggacctgtatgcggcttggatggaaagacttacaggaacgaatgtgcactgctgaaagccagatgtaaggaacaaccggaactggaagtgcagtatcagggtcggtgtaaaaagacgtgccgagatgtgttttgtccaggtagctcaacttgcgtggtggatcaaacgaataatgcctactgcgtgacctgtaaccggatctgcccggagcctgcatcgtcagaacagtacctgtgtggcaatgatggcgtgacctacagctctgcgtgccaccttagaaaagccacgtgccttctcggccgctcgataggtcttgcttacgagggtaagtgtatcaaggcaaaatcctgtgaagatatccaatgtactggcgggaagaaatgcctgtgggactttaaggtcggcagaggacggtgttctctttgcgatgagttgtgtcctgactcaaagtccgatgagccagtgtgtgcgtccgacaacgccacctacgcaagcgaatgcgcaatgaaggaggccgcctgttcctctggagtccttctcgaggtcaaacatagcggctcctgtaacagcatttcggaggacaccgaagaagaggaagaagatgaggaccaggattacagtttcccaatatcctcaatactggaatgg

SEQ ID NO: 250043 - DNA, 1032 bp, Artificial Sequence
  Description of Artificial Sequence: Synthetic coding sequence
atggtacgcgcacgtcatcaacccggtggcttatgcctcctccttctcctgctgtgccagttcatggaagacagaagtgcccaggccgggaattgctggctccgtcaggcgaaaaatggccggtgtcaggttctatacaaaacagagcttagtaaggaagagtgctgctcgacaggcagactgagcacctcatggacagaggaagatgtgaatgataataccttgttcaaatggatgatattcaacggcggtgcacccaattgtatcccctgtaaagaaacctgtgagaatgtggactgtgggcccggtaagaaatgccggatgaacaaaaagaacaagcctaggtgtgtatgtgcccctgactgtagtaacatcacatggaaaggaccagtctgtggcctggatggcaagacgtaccgaaatgagtgtgcactgctgaaggcccgttgcaaggaacaaccagaacttgaagtacagtaccagggaaggtgtaaaaagacatgtcgggacgtattttgtcctggctcaagcacctgcgtggtggatcagacgaacaacgcttactgcgtgacctgtaatcgaatatgtccagagcctgcgagcagcgagcagtacctttgtggtaacgacggtgtaacatattcttcggcctgccatctcagaaaagcgacatgcttactgggaaggagcatcggattggcttatgaggggaagtgtattaaggctaaatcctgcgaggacatccagtgcacgggagggaagaaatgcctgtgggacttcaaagtgggacggggccggtgttccctgtgcgacgagctatgtcccgacagcaaatccgacgagcctgtgtgcgcaagtgataacgcgacctacgcaagcgagtgcgccatgaaagaggccgcgtgctcctcgggcgtgctgctggaggtgaagcactccggttcatgtaactcaattagtgaagatactgaggaagaggaggaagatgaggatcaggactattcgtttcctatctcatccattctggaatgg

SEQ ID NO: 250044 - DNA, 1032 bp, Artificial Sequence
  Description of Artificial Sequence: Synthetic coding sequence
atggtgagggcccgtcaccagcctggagggttgtgcctcttactgcttctgctgtgccaattcatggaagatagaagtgcacaggcagggaactgctggctacgacaagccaaaaatggcaggtgccaggttctgtacaagaccgaactctctaaggaggagtgctgctcaaccggcagactgtcaacgtcttggaccgaagaagacgttaacgacaatacactcttcaagtggatgatcttcaacggtggcgcccccaactgtatcccctgcaaagagacttgcgagaacgtcgactgtggtccgggcaagaaatgcaggatgaacaaaaagaacaaacctagatgcgtgtgcgctcctgactgcagcaatatcacatggaagggtccagtgtgtggcctggatggtaaaacgtataggaacgagtgtgctttgttgaaggccagatgtaaggagcaacccgaacttgaggtacaataccagggaagatgtaagaaaacctgtcgggacgtgttttgcccgggctcaagcacctgtgtcgtggatcaaaccaataacgcctactgtgttacctgtaatcgcatatgcccggagcccgcgtctagcgagcaatacctgtgcggcaatgatggggtcacctactcttctgcctgccacctgcgcaaggcgacctgccttctcggccgttccatcggcctggcctatgagggaaaatgtatcaaagccaaatcctgtgaggacatccagtgcacgggaggcaagaagtgtttatgggattttaaagtaggccggggccgctgctccttgtgtgatgaattgtgccctgacagcaagagcgatgaaccagtctgcgcaagcgataacgccacgtacgccagcgagtgcgccatgaaagaagccgcgtgctctagcggagtactgctcgaagttaagcacagcggctcttgcaacagcataagtgaggacacggaggaagaagaggaggacgaagatcaggactactcctttcctataagcagcatcctggagtgg

SEQ ID NO: 250045 - DNA, 1032 bp, Artificial Sequence
  Description of Artificial Sequence: Synthetic coding sequence
atggtgagggctcggcaccagccaggaggcctctgccttttactacttctcctctgccagtttatggaggatagaagcgctcaggcaggcaactgttggttgaggcaggccaaaaacggacggtgccaggtactctacaaaacagaactgtccaaggaagaatgttgttcaacagggcgactgagcaccagctggactgaggaagatgttaacgataacacactttttaaatggatgatctttaacggaggagctccaaactgtataccctgcaaggagacatgcgagaacgttgactgcgggcccggcaaaaaatgtcgtatgaacaaaaaaaataagccgaggtgtgtgtgcgcccccgactgctctaatattacttggaagggtcccgtatgcgggcttgatgggaaaacctaccggaatgaatgcgccctactaaaggcgagatgcaaagaacagccagaactggaggtacagtaccagggccggtgcaaaaaaacgtgccgagacgtgttctgccctggatcgtctacgtgcgttgtagatcagaccaataacgcctactgtgttacgtgtaaccgaatctgccctgaaccagcatcaagcgagcagtatctgtgtggcaatgatggcgtgacctactcctctgcatgccacctgcgtaaagctacctgcctgctggggcgaagtattggcttagcgtatgaggggaagtgcataaaggcaaaatcatgcgaggacatccagtgtaccggtggaaagaagtgtctttgggatttcaaggtggggagggggagatgttcgctatgtgatgagttgtgtcccgattctaaaagcgacgagccagtgtgtgcaagcgacaatgccacttatgcctctgagtgtgccatgaaagaggcggcctgcagcagtggtgttttgctcgaagtaaaacactctggatcctgcaacagcatctcagaggacaccgaggaagaagaagaggatgaagaccaggattacagctttccaatctccagtatactcgagtgg

SEQ ID NO: 250046 - DNA, 1032 bp, Artificial Sequence
  Description of Artificial Sequence: Synthetic coding sequence
atggtgcgggctcgccaccagccgggcggcctgtgcctgctgctgctcctgctgtgtcagttcatggaggaccggtcagcccaggccgggaactgctggctcagacaagcgaagaatggtcgctgtcaggtcctgtacaagactgagttgtcgaaggaagagtgttgcagtactggcagactgagcacttcgtggactgaagaagatgtgaacgacaatacccttttcaagtggatgatctttaatggcggagcgcctaactgcattccatgcaaagaaacctgcgagaacgtggactgtggacctggtaagaagtgccgcatgaacaagaagaacaaaccacgctgcgtctgcgccccggactgctcgaacattacgtggaaggggcctgtctgtgggttggacggaaagacttaccgcaacgagtgcgcgctgctgaaggcgagatgtaaggaacagccggaactggaggtacaataccaaggccgctgtaagaaaacttgccgcgatgtgttctgtcctggctcgtcaacctgcgtggtggatcagactaataacgcatactgcgtgacgtgcaaccggatctgcccagagcctgcttctagcgagcaatacctctgcggaaatgatggcgtgacttactcctcggcgtgccatttgcgaaaagccacctgcctcttgggaaggagcatcggactggcctacgaggggaagtgcataaaggccaaaagctgcgaagatatccaatgtactggagggaagaagtgtctgtgggactttaaggtcggacggggacgctgcagcctttgcgacgagctgtgcccggatagcaagtccgatgagccagtgtgtgcatccgataatgctacctatgcgagcgagtgcgctatgaaagaggcggcgtgctcctccggagtgcttctggaggtcaaacactccggctcctgcaattccatctcggaagataccgaagaagaggaagaggacgaggatcaggattactctttcccgatctcaagcatccttgaatgg

SEQ ID NO: 250047 - DNA, 1032 bp, Artificial Sequence
  Description of Artificial Sequence: Synthetic coding sequence
atggtccgagcaaggcaccagcctggaggactttgtctcttgctactcttactttgtcagttcatggaggacagatccgcccaagccggcaactgttggctgagacaggccaagaatggacgatgccaagtgctgtataagacagagctgtcaaaggaagagtgttgtagcaccggtaggctgtcaacctcatggactgaagaggatgtgaatgataacactcttttcaaatggatgatcttcaatggaggagcccccaattgcataccttgtaaagagacctgcgagaacgtggattgtggtcccggcaaaaagtgcaggatgaataagaagaacaaaccccgatgtgtttgcgcacccgattgttcaaatattacatggaaaggacctgtgtgcggcctggatgggaagacctaccggaacgaatgtgctctcctcaaggctaggtgtaaggaacaacccgagctagaagtgcagtaccaaggtcgatgcaagaagacatgcagggatgttttctgccccggcagctctacatgcgtggtagatcagaccaacaacgcgtattgtgttacctgtaatagaatctgcccagagcctgccagctccgaacagtatttgtgcggcaacgacggtgtcacctactctagcgcttgtcatctgcgaaaagcaacttgtctgctgggtaggtctatcggcctcgcttatgaagggaagtgtatcaaggccaaatcctgtgaagatatacaatgcactggcggtaagaaatgtctttgggatttcaaagtagggcgaggccggtgcagtctctgcgacgagttatgccccgactcaaagagcgacgaacctgtatgtgccagcgataacgcgacttacgcaagcgagtgcgccatgaaagaggcagcgtgcagctccggcgttctgctcgaagttaaacactccgggtcatgcaattctatctctgaggatacggaagaggaagaggaggatgaggaccaggactactcatttcccatttcttcaatcctggagtgg

SEQ ID NO: 250048 - DNA, 1032 bp, Artificial Sequence
  Description of Artificial Sequence: Synthetic coding sequence
atggtgagggccaggcaccagcctggtggcctgtgtctgttgcttttgttgctgtgccagtttatggaggacagatcagctcaagccggaaactgctggctcagacaagccaaaaatgggcggtgccaggtgttgtacaagactgaactttcgaaggaagaatgctgctccaccggtcggctgtcaacctcatggacggaagaagatgtgaacgacaatactctgttcaagtggatgatcttcaatggcggagcccccaactgtatcccgtgcaaggagacttgcgaaaacgtcgactgcgggccaggaaaaaagtgccgcatgaacaaaaagaacaaaccgagatgcgtctgcgccccggactgctcgaacattacttggaagggaccggtctgcggactggacggaaagacctaccgcaacgagtgtgcactgctgaaggcaagatgtaaggaacaacctgagctggaagtccagtaccagggtcgctgcaaaaagacttgtcgggatgtgttctgtccaggctcaagcacttgcgtggtcgatcaaactaacaacgcgtactgcgtgacctgcaacagaatttgcccggaaccagcgagcagcgaacagtacttgtgcggcaatgacggtgtgacttacagcagcgcgtgtcaccttcggaaagcaacctgtctcctcggccgctcaatcggactggcctacgagggaaaatgcattaaagccaagtcttgcgaggacatccagtgcaccggtgggaagaagtgcttgtgggactttaaagttggacggggaaggtgttcgctgtgtgacgagctgtgccctgattcgaagtcagacgagccggtttgcgcctcggataacgccacttatgcgtctgagtgcgcgatgaaggaggcggcatgctcctcgggcgtgctcctcgaagtcaagcactcaggaagctgcaattcaatctccgaggacaccgaggaggaggaagaggatgaggatcaggactactccttccccatcagctcgatcctggagtgg

SEQ ID NO: 250049 - DNA, 1032 bp, Artificial Sequence
  Description of Artificial Sequence: Synthetic coding sequence
atggtgcgggcccgccaccagccaggagggttgtgtttactgctgctgctcctgtgtcagttcatggaggataggtctgcacaggccggaaattgttggctgaggcaggccaagaacggacgttgccaggtcctgtacaagaccgaattatctaaggaagagtgctgtagtaccggacggctgtccaccagctggacagaagaggatgtcaatgataacaccctcttcaaatggatgatcttcaatggcggcgcccctaactgtattccctgcaaggagacctgtgagaatgtcgactgcgggccaggcaaaaaatgcagaatgaataagaaaaacaagccacggtgtgtctgcgcccccgactgctcgaacataacttggaaaggcccagtatgcggtctagatggcaagacttataggaacgagtgtgccctgctcaaggcaaggtgcaaggaacagcccgagcttgaggtgcagtaccaagggcgctgtaaaaagacctgccgtgacgttttttgccctggctccagcacatgtgtggtggatcagactaacaatgcctattgcgtgacgtgtaatagaatttgcccggagccagcctcatctgaacagtacctttgcggcaacgacggggtgacctactcatccgcttgccatctgaggaaggccacttgtctgctcggtcggtccatcgggcttgcctacgaaggcaaatgtataaaagctaagagctgtgaagatattcagtgcacgggcggcaagaagtgtctgtgggattttaaggtggggaggggacgttgttccctgtgtgacgagctgtgcccggactccaaaagtgacgagcccgtctgtgcctcagataacgccacttacgcgagcgagtgcgcaatgaaagaggcagcttgttccagtggagtgctcctggaggtgaagcattcaggcagctgcaacagtatcagtgaggataccgaagaggaagaagaagacgaggatcaggattactccttcccaatttcaagtattttggaatgg

SEQ ID NO: 250050 - DNA, 1032 bp, Artificial Sequence
  Description of Artificial Sequence: Synthetic coding sequence
atggtgcgggcccgccaccagcctgggggtctttgccttctgctgctgctgctttgtcagttcatggaggacagatccgcacaggctggcaattgctggctgcggcaggctaagaacggacggtgccaagtcctgtacaaaaccgaactgagcaaggaggaatgctgcagcactggacgactgagcacctcctggactgaagaagatgtgaacgacaacactctgttcaaatggatgatcttcaatggcggtgcgccgaactgtatcccctgcaaagagacgtgcgagaacgtggactgcggaccagggaagaaatgcaggatgaacaagaagaacaagccgaggtgtgtgtgcgcgcctgattgcagcaatatcacctggaagggcccggtgtgcggactggacggaaaaacttaccgcaacgagtgcgctttgctcaaagcccgctgcaaggagcagccggaactcgaagtgcagtaccagggacgctgcaagaaaacttgtcgggacgtgttctgcccaggatcctccacctgtgtcgtcgatcagactaacaatgcatactgcgtgacctgtaaccggatctgcccggagccagcttcctctgaacaatacctgtgcggcaacgacggagttacctactcgagcgcgtgtcacctgcggaaggcgacttgcctgcttggtcgctccattggactcgcgtacgaaggcaaatgtatcaaggcgaagtcgtgcgaggacatccagtgtaccgggggcaaaaagtgtctctgggatttcaaggtcgggcgcgggcgctgctcgctctgcgacgaactgtgcccggacagcaagagcgacgagccggtttgtgcttccgataatgctacttacgcctcagaatgcgctatgaaagaggcggcttgttcatcgggcgtgctccttgaagtcaagcattcggggtcgtgtaactccatctccgaagatacggaagaagaagaggaggacgaggaccaggattactcgtttccaatctcgagcattctcgaatgg

SEQ ID NO: 250051 - DNA, 1032 bp, Artificial Sequence
  Description of Artificial Sequence: Synthetic coding sequence
atggtacgagcgcgccatcagcccggtggcctgtgtctcctgctcctgttgctgtgccagtttatggaggataggagtgcgcaggccggaaattgttggctccggcaggcaaaaaatgggcgctgccaggttttgtataagaccgaactcagcaaggaggagtgttgctctaccggaaggctctctaccagttggactgaggaggacgtgaatgataatacactttttaagtggatgattttcaatgggggggctccaaattgtattccttgtaaagagacatgtgagaatgtcgactgcgggcctggcaaaaaatgtcgaatgaacaaaaagaataaaccaaggtgcgtctgcgccccagactgcagcaatattacatggaaaggtcccgtgtgcggtctcgatgggaagacatacaggaacgagtgcgctctgctgaaggcgaggtgcaaggagcagcccgagctcgaggttcaataccaggggagatgcaagaaaacttgccgcgatgtgttttgtcctggaagcagcacctgtgtggtcgatcagacgaacaatgcctactgtgtaacctgcaaccgcatatgccctgaaccagcgtcctccgagcagtacctttgcgggaacgatggcgtgacatattccagtgcttgtcatttgcgcaaggccacctgtttgttgggtcggtctatcgggttggcatacgagggcaagtgcattaaggccaaatcctgcgaagatatccagtgtaccgggggtaagaaatgcctctgggattttaaagtgggcagagggagatgctcactgtgcgacgaactctgccctgatagcaaatctgacgagcccgtttgcgcatcagataacgcaacttatgccagcgaatgtgctatgaaagaagctgcatgcagtagcggagttttgcttgaggttaaacatagtgggtcatgtaattctatttccgaagatacagaagaggaggaagaagacgaagaccaagactattcattccctatttcttccatactggagtgg

SEQ ID NO: 250052 - DNA, 1032 bp, Artificial Sequence
  Description of Artificial Sequence: Synthetic coding sequence
atggtgagagctcggcatcaaccaggtggactctgtctcttgttgttgttgctgtgtcagttcatggaggatagatctgctcaggcgggcaactgctggctcaggcaggccaagaacggacgatgtcaggtcctgtacaagaccgagctgtctaaagaggaatgttgcagtaccgggaggctgtctacatcatggactgaggaagatgtgaacgacaacactctgtttaagtggatgatctttaacggaggcgcgcctaactgtattccctgtaaagagacatgcgaaaatgtcgactgcggtccgggcaagaagtgtaggatgaacaaaaagaacaaacccagatgcgtgtgtgccccggactgttcaaacatcacctggaaaggtcccgtctgtgggcttgatggaaaaacctatagaaacgagtgtgctttgcttaaagcaagatgtaaggagcagccggaattggaggttcagtatcagggaagatgtaaaaagacctgtcgggatgtattctgtccgggcagctccacttgcgtggtagaccaaacaaacaacgcttactgcgtcacatgcaataggatctgccccgagcctgcctcaagtgagcagtatctgtgtgggaacgacggagtaacctactccagcgcttgtcatctcagaaaagccacctgcctcctgggtcggtcaattggactggcttatgaggggaaatgtattaaagctaagagctgcgaagatatacagtgtactgggggaaaaaagtgcttgtgggattttaaggtgggcagagggcgatgctccctgtgtgacgagctctgcccagatagtaaatccgacgagccagtttgtgccagcgataatgccacttacgccagtgaatgtgccatgaaagaggccgcttgctcttcaggtgtcctgctggaagtgaagcattcaggctcttgtaattctataagtgaagacaccgaagaggaggaggaagacgaagatcaggattactctttccctattagctctatacttgagtgg

SEQ ID NO: 250053 - DNA, 1032 bp, Artificial Sequence
  Description of Artificial Sequence: Synthetic coding sequence
atggttagagcccgccatcagcccggggggttgtgtctcctactacttcttctgtgccagttcatggaagatcggtctgcccaggcaggaaattgctggcttagacaggcaaaaaacggaaggtgtcaggtgctgtacaaaacagaactctctaaagaggaatgttgctctactggaagactttcgacatcctggacagaagaagacgtaaatgataacactttgtttaaatggatgatatttaatgggggagcaccaaactgtataccctgtaaagaaacttgtgagaatgtggattgtggacccggaaaaaaatgccgcatgaacaagaaaaataaaccaagatgtgtgtgtgcccccgattgtagtaacataacatggaaagggccagtgtgcggactcgatggaaaaacttatcggaacgaatgcgcactgctcaaggctcggtgtaaagaacagccagaacttgaagtccaatatcaagggagatgtaagaaaacttgtagagacgtcttttgtccaggatcatctacttgcgtggtagatcagacgaacaatgcttactgtgtcacatgcaaccggatctgtcctgaacccgcatcctcagaacagtatctgtgcgggaatgatggagttacttacagttcggcgtgtcatcttcgcaaagcaacttgtctccttgggaggagtataggactcgcctatgagggaaaatgcataaaagcaaaatcttgtgaggatatccagtgcactggaggaaaaaagtgcttatgggattttaaagtgggacgagggcgctgttccctctgtgatgaactttgccctgattcaaaatctgatgaacccgtgtgcgcctcagataacgccacttacgcctccgaatgcgcaatgaaagaagccgcctgttcatccggagtcctccttgaggtgaaacattctggatcttgtaacagtatctctgaagatacagaagaggaagaagaagatgaagaccaggattattctttccccattagttctatcttggaatgg

SEQ ID NO: 250054 - DNA, 1032 bp, Artificial Sequence
  Description of Artificial Sequence: Synthetic coding sequence
atggttcgggctcgccaccaaccagggggactctgccttctgcttctcctcctctgccaattcatggaagaccgcagcgcccaagcggggaactgctggctgaggcaagccaagaatggaagatgtcaggttctgtacaaaaccgagctatctaaagaggagtgttgctcgacggggcgactgtcaacgtcctggacagaggaggatgtgaatgacaacacacttttcaagtggatgatttttaacggcggggcacctaattgtatcccttgtaaggaaacttgtgagaacgttgattgtggccccgggaaaaaatgtcgcatgaataagaaaaacaagccgcgatgcgtctgtgcaccggactgctccaatattacttggaaagggcccgtgtgtggactcgacgggaaaacatatagaaatgagtgcgccttactcaaggcccgatgcaaagagcagcctgagctcgaggttcaatatcagggcagatgcaagaagacgtgccgagatgtgttctgcccaggctcgtcaacatgcgtcgtggaccaaactaataatgcctattgtgtgacatgtaatcgaatatgccccgaacctgcctcatctgaacagtacctgtgtggaaatgacggcgtcacgtattcttctgcctgtcatcttagaaaggctacctgcctgcttggcagatccatcggcctggcctatgagggcaagtgcatcaaagcgaagtcctgcgaagatatccagtgcacaggcggtaagaagtgtctgtgggacttcaaggtgggacgtggccgctgcagtttatgtgatgaactgtgtcccgactcgaagtctgacgaacctgtttgcgccagtgacaatgctacctacgcatctgagtgcgccatgaaggaggctgcttgctcttcgggagtgctcctagaggtaaagcactcaggctcctgcaattctatatccgaggacacggaagaagaagaggaagacgaagatcaagactactccttccctatctccagcattttggaatgg

SEQ ID NO: 250055 - DNA, 1032 bp, Artificial Sequence
  Description of Artificial Sequence: Synthetic coding sequence
atggtcagggccaggcaccaaccaggaggactctgcctcctcctgctgcttctgtgccagtttatggaagatcgttccgcacaggctggaaattgttggctgcgccaagccaaaaacggccggtgtcaagtcctttacaagaccgaactgtcaaaggaggagtgctgttccaccggtaggctttcgacttcgtggaccgaagaggatgtcaatgataacaccctgttcaaatggatgattttcaatggaggggcacctaattgtattccatgcaaggaaacttgcgagaatgtggattgcggacctggtaagaagtgtcgtatgaacaagaagaacaaaccaagatgcgtgtgtgccccagactgttccaacattacgtggaaaggtcctgtctgtggacttgatgggaaaacctaccgcaatgagtgcgccctgctcaaagcgcggtgcaaggaacagccagaactcgaagtccaataccaagggcggtgcaaaaagacgtgcagagatgtgttttgccccggttcttcaacttgcgtggtcgatcagacgaacaatgcttactgtgtcacttgtaacagaatttgtccagaacccgccagctcggaacaatacctttgcggaaacgacggtgtgacttacagctcagcatgtcatctgcggaaagcaacctgtcttttggggcgatcaatcgggctcgcatacgaaggaaagtgcattaaggcgaagtcgtgcgaagatattcaatgtaccggcggaaagaagtgcttgtgggatttcaaagtgggacgaggtagatgttcgctgtgtgatgaactttgcccggatagcaagtccgatgaaccagtgtgtgcatcggacaacgccacctacgcaagcgaatgcgctatgaaggaggcagcatgtagctcgggagtgcttctggaagtgaaacactcaggatcttgtaactcgatttcggaggatactgaagaagaggaggaagatgaagatcaggactacagctttcctatctcgagcatattggagtgg

SEQ ID NO: 250056 - DNA, 1032 bp, Artificial Sequence
  Description of Artificial Sequence: Synthetic coding sequence
atggtgcgtgcccgacatcaacctggcggactgtgcttacttttgttgttactctgccagtttatggaagatcgctctgctcaagcaggtaactgttggctgagacaagcaaagaatggccgttgtcaagtgctgtataaaactgagctttcaaaagaagaatgctgtagcacaggccgcttgtctacctcgtggacagaggaagacgtcaatgataatactttatttaagtggatgatcttcaatggcggcgcgccgaactgtatcccatgtaaagaaacatgcgagaacgtagactgtggaccgggtaaaaagtgccgtatgaacaaaaaaaacaaaccacgttgtgtctgtgcacctgattgttccaatattacatggaagggtccggtatgcggattagacggtaaaacgtatagaaatgaatgcgctctcttgaaagcgcgctgtaaggaacagcctgagcttgaagttcagtatcagggtcggtgcaaaaaaacctgccgcgatgttttttgtccgggatcttccacatgcgtggtagatcaaactaacaatgcgtattgtgtgacatgcaaccggatttgtcctgagcctgcctcatcagaacagtatctgtgcgggaatgacggagtcacctatagctctgcatgccatttaaggaaagctacatgcctgctgggccggagcataggccttgcctatgaggggaagtgtataaaggccaagtcttgtgaagatatccaatgcacgggcggaaagaaatgtttatgggactttaaagtcggacgaggacggtgttctttatgcgatgaactgtgtccggatagcaaatcagatgaacctgtgtgtgcctcagacaacgcaacatatgcgtcagagtgtgccatgaaggaagctgcgtgctcatcgggggtgttattggaagtcaaacatagcgggtcgtgcaattccatctccgaggacacagaagaagaggaagaggatgaagaccaagactatagcttccctatttcaagtatcctcgaatgg

SEQ ID NO: 250057 - DNA, 1032 bp, Artificial Sequence
  Description of Artificial Sequence: Synthetic coding sequence
atggtccgggctcgccaccaaccgggtgggctctgcctactgctcctcctactctgtcagtttatggaggaccggagcgcacaggccgggaactgttggctgagacaggcaaaaaatgggagatgtcaggtattgtacaagacagagctgtctaaggaggaatgttgcagcacagggaggttaagtacaagctggaccgaggaggacgtcaatgataacaccttgttcaaatggatgatcttcaacgggggagctcccaactgcatcccatgtaaggaaacttgcgagaatgtggattgtggacctgggaagaagtgccgcatgaataaaaagaataagcccaggtgcgtttgcgctcccgattgtagcaacataacctggaaaggacccgtgtgcggcctggatgggaagacgtatcgaaacgagtgtgcccttttaaaagccaggtgtaaggaacagccggagctggaggtgcagtaccaggggagatgcaagaaaacctgtagggacgtgttctgccctggttctagcacctgtgtggtggaccaaaccaataacgcctactgcgtgacctgtaacagaatttgtcccgaaccagcgtcaagcgagcagtacttatgcgggaatgacggtgtcacatattccagtgcctgccacctgcggaaagcgacttgtctgcttgggcggtcaataggcctggcttacgagggcaagtgtattaaggccaaatcatgtgaagatatccagtgcaccggagggaaaaagtgtctctgggacttcaaggtgggccgtgggagatgttcattgtgcgatgagttatgccctgatagcaagagcgatgaaccagtgtgtgcctctgataacgccacttatgcttccgagtgcgcaatgaaagaagctgcctgtagttcaggagttcttctggaggtgaaacacagcgggagctgcaatagtataagcgaagacacagaagaggaagaagaagacgaagaccaagattacagcttccccatcagttctattctggaatgg

SEQ ID NO: 250058 - DNA, 1032 bp, Artificial Sequence
  Description of Artificial Sequence: Synthetic coding sequence
atggttcgtgcgcgacatcaaccgggtggtttatgtctattattattattattatgtcaatttatggaagatcgttcggcgcaagcgggtaattgttggttacgacaagcgaaaaatggtcgttgtcaagttttatataaaacggaattatcgaaagaagaatgttgttcgacgggtcgattatcgacgtcgtggacggaagaagatgttaatgataatacgttatttaaatggatgatatttaatggtggtgcgccgaattgtataccgtgtaaagaaacgtgtgaaaatgtagattgtggtccgggtaaaaaatgtcgaatgaataaaaaaaataaaccgcgatgtgtatgtgcgccggattgttcgaatataacgtggaaaggtccggtatgtggtttagatggtaaaacgtatcgtaatgaatgtgcgttactaaaagcgcgatgtaaagaacaaccggaactagaagttcaatatcaaggtcgttgtaaaaaaacgtgtcgagatgtattttgtccgggttcgtcgacgtgtgtagtagatcaaacgaataatgcgtattgtgttacgtgtaatcgaatatgtccggaaccggcgtcgtcggaacaatatttatgtggtaatgatggtgtaacgtattcgtcggcgtgtcatctacgtaaagcgacgtgtctactaggtcgatcgataggtttagcgtatgaaggtaaatgtataaaagcgaaatcgtgtgaagatatacaatgtacgggtggtaaaaaatgtctatgggattttaaagtaggtcgaggtcgttgttcgttatgtgatgaattatgtccggattcgaaatcggatgaaccggtttgtgcgtcggataatgcgacgtatgcgtcggaatgtgcgatgaaagaagcggcgtgttcgtcgggtgtattattagaagtaaaacattcgggttcgtgtaattcgatatcggaagatacggaagaagaagaagaagatgaagatcaagattattcgtttccgatatcgtcgatattagaatgg

SEQ ID NO: 250059 - DNA, 1032 bp, Artificial Sequence
  Description of Artificial Sequence: Synthetic coding sequence
atggtcagagcccgccaccagccgggaggtctgtgtcttctcctgttgcttctgtgccaattcatggaagatagaagtgcccaagccggaaattgttggctgcgccaagccaagaatggaaggtgccaggtactttacaagacagagctgtccaaggaagagtgttgttccaccggcaggctgagcaccagctggactgaggaagatgtaaacgataacacactcttcaaatggatgatctttaatggaggcgcaccaaactgcatcccctgcaaggagacatgtgagaacgtggactgcggaccgggcaaaaagtgcaggatgaataagaagaacaagcctagatgtgtatgcgcccccgattgttctaacatcacctggaagggacctgtctgtggcttggatggtaagacgtatagaaacgagtgcgctctgcttaaagccagatgcaaagagcagccggaactcgaagttcagtaccaaggccgctgcaagaagacctgtagggacgtgttctgtccaggctcttctacctgtgtcgtcgaccagacgaataatgcctattgtgtgacgtgcaataggatttgccctgagcctgcttcatcagaacagtacctctgtggaaacgacggtgttacatatagctctgcttgtcatttgagaaaggcaacttgcctcttgggacgctccattggtctcgcttacgagggcaagtgcattaaggcaaagagctgtgaagatattcaatgcactggtggaaaaaaatgtctgtgggacttcaaagtcggcaggggtcgctgttcactgtgtgacgaactttgccctgattctaagtcagacgagcccgtttgcgcatcagataacgcgacctacgcatccgagtgcgcgatgaaagaggcagcctgctctagcggagtcctgctggaagtgaagcacagcggctcatgcaatagcatttctgaggacactgaagaagaggaggaagacgaggatcaggactattcttttcccatttccagcattctcgagtgg

SEQ ID NO: 250060 - DNA, 1032 bp, Artificial Sequence
  Description of Artificial Sequence: Synthetic coding sequence
atggtaagggcaaggcaccagcccggaggactgtgtctcctgctgctgttgctgtgtcagttcatggaggacaggagtgcacaggcagggaactgttggcttagacaggcgaaaaacgggagatgccaagttctgtacaagactgaactgagtaaggaggagtgctgttccactggacgcctttcaacttcttggactgaggaggacgtgaacgacaacactctgttcaaatggatgatatttaatgggggcgcacccaactgtattccgtgtaaggaaacgtgtgagaatgtggattgtggtcccggaaagaaatgtaggatgaataaaaaaaataaacctcgctgtgtgtgcgccccagattgttccaatattacatggaagggacctgtgtgtgggctcgacggtaagacttatagaaacgagtgcgcccttctgaaggccaggtgcaaggaacagccagaactggaagtgcagtaccaggggaggtgcaagaagacatgcagagatgttttctgtcccggatccagcacttgcgtggtggaccaaacaaacaacgcctactgtgtgacctgcaatcgcatatgcccagaacccgccagcagcgagcagtacctctgcggcaacgacggggtcacctattctagcgcctgtcatcttaggaaggccacgtgtcttctgggccggtcaatcggtctggcatatgagggaaagtgtattaaagccaaatcctgcgaagatatccagtgtactggcgggaagaaatgcctgtgggatttcaaagtgggcagaggacggtgcagcctgtgtgatgaactgtgtccagatagtaagtctgacgagcccgtgtgtgccagcgataacgccacatacgcctctgagtgcgccatgaaagaagccgcttgctcttcaggcgtcttgctggaggttaagcacagtggaagctgcaactctatctctgaggataccgaagaggaggaggaggacgaagaccaagactacagctttccgatctccagtattttggagtgg

SEQ ID NO: 250061 - DNA, 1032 bp, Artificial Sequence
  Description of Artificial Sequence: Synthetic coding sequence
atggtgagagctcgccatcagccaggcggactttgccttcttcttctcctgctttgccagtttatggaggatcgctccgcacaggccggaaactgttggctgcgacaagccaagaacgggaggtgtcaggtgctttacaaaaccgaactttccaaagaagagtgctgctcaaccggaaggctgtcaacttcgtggaccgaagaggacgtgaatgataacacgctgttcaagtggatgattttcaacgggggtgcaccaaactgcatcccttgtaaagaaacttgtgaaaacgtggattgtggaccaggcaaaaagtgtaggatgaacaaaaagaataaaccgcgctgtgtgtgtgctcccgattgctccaacattacttggaaaggccctgtttgtggacttgacggcaagacctacagaaacgaatgtgcccttctgaaggcgcgttgcaaggaacaaccagaacttgaagttcaataccaaggtcgttgtaagaaaacttgtcgagacgtcttttgtcctgggtcgtccacctgtgtggtggatcaaaccaataacgcttactgcgtcacctgtaaccgcatatgccctgagcctgcatccagcgaacagtacctgtgcggtaatgatggtgtgacctattcgtctgcatgccacctgagaaaggctacgtgcctgctgggacgatctattggccttgcgtacgaagggaagtgtattaaggcaaaatcatgtgaggacattcagtgtactggagggaagaagtgtttgtgggatttcaaggtcggtagaggacgttgttctttgtgcgatgaactttgccccgacagcaagtctgatgaaccggtgtgcgcctcagataatgcgacctacgctagcgagtgcgcaatgaaggaagcagcttgttcgtcaggagtccttctggaagtcaaacattcgggaagctgcaactccatttcggaggacacggaagaagaggaggaggatgaagatcaggattattcgttccccatctcctcgatcttggaatgg

SEQ ID NO: 250062 - DNA, 1032 bp, Artificial Sequence
  Description of Artificial Sequence: Synthetic coding sequence
atggtgagagctcggcaccagccaggcggcctgtgcctcctcctgctgctgctgtgccagttcatggaagaccgaagcgcccaggcagggaactgttggctgcgccaagctaaaaatggcagatgtcaggtattatacaagacagaactgtcgaaagaggaatgttgctctactgggagactcagtacatcttggacagaggaagatgtgaatgacaatactctgttcaaatggatgatctttaatggtggtgccccaaattgcatcccctgcaaggagacttgtgaaaatgttgactgcgggcccggcaaaaaatgccgtatgaacaagaagaataaaccccgatgcgtgtgtgccccagactgtagcaacataacttggaaaggtccagtgtgcggactggatggaaagacgtatcgaaatgagtgcgccctgctgaaggccaggtgtaaggagcaaccggaactggaagttcagtaccaggggcgctgcaagaagacttgtcgcgacgtcttttgtcccgggtcctctacctgtgtggtggatcagacaaacaacgcctattgtgtcacatgtaatagaatctgccctgaacctgcctcaagtgaacagtacctttgtggcaatgatggtgtaacctattccagtgcttgccatctcaggaaagcgacctgcctgctcgggagatctattggtctggcctatgaaggaaagtgcatcaaggccaagagctgcgaagatatccagtgcactggcggcaagaaatgtctgtgggattttaaagtcggccgcggtcggtgcagcctgtgcgacgagctttgtcctgatagcaaaagtgacgagccggtgtgtgcctccgacaatgcaacttacgcgagtgagtgcgccatgaaagaggcggcctgctcttcaggggtgttgctcgaagtgaagcactcaggatcctgcaattccatctcagaagacaccgaggaggaggaggaagatgaagaccaggactatagcttccccatctcatcaatacttgagtgg

SEQ ID NO: 250063 - DNA, 1032 bp, Artificial Sequence
  Description of Artificial Sequence: Synthetic coding sequence
atggtaagggcaaggcaccagccgggaggcttgtgcctgctcttgctgttactgtgccaatttatggaggatcgatccgcccaagcagggaactgttggctgcgacaggccaaaaatggacgctgtcaggtgttgtataaaaccgaactgtcgaaggaggagtgctgttcaaccgggagattatctacaagctggaccgaggaggatgtaaacgacaacacactgttcaagtggatgatattcaatggaggtgcccctaactgtatcccatgcaaagaaacctgtgagaacgtcgactgcggaccaggcaaaaaatgtcgaatgaataaaaagaataagccccgatgcgtgtgcgcgcccgattgtagtaacattacgtggaaagggcccgtgtgcggtctggatggaaagacttaccggaacgaatgtgcgctactgaaggccaggtgtaaggaacagcctgagctggaggtccagtaccagggtagatgcaaaaagacctgcagggacgtgttctgccctgggagtagtacctgcgtcgtcgaccaaacaaacaacgcttactgtgtgacctgcaaccgaatctgtcctgagcctgctagctctgaacaatacttgtgtgggaatgacggcgtgacttatagttcagcttgtcatctccggaaagccacctgcctgctgggccggagcatcgggctcgcttacgagggcaaatgcatcaaggccaaaagctgcgaggacattcaatgtactggcggtaaaaaatgcttgtgggacttcaaggttggtcggggacgctgctccctgtgcgatgaattgtgccccgactccaagagcgacgagccagtttgtgcctcagacaatgccacatacgcctccgaatgcgccatgaaagaagctgcatgctcaagcggcgtgctgctggaggttaaacatagcgggtcctgcaatagcatctccgaggatacagaagaggaggaagaggacgaagaccaagattattcgtttcccatatcaagtattctggagtgg

SEQ ID NO: 250064 - DNA, 1032 bp, Artificial Sequence
  Description of Artificial Sequence: Synthetic coding sequence
atggtgagagcacgtcatcaaccgggtggcctctgtctgcttctgctgcttctctgtcagtttatggaggatcggagcgcacaagccggtaactgttggttgagacaggcaaagaacgggcgctgccaagtcctttacaagactgagctctccaaggaagaatgttgttcgaccgggcgcctgtccacttcctggactgaggaagatgtgaatgataataccttgtttaagtggatgattttcaacggcggagcacccaattgcattccatgcaaagaaacctgtgaaaacgtggattgtggccccggcaaaaagtgcagaatgaacaagaagaacaaaccacgatgtgtctgtgcccccgactgctcgaatatcacttggaaggggcctgtgtgtggactggacggtaaaacctacaggaacgagtgtgcacttttgaaggcccgttgtaaggagcaaccggaacttgaagtgcaataccagggaaggtgtaagaaaacctgtagagacgtgttctgtcccggatcgtccacctgcgtggtggaccagacgaataacgcatactgcgtgacttgtaatagaatttgccctgaacctgccagctcggaacaatacttgtgcggcaatgatggtgtcacctactcatcggcatgtcatcttagaaaggcaacttgccttctcggccgatcaatcggtctggcatacgaaggaaagtgtatcaaggcaaagtcctgtgaagatattcagtgtaccggtggtaagaagtgtctttgggatttcaaggtgggacgtggtcgatgtagcctttgcgacgaactgtgtccagattcaaaatcggatgaacctgtctgtgcaagcgacaacgccacctacgcctcagaatgtgcaatgaaggaagccgcgtgttcatcaggagtgctgcttgaggtgaagcattcgggctcgtgtaactcgatatccgaggataccgaagaggaagaggaggacgaagatcaggactactccttcccaatctccagcattcttgaatgg

SEQ ID NO: 250065 - DNA, 1032 bp, Artificial Sequence
  Description of Artificial Sequence: Synthetic coding sequence
atggtgagagcccgccatcagcccgggggactttgtcttctccttctattactatgccagtttatggaagatagatccgcacaagccgggaattgttggctgcggcaggctaagaacgggcgctgtcaggttttatataaaacggaactgtccaaggaggaatgctgcagtactggaaggctttctacaagttggactgaagaagacgttaatgataatacattattcaaatggatgatctttaatgggggagcccctaattgtatcccttgtaaagaaacttgtgaaaacgtggactgtgggccggggaaaaaatgtcgaatgaacaagaaaaataaaccccgatgtgtgtgtgctcccgattgttcaaatatcacttggaagggaccagtatgtggactcgatggaaagacatatagaaatgaatgcgctctgttaaaagcccggtgcaaagagcagcctgaattagaagttcagtatcagggaaggtgtaaaaaaacatgccgggatgtcttctgtcccgggtcctccacttgcgtagtcgatcagactaataatgcctactgcgtgacatgtaaccggatctgtcccgaacctgctagttctgaacagtatttgtgcgggaacgatggggtaacatactcatccgcatgccatctacgtaaagctacatgcctgctgggaaggtctatcgggctagcgtatgaaggaaagtgcatcaaagcaaaatcatgtgaagatattcagtgtacaggggggaaaaaatgtctctgggatttcaaagtaggaagagggcgctgctcactctgcgatgaactgtgccctgatagtaagtccgatgaacctgtgtgcgcttctgacaacgctacatacgccagtgaatgtgccatgaaggaagctgcatgttcctctggggtgttattggaagtcaaacattctggatcatgtaacagtatttctgaagatactgaagaagaagaagaggatgaggatcaggattattcgtttcctatttcttcaatactggaatgg

SEQ ID NO: 250066 - DNA, 1032 bp, Artificial Sequence
  Description of Artificial Sequence: Synthetic coding sequence
atggtacgagctcgccaccagcctgggggcctgtgcctgctgttgctgctgctgtgtcagttcatggaagatcgatctgcacaggcaggtaactgttggctgagacaagccaagaatggtcggtgccaggttctgtacaagactgagttgtcaaaagaggaatgttgtagcaccgggaggctcagcacaagctggactgaagaggatgtgaatgacaacacgctctttaaatggatgattttcaacggcggcgcaccaaactgcattccctgtaaagagacctgcgagaatgttgactgcggcccaggaaagaaatgtaggatgaataagaaaaacaagcctcgttgcgtatgcgcacccgactgcagtaatatcacttggaaggggcccgtgtgcggactggatggcaaaacataccgcaacgagtgtgctttactgaaagcaaggtgtaaggagcagcctgagctggaggttcagtaccaggggcgctgtaagaagacttgtcgggacgtgttctgccctgggtcgtcaacttgtgtggttgaccaaacaaataatgcctattgcgtcacctgtaacaggatctgccccgaacccgcctcctctgagcagtacctctgtggcaatgatggagttacttattcgtccgcctgccacttgaggaaggcaacctgccttctgggtagatcaatcggcctcgcttatgaggggaaatgtatcaaagctaaatcatgtgaagatatccagtgtactggcggaaagaaatgcctgtgggatttcaaggtaggccgtggcagatgttcactgtgtgatgaactctgtcctgatagcaagagtgacgagcctgtttgtgcatcagacaatgcgacatacgccagcgagtgtgccatgaaggaagcagcttgcagcagtggcgtactgcttgaggtgaaacacagcggaagctgcaactctatctctgaggataccgaggaggaagaagaagacgaagaccaggattactctttccctatttcctcaatacttgagtgg

SEQ ID NO: 250067 - DNA, 1032 bp, Artificial Sequence
  Description of Artificial Sequence: Synthetic coding sequence
atggtacgcgctcgccatcagccgggcggcttgtgtctcctgctgcttcttctgtgtcagttcatggaagaccgatccgcccaagctggtaactgttggctgcgtcaggctaaaaatgggaggtgccaagtgctttataagactgaactgtcaaaagaggaatgctgcagcaccggccgccttagtaccagctggactgaagaagatgtaaacgacaacacgcttttcaaatggatgattttcaatggaggagcccccaactgtataccctgcaaggagacatgcgaaaatgtggactgtggccctgggaaaaaatgtagaatgaataaaaagaataagccccgatgtgtgtgcgcccctgattgttcgaacatcacgtggaagggcccagtgtgcggcctggacgggaagacgtataggaatgaatgtgctttgctgaaagctaggtgcaaggagcaacccgagttagaggtgcagtaccaaggtagatgtaaaaagacttgtcgcgatgtgttttgtcccggctcttcaacttgcgtggtcgaccaaacgaataatgcatactgtgtgacgtgcaatcgcatctgcccggagcccgcaagcagtgagcagtacttgtgcgggaacgatggggttacctatagctccgcctgccaccttcggaaggccacgtgcctgctcggacgcagtattgggctcgcctatgaaggtaagtgtattaaagcaaagagttgcgaggatattcagtgtaccgggggcaagaagtgtctctgggattttaaagtcgggagggggaggtgtagcctttgtgacgaactgtgtccagatagcaaatccgatgaaccagtctgtgccagcgacaacgcgacatatgcgagtgaatgtgccatgaaggaggccgcctgttcttcgggggtgttgctggaggtgaagcactctggcagctgtaacagtatctctgaagacacagaagaggaggaagaagacgaagaccaggattactctttccctattagtagcatcttagaatgg

SEQ ID NO: 250068 - DNA, 1032 bp, Artificial Sequence
  Description of Artificial Sequence: Synthetic coding sequence
atggttcgggcgaggcatcaacctggtgggttgtgcttgctgctcttgctcctctgccaattcatggaagatcgttcagcgcaagctggcaactgctggctaaggcaagccaagaatggcaggtgccaagtgttgtataagaccgagttgagcaaagaggaatgttgctccacgggaaggctttcaacgtcctggactgaagaagacgtcaatgataacactctattcaagtggatgattttcaacgggggtgcacctaactgtattccgtgtaaagaaacatgcgagaatgtggactgtggaccaggtaagaaatgcagaatgaacaagaaaaacaagcccagatgcgtgtgcgctccggattgtagtaatatcacttggaaggggcctgtgtgcggtcttgacggtaaaacatacagaaacgagtgtgctctgctcaaggctagatgcaaggaacaacctgaacttgaggttcagtatcaaggacgatgcaagaagacatgcagagatgtgttttgtccaggaagttctacatgtgttgtggaccaaactaacaacgcatattgtgttacctgcaaccgtatttgccccgagccagctagcagcgagcagtatctttgcgggaacgatggagttacttattcgtccgcttgccatcttaggaaagccacctgcctcctcggacgttccattggacttgcttatgaagggaagtgtattaaggcaaaaagttgtgaagatatacagtgcaccggtggaaaaaaatgcctttgggattttaaagttggtaggggaaggtgtagtctttgcgacgaactttgcccagatagtaagagtgacgagcctgtgtgcgccagtgataacgcaacgtacgcttcagagtgtgctatgaaggaggccgcttgctcgtcgggagtgttgctagaagtcaagcatagtgggtcttgcaatagcatcagtgaagatactgaggaagaagaagaggatgaagaccaagattactcttttcctataagttcgatcttagagtgg

SEQ ID NO: 250069 - DNA, 1032 bp, Artificial Sequence
  Description of Artificial Sequence: Synthetic coding sequence
atggtcagagctcgacaccagcctggaggcttgtgcctcctgttattgctgttatgccagtttatggaggataggagtgcccaagcggggaactgctggctccgccaggccaagaacggtagatgtcaggtgctatacaagactgaactgagcaaagaagagtgctgctccacaggccgcttgtcaacgtcatggaccgaagaagatgtaaacgacaacactctctttaagtggatgatattcaatggtggcgcgccaaattgtataccttgcaaggagacgtgcgagaacgtggactgcggccctggcaagaagtgccgtatgaacaagaagaataagccgcgatgtgtctgcgctcctgattgcagtaacatcacgtggaagggcccggtatgcggactggacggaaagacctatcgaaatgaatgtgccctgctgaaggcccgctgcaaggagcagccggagctcgaagttcagtaccagggccgctgtaagaaaacttgccgcgatgtgttttgcccaggtagcagtacctgcgtggtggaccagacaaacaatgcctattgtgtcacgtgcaacaggatttgccccgaaccggccagctcagagcaatacctgtgcggcaacgacggtgttacttacagttctgcctgccatctgagaaaagcgacatgcttgctgggcagatcgatcggattagcgtatgagggcaaatgtattaaggctaagtcctgcgaggatattcagtgcactggcggaaaaaagtgcctttgggattttaaggtgggccgtggccgctgcagcctgtgcgacgagttgtgccccgacagcaaatcggatgagccagtgtgcgcctccgacaatgccacctacgcgtctgagtgcgcgatgaaggaagcagcctgcagcagcggcgtgctgttggaagtcaaacactccggctcctgtaatagcatctcggaagataccgaagaagaagaggaggacgaggaccaagattacagtttcccgatctcctccatcctggaatgg

SEQ ID NO: 250070 - DNA, 1032 bp, Artificial Sequence
  Description of Artificial Sequence: Synthetic coding sequence
atggtgagggcccgccaccagccagggggcctctgcctactgttgctgctgttatgccaatttatggaagaccggtccgcccaggcgggtaactgctggctccgccaagcaaaaaatgggcggtgccaagtcctgtataagacagaattatctaaggaggagtgttgctctaccgggcggttgagtacgtcttggacagaagaagacgtgaacgacaacacactttttaaatggatgatctttaatgggggtgctcccaactgcatcccttgtaaagagacatgcgagaatgtggattgcggccccgggaagaagtgtaggatgaacaaaaagaataagcccaggtgcgtgtgtgccccagactgttccaacatcacttggaaaggtcctgtgtgcggtctagacggaaaaacctataggaacgagtgtgctctgttgaaagcccgctgcaaggagcagccagaactggaagtccaatatcaagggcgatgcaaaaagacatgtcgggatgttttctgccccggttcctcaacctgtgtggtggatcagaccaacaacgcctactgcgttacatgtaatcgaatctgccccgagcccgcaagctccgagcagtatctatgcggcaatgacggcgtgacatacagtagcgcatgccaccttagaaaagcaacctgcctcctcggacgatcgatcggcctcgcttatgaaggaaagtgtatcaaggctaagtcttgcgaggatattcagtgcactggagggaagaagtgtttatgggattttaaggtcgggagggggcgctgttccctctgcgacgaattatgtccagactctaagtctgacgaacccgtttgcgcgtcggacaatgcaacgtacgcctcagaatgtgctatgaaggaagcagcttgctcatccggcgtattactggaggttaagcacagtggatcgtgcaattctatctccgaggacactgaagaggaggaggaggacgaagatcaggactattcgtttcccatctcaagtatcctggaatgg

SEQ ID NO: 250071 - DNA, 1032 bp, Artificial Sequence
  Description of Artificial Sequence: Synthetic coding sequence
atggtccgcgccagacaccaacccggcgggctttgtctactgctgctgctcctgtgccagttcatggaggacagatctgcgcaggcaggaaactgttggttacgacaggctaagaacggtaggtgtcaggtcctttataagaccgagctcagcaaggaggagtgctgctcaaccggaaggttgtcaacgagctggactgaggaggacgtgaatgacaacaccctctttaaatggatgatcttcaatggtggggcgcctaattgtattccttgtaaggaaacatgtgagaacgtcgactgtggaccaggcaagaaatgcaggatgaataagaagaacaagccccgctgtgtgtgtgcccccgactgttcgaatatcacttggaaaggccccgtttgtggattggacggcaagacctaccgaaacgaatgcgctttgctaaaggccagatgtaaagagcagccagaactggaggtgcagtaccagggtcggtgcaaaaagacctgccgcgatgtcttttgcccagggagtagcacttgcgtcgtggatcaaacaaataacgcctactgcgtgacttgcaatcggatttgccctgagccagcctccagtgaacagtatctctgtggaaatgacggagtaacctactccagcgcctgccatctgaggaaagccacttgtctgttgggcagatcaattggcctggcgtacgaagggaagtgcatcaaagcaaagtcctgtgaggacattcagtgcaccggagggaaaaagtgcttgtgggacttcaaggtcggaagaggacgatgctctctttgcgatgagttgtgtcccgattccaagagcgacgagccagtgtgcgccagtgataatgctacctatgcttccgaatgcgccatgaaggaggccgcctgctcctcaggggtattactcgaggttaagcactcaggctcttgcaatagcatctccgaagataccgaagaagaggaggaagatgaagaccaggattatagttttcccatatcgtccatcctggagtgg

SEQ ID NO: 250072 - DNA, 1032 bp, Artificial Sequence
  Description of Artificial Sequence: Synthetic coding sequence
atggtaagggccaggcatcagcctggcgggctgtgcctccttctcctcctcctgtgccagtttatggaggaccggtcggcacaggcaggaaactgctggctgagacaggccaagaacggccgctgtcaagtgctgtacaagaccgaactgtcaaaggaagaatgctgttccactggtcggctgtctacctcgtggactgaagaagatgtgaatgacaataccttgttcaagtggatgatctttaacgggggagcaccaaattgcatcccgtgcaaggaaacgtgtgagaatgtcgactgcggcccgggcaaaaagtgccggatgaacaaaaagaacaaaccgcgctgcgtttgcgccccggattgttctaacatcacctggaaagggccagtctgtggattggacggcaagacctaccgcaacgagtgcgccttgcttaaggcgcgctgtaaggaacagcctgagcttgaagtccaataccaggggcgatgcaaaaagacctgtagagacgtgttctgccccggatcctcgacgtgtgtggtggatcaaaccaacaatgcctactgcgtcacttgtaaccggatttgtccagagcccgcgagcagcgagcaatatctgtgcggaaatgacggagtgacttactcgtcggcctgccacctcagaaaagcaacctgcctgctgggacggtcgattggactcgcatacgaaggcaagtgtattaaggcgaaatcctgcgaggatattcagtgtacggggggaaagaaatgcttgtgggatttcaaagtcggacggggccggtgctccctgtgtgacgaactgtgccctgactcaaagtccgacgagccggtgtgcgcaagcgacaacgctacctacgctagtgaatgtgcaatgaaggaagcggcctgcagctcgggagtgctgctggaggtaaagcactccggatcgtgcaattccatatcagaggacactgaagaggaggaggaagatgaggatcaggactactctttcccgatctcgtctatcctcgagtgg

SEQ ID NO: 250073 - DNA, 1032 bp, Artificial Sequence
  Description of Artificial Sequence: Synthetic coding sequence
atggttcgcgcccggcaccaaccgggcggcctctgtttgctccttctgcttctctgtcaattcatggaggatcggagcgcgcaagcaggaaactgttggttgcggcaggccaaaaacggacggtgccaggtcctgtacaagaccgagctcagtaaagaagagtgctgtagcactggacgcttgtccacgtcgtggaccgaggaggatgtgaatgataacaccctgtttaagtggatgatcttcaatgggggcgcaccaaattgtatcccgtgcaaggagacttgtgaaaacgtggactgtggcccgggaaagaaatgccgcatgaataagaagaacaagccgcgctgcgtgtgcgcgccggactgctccaacataacctggaagggtccggtgtgcgggttggatggcaaaacctaccgcaatgagtgcgctctgctcaaagcaagatgtaaagagcagccggagcttgaagtccaataccaaggacgctgcaaaaagacgtgtcgagatgtgttctgccccggctcgtccacttgcgtggtggaccagaccaacaacgcctattgcgtgacttgtaaccggatctgcccggagccagcctccagcgagcagtacctgtgcggaaacgacggagtgacttactcctcagcatgccacctccgcaaggcgacctgccttctgggacgctccatcggactggcttacgaaggaaaatgcattaaggcaaagtcctgcgaggatattcagtgcactggaggaaaaaagtgtctctgggatttcaaagtgggccggggtagatgctcgctgtgtgatgagctctgcccagattccaagagcgacgaaccagtgtgtgcttcggataatgccacctacgcctcggagtgcgcgatgaaggaggccgcttgctcgtccggcgtcctcttggaggtgaagcactcaggttcgtgcaattcaatctcggaggacactgaagaagaagaagaggacgaggaccaggattactctttcccaatctcgtcgatcctcgaatgg

SEQ ID NO: 250074 - DNA, 1032 bp, Artificial Sequence
  Description of Artificial Sequence: Synthetic coding sequence
atggtccgcgcacggcaccagccaggtggcttgtgccttcttctactgcttctttgtcagttcatggaagatagaagtgctcaagccggtaactgttggctgcgccaggcaaagaatggtaggtgccaggtgctctataagaccgaactgtccaaggaggagtgttgctccacaggacgcctctccacgtcttggactgaggaagatgttaatgacaataccctattcaagtggatgatattcaatggaggggcgcctaactgtattccatgtaaggaaacgtgcgagaatgtggactgcgggccgggtaagaaatgccggatgaataagaagaacaaacctcggtgtgtgtgtgcaccagactgctcgaacattacttggaagggcccagtctgcggtctcgatgggaagacgtatcgaaacgaatgtgcattgctgaaggcccgatgtaaggaacaacctgaactggaggtgcaataccagggtcgttgcaagaaaacgtgcagggacgtcttctgtccaggcagttctacctgtgtcgtagaccaaacaaacaatgcgtactgcgtgacctgtaaccgcatttgtcctgagcctgcctcgtctgagcaatacttatgcggaaacgatggggtaacgtacagctccgcctgccacctgcgcaaagcaacctgcctcctagggaggtcaatcggtcttgcgtatgaaggcaagtgcattaaagctaagagctgcgaggatatccagtgcacaggtggaaagaagtgcctctgggacttcaaggttggtaggggtcgatgctctttgtgtgatgaactttgccctgattccaagtcagatgagcccgtttgtgctagcgacaacgcaacttacgcgtccgaatgtgctatgaaggaggccgcttgttccagcggggtcctcttggaggttaagcattccggatcgtgtaattcgatttctgaggacaccgaggaggaggaggaggacgaagatcaagattacagcttcccaatatcgagcatcctcgagtgg

SEQ ID NO: 250075 - DNA, 1032 bp, Artificial Sequence
  Description of Artificial Sequence: Synthetic coding sequence
atggtccgcgctagacatcagccaggcgggctgtgcctgctgttgctactgctttgtcagttcatggaagataggtcagcccaagctgggaattgctggctccgccaggctaagaacggtcgctgtcaggtgctctacaagactgagttgtccaaggaggaatgctgctctaccggccgcctgtcgacatcctggacggaggaagatgttaatgataacaccctgtttaaatggatgattttcaacggaggcgcacccaattgcatcccctgtaaagagacgtgtgagaatgtggactgcggcccaggcaagaagtgtcgaatgaacaaaaagaacaaacctcgctgcgtttgtgccccggattgttctaacatcacatggaaggggccagtgtgtggtttggatggaaagacctatcgcaacgagtgcgccctgctcaaggcacgctgcaaggagcagccagagctagaggttcaatatcaaggaagatgcaagaagacctgtcgtgacgtcttctgccctggctcctcgacgtgcgtagtggaccagaccaataacgcctattgtgtcacatgtaatcgtatatgccccgagccggcctccagcgagcagtacctgtgtggaaatgatggtgtcacctacagttcagcctgtcacctgaggaaggctacgtgcctgcttggtcgcagcatcggactggcgtatgagggcaaatgtatcaaagcaaaaagctgcgaagacatccaatgcaccggcggaaagaagtgcctatgggattttaaagtaggcaggggacgttgctcgctgtgcgacgagctgtgccctgattctaaaagcgatgagccagtttgcgcctcagacaacgccacctatgcctcagaatgcgccatgaaggaggctgcttgcagctccggagtcttgctggaggtaaaacactccggctcttgcaactccatttccgaggacacagaagaggaggaagaggatgaagatcaagactacagcttcccaatttccagcatcctggagtgg

SEQ ID NO: 250076 - DNA, 1032 bp, Artificial Sequence
  Description of Artificial Sequence: Synthetic coding sequence
atggtgagggcgcgacatcagcccggggggctttgtctgttgcttttgcttttgtgtcagtttatggaagatagaagcgcgcaggccggaaattgctggctgcggcaggccaaaaacgggaggtgccaggtgctatacaagactgaactgagtaaggaggagtgttgttccacaggaagactgagcacttcctggactgaagaagatgtcaatgacaataccctcttcaagtggatgatatttaacggtggggcacccaactgtataccttgtaaggaaacgtgcgagaacgtcgattgcggacccggcaaaaaatgccggatgaataaaaaaaacaagcccagatgcgtctgtgccccagattgcagtaacataacatggaaaggacctgtatgtggactggatgggaagacctatagaaacgagtgtgctctactcaaggcccgctgcaaggaacagccggagttggaggtgcagtaccagggacgatgtaagaagacctgccgcgacgtgttctgtcctggctcgtctacctgcgtggtggatcaaacgaataacgcatactgtgtcacctgtaatcgtatttgccccgaaccagctagctccgaacagtacctctgcgggaatgacggagtgacttattcttccgcttgccatctcagaaaggccacatgccttctgggccgctcgatcggcctggcttatgagggaaaatgcatcaaggcaaagtcctgcgaggacatccagtgcacaggaggcaaaaaatgtctgtgggacttcaaggtgggacgtggtcggtgtagtctttgtgacgagttgtgcccagactcaaagtctgatgagcccgtttgcgcgtccgacaatgctacatacgcgtcagagtgcgctatgaaggaggctgcgtgttcctcaggtgtccttctggaggtcaaacactcgggctcctgtaacagtatttccgaggatacagaggaggaggaagaagatgaagaccaagactatagtttccctatcagcagcatcctggagtgg

SEQ ID NO: 250077 - DNA, 1032 bp, Artificial Sequence
  Description of Artificial Sequence: Synthetic coding sequence
atggtaagagcgagacaccaacccgggggactgtgccttttgctcttactcctctgtcaatttatggaagatagatcggcgcaagcaggaaactgttggcttagacaagcaaaaaacggccgttgccaagtcctgtacaaaacggagttgtcaaaagaagagtgctgttcgacaggaagactctctactagttggacggaggaagatgtaaacgataacacactttttaaatggatgattttcaatggaggcgctcctaactgtattccatgcaaggagacgtgcgaaaacgttgactgcggcccaggtaagaagtgtaggatgaataaaaaaaacaaacctcgctgtgtctgtgcaccagattgcagcaatattacttggaagggccccgtctgcggactcgatggtaagacttatagaaatgaatgcgctcttcttaaagctagatgcaaagaacaaccagagctggaagtgcaatatcaaggtagatgcaaaaaaacctgcagggatgtgttttgccctgggtccagcacctgtgttgttgatcaaacaaacaacgcttattgcgtcacgtgtaatcggatctgccctgagcccgcatcgtctgagcaatacctatgcggtaatgatggagtgacgtactcttccgcttgtcacttaagaaaggctacatgcctgttggggcgttccatcgggttggcctatgaaggaaagtgcattaaagccaaaagctgtgaggatattcagtgtacgggtgggaaaaaatgtctgtgggactttaaggtaggtagggggcgttgttctctttgcgatgagctttgcccggattccaagagcgacgagcctgtatgcgcatcggataatgccacctacgcttccgagtgtgcgatgaaagaagccgcctgttcctcaggggtattattggaggttaaacattctggctcctgcaacagcatatctgaggatactgaagaagaagaagaggatgaagatcaagattactcttttccaatttcaagcatattggaatgg

SEQ ID NO: 250078 - DNA, 1032 bp, Artificial Sequence
  Description of Artificial Sequence: Synthetic coding sequence
atggtgcgggcgcggcatcagcctggtggactctgtctgctcctccttctcctgtgtcagttcatggaggatcgatctgctcaagcggggaattgctggcttagacaggccaaaaatggccgctgccaggtgctgtataagacggaattgagcaaagaagaatgttgctcaactggacggctgagcacatcttggacggaggaagatgtgaatgataataccctctttaagtggatgatctttaacggaggcgccccgaactgcataccttgcaaagaaacttgtgaaaacgtggattgtggacccggaaaaaaatgtcgtatgaacaagaaaaacaagcccaggtgtgtgtgtgcgcccgactgcagcaacattacttggaagggccccgtgtgtggcctggatggtaagacgtaccgcaacgagtgtgcgttattgaaagcgcgctgtaaagaacagccagagttagaagtccagtaccaggggcggtgtaagaagacatgtagagatgtattctgcccaggtagctctacatgcgtggtcgatcaaactaataatgcatactgcgtaacgtgtaaccggatctgtcctgaaccggcttcctctgaacagtatctctgcgggaacgacggagtgacctacagttctgcatgtcatctgaggaaggcgacttgtctgctgggtaggtctatcggtcttgcttacgaaggtaaatgcataaaagctaaatcctgtgaggatattcagtgcaccggaggaaaaaagtgcttgtgggatttcaaagtggggagagggagatgttctttgtgcgacgagttgtgcccagattcgaaatctgacgagcccgtctgtgcctccgataatgcaacatacgcttccgaatgtgcaatgaaagaagctgcttgctcatcgggcgtgctcctggaggtcaagcactccgggtcatgcaacagcatctccgaggataccgaggaggaagaagaggatgaagaccaagattattccttccctatctcttctatcttagaatgg

SEQ ID NO: 250079 - DNA, 1032 bp, Artificial Sequence
  Description of Artificial Sequence: Synthetic coding sequence
atggtgagggccaggcatcagccaggaggactctgcctgctgttgttgctgctgtgtcagttcatggaggatagatccgcgcaggctggcaattgttggcttcgccaggctaaaaacgggaggtgccaggtactttataagaccgaactctccaaggaggagtgttgttccacgggccgactcagcacaagttggaccgaagaggatgtcaacgacaatactctcttcaagtggatgatctttaacgggggggccccaaactgcataccatgtaaagagacttgtgagaacgtagactgcggtccgggcaagaagtgcaggatgaacaaaaagaacaaaccccggtgcgtgtgcgcccctgactgttctaacatcacttggaaaggacccgtgtgtggattggacggtaaaacgtatagaaatgagtgcgccttgctgaaagctcgatgcaaggaacagccggaactcgaggtacagtatcaaggccgatgtaagaagacttgtcgggatgtgttttgccccggaagttctacttgcgtggtcgatcaaactaacaatgcatattgcgtcacctgcaatcgcatttgccccgagccggccagtagcgaacagtacctttgtggaaatgacggagtgacctattcctctgcatgccacttgagaaaagcgacatgtcttctcggccggagtattggactggcctacgaggggaagtgcattaaggcaaaaagttgtgaggacatccagtgtacaggaggcaagaagtgtctttgggatttcaaagtagggcggggacggtgcagtttgtgtgatgagctgtgtcctgattctaagagtgacgaacccgtgtgcgcttctgataatgccacttatgcttcagagtgtgccatgaaggaagccgcatgcagcagtggcgtgctgctcgaggtgaaacatagcggcagctgcaactcaatatccgaggatacagaagaggaggaggaggatgaggaccaggactactcttttcctatctcaagcatattggagtgg

SEQ ID NO: 250080 - DNA, 1032 bp, Artificial Sequence
  Description of Artificial Sequence: Synthetic coding sequence
atggtgagagctcgacaccagcctggcggactgtgcctgttgcttctccttctgtgccagtttatggaggatcgctccgcgcaggccggaaattgttggctcaggcaggcaaaaaacggtcgctgccaagtgctttacaagactgagctctcgaaggaggagtgttgctcgaccgggcggctgtcgacttcttggactgaggaggacgtgaacgataacaccctgtttaagtggatgatcttcaacggtggcgcaccaaattgcattccatgcaaggaaacttgtgaaaatgttgattgcggtccagggaagaagtgtcgcatgaacaagaagaacaagcccaggtgtgtctgtgcaccggattgctctaacattacctggaaaggtcctgtgtgtggcctggacggaaagacttaccggaatgaatgcgcactgctcaaagcacgctgtaaggaacaaccggagcttgaagtgcagtatcagggaagatgtaaaaagacctgtcgcgatgttttttgtccaggtagcagcacttgtgtggtggaccagactaacaacgcatactgcgtcacttgcaatcggatatgcccagaacccgcgagctccgagcaatacctctgtggtaacgatggagtgacttactcatcggcctgtcacctgaggaaggcaacttgccttctggggaggtcgatcggacttgcatatgaaggaaagtgcattaaagccaaatcctgcgaggatattcaatgtaccggcggaaaaaagtgtctgtgggatttcaaagtgggacgcggaagatgctcgctttgcgacgagctttgtcctgattcgaagtcagacgaaccggtctgtgcgtcagacaacgcaacgtacgcgagcgaatgcgctatgaaggaagcagcttgctcgagcggggtgctcctggaagtgaagcattccggatcgtgcaattctatttcggaggacaccgaggaagaagaggaagatgaagatcaagactactcatttcccatatcaagcattcttgagtgg

SEQ ID NO: 250081 - DNA, 1032 bp, Artificial Sequence
  Description of Artificial Sequence: Synthetic coding sequence
atggtgcgtgcgcgtcatcaaccggggggactttgtctgttgctgctgctcctgtgtcagtttatggaagataggagcgcgcaagcgggtaattgctggctgcgccaggcgaagaacggtagatgccaagtcttgtacaaaactgagctttccaaggaggagtgctgctccaccggacgtctctccacctcgtggactgaagaggacgtcaacgataacaccctgtttaagtggatgatctttaatggaggggcaccaaattgcattccatgtaaggaaacttgtgaaaacgtcgattgtggtccagggaagaaatgtagaatgaataagaaaaacaaaccacgatgcgtctgcgcacccgactgtagcaacatcacctggaaaggtccggtgtgtggcctcgatggaaagacctacaggaatgaatgcgcacttttgaaggcccggtgtaaagaacaaccagaactggaagtccagtaccaaggccggtgtaagaaaacttgtagggacgtgttttgccctggatcgtccacctgcgtggtggatcagactaacaacgcatactgtgtgacgtgcaatcgcatttgccctgaacctgcatcatctgagcaatacctctgtggcaacgatggcgtaacttactcgtcggcatgccaccttcggaaggcaacctgtcttttgggacgctcgatcggcctggcttacgaagggaagtgcatcaaggcgaaatcatgcgaagatatccagtgcaccggaggaaagaagtgtctctgggatttcaaggtggggagaggacggtgttcactgtgcgatgagctgtgtccggatagcaagtcagacgaaccagtgtgtgcatcggacaacgcaacctacgcgtctgagtgtgcaatgaaggaagcagcgtgctcctcaggggttcttctggaagtgaaacattcaggcagctgtaattcgatttcggaagatactgaagaagaggaggaagatgaagatcaggactattcgtttccaatatcctcgattcttgaatgg

SEQ ID NO: 250082 - DNA, 1032 bp, Artificial Sequence
  Description of Artificial Sequence: Synthetic coding sequence
atggtgagagcaagacatcagcctggcggactttgcctgctgttgctgctattgtgccagtttatggaagacagatccgcccaggccgggaactgctggctgcgccaggccaaaaatggccggtgccaggttctgtacaagacggagttgtccaaggaggaatgctgttctaccggtcggttatccaccagctggacggaggaggacgtgaacgataataccctattcaagtggatgatatttaacggtggggctccgaactgtatcccttgcaaagagacctgcgagaatgtggattgtgggcccgggaaaaaatgccgcatgaacaaaaagaataagccccgttgtgtgtgcgccccggactgtagtaacataacttggaaaggtccagtgtgtgggctggatgggaagacctatcggaatgagtgcgctctgctgaaggcccgctgtaaggagcagcccgaacttgaggtgcaatatcaggggcgatgcaagaagacctgtcgggatgtgttctgccccggatccagtacctgtgtggtggaccagacaaataacgcatactgcgttacttgcaaccgaatctgccctgaacccgcatcctctgagcagtatctgtgtgggaacgacggcgtcacctatagctcggcctgccatctcaggaaagccacatgcctgctgggcagatcaattggattagcttacgagggcaagtgtatcaaggccaaaagttgcgaagacatacagtgtaccgggggtaagaaatgcctctgggatttcaaggtgggtcgagggcgttgcagcctgtgcgatgagctatgccccgacagcaaatctgatgaacccgtctgtgcatcagataacgctacttacgcatcagaatgtgctatgaaggaagccgcttgttcttctggagtattgctagaggttaagcactccggctcatgcaactctattagcgaggataccgaggaggaagaggaagatgaggaccaggactactctttccctatatcatcgatactggaatgg

SEQ ID NO: 250083 - DNA, 1032 bp, Artificial Sequence
  Description of Artificial Sequence: Synthetic coding sequence
atggtccgagcccggcaccagccaggtgggctgtgtctgcttctcctcttgctttgtcagttcatggaggaccgcagcgcacaggcgggcaattgttggctgagacaagccaagaacggaagatgccaagtcctctacaaaactgaactcagcaaggaggagtgttgcagcactggccggctgtcgacgtcatggactgaggaggacgtgaatgataacactcttttcaagtggatgatcttcaacggaggtgctcccaattgtatcccatgcaaggaaacctgtgagaacgtcgattgcggtccgggtaaaaagtgccgaatgaacaagaagaataaaccgcgctgcgtgtgcgccccagactgttctaatatcacttggaaggggcctgtctgcggattggacggcaagacgtacaggaacgagtgtgcgttgctcaaagcacgctgcaaggaacagccggagctggaggttcagtatcaaggccggtgcaaaaagacctgcagagacgtcttttgcccaggatcatccacctgtgtcgtggaccagaccaacaatgcgtactgcgtgacttgcaatcgcatctgtccggaacccgcgtcctccgaacagtacctgtgtggtaacgatggagtgacttactcgtcggcttgtcacctcaggaaggcgacctgcctcctgggcagatctatcggtctggcgtacgagggaaagtgcatcaaggccaagtcctgtgaagatatccagtgcacggggggaaagaaatgtctctgggactttaaggtcggacgcggacgatgcagcctttgtgatgaactctgcccggactccaagagcgatgaaccggtgtgcgcctctgataacgcaacttacgcctccgaatgcgcaatgaaggaagctgcctgctccagcggagtccttttggaagtgaaacattcaggatcctgcaactccatttccgaggacactgaggaggaagaagaggatgaggatcaggactactcgttcccaattagctccatcctggaatgg

SEQ ID NO: 250084 - DNA, 1032 bp, Artificial Sequence
  Description of Artificial Sequence: Synthetic coding sequence
atggtgcgcgccagacatcagcctggtgggctgtgcctcctcctactgttgctctgccaattcatggaggacaggagcgcacaagcaggaaactgctggcttaggcaggccaagaatgggcgatgtcaggtgttgtataaaaccgagctgagcaaggaggaatgctgtagtaccgggaggctgtcaacaagctggaccgaggaagacgtgaacgataacacccttttcaagtggatgatttttaacggcggcgctccaaactgcataccttgcaaggaaacttgcgagaacgtggactgtgggcccggcaagaagtgtagaatgaacaagaaaaacaagcctaggtgtgtgtgcgcccctgactgcagtaacatcacatggaaaggtcccgtgtgcggcctcgatgggaaaacctacagaaatgagtgcgctcttctgaaggccagatgtaaggagcagcccgagctcgaggttcagtaccaagggcgctgcaagaaaacgtgtagggacgtattctgcccgggttcgagtacctgtgtggtcgaccagacaaataatgcatactgtgtaacttgtaaccggatctgtcctgagccagccagcagtgagcaatatctctgcgggaatgatggagtgacctattcaagtgcatgccacctccgcaaggccacctgcctgctaggcaggagcattggactggcttatgagggaaaatgcataaaagccaagtcatgcgaagacatacagtgtacaggaggaaagaaatgcctctgggactttaaggtgggtcggggtagatgttccttatgcgacgaactgtgtccagatagcaagtctgacgagcctgtctgtgcaagtgacaacgccacctacgcgagcgagtgcgctatgaaggaggctgcctgcagttctggggtcctcctggaggtcaagcactcaggtagttgcaattccatcagtgaggataccgaagaggaggaggaagatgaagatcaggattattccttcccaatctcgtcaatcctggaatgg

SEQ ID NO: 250085 - DNA, 1032 bp, Artificial Sequence
  Description of Artificial Sequence: Synthetic coding sequence
atggtgcgagcacgtcaccaacctggaggtctttgcttgttgctgctcttgctttgtcaattcatggaagatagatcggctcaagcggggaactgttggctgcgccaagcgaaaaatggccggtgtcaggtgctgtacaaaaccgaactgtccaaggaagaatgctgttcgaccggacgtctgtctacctcttggactgaagaggacgtcaacgacaataccctctttaagtggatgatcttcaacggaggagctccaaactgcattccatgcaaggaaacctgtgagaacgtggattgcgggccaggaaaaaagtgtagaatgaacaaaaagaataagcccagatgtgtctgcgcgccggactgctccaatatcacttggaagggacctgtgtgtggcctcgatgggaaaacttaccgtaacgaatgtgctctgctcaaggcccggtgtaaagaacagcctgaactggaagtgcaatatcaaggtcggtgcaagaaaacttgtagagacgtgttttgtcccggatcgagcacctgcgttgtcgatcagaccaacaatgcatactgtgtgacttgcaaccgtatatgcccagagcctgcatcctcagagcaatacctttgcggtaacgatggtgtgacttattccagcgcatgccaccttcgaaaagcaacttgtctgctcggacgatccattggtcttgcctacgaaggaaaatgtataaaggcaaaatcatgtgaggatatccagtgtaccggtggaaagaagtgtttgtgggactttaaggtcggacgggggagatgctctctttgtgacgaactgtgtccagatagcaagagcgatgaacccgtctgtgcaagcgacaatgccacgtacgcatccgaatgtgcaatgaaagaggcagcctgctcctcaggtgtgttgcttgaggtgaaacactcgggatcctgtaactcgatttcggaagataccgaggaagaagaagaggacgaagatcaggattactccttcccgataagctcgatcctggaatgg

SEQ ID NO: 250086 - DNA, 1032 bp, Artificial Sequence
  Description of Artificial Sequence: Synthetic coding sequence
atggttcgagctcgacaccagccaggtggcctgtgcctgctccttctgctgttgtgtcagtttatggaggataggtcggcccaggcggggaactgctggctccggcaggccaagaatggtcgatgccaagtcttgtataagaccgaactgagtaaggaagaatgctgctcaaccggacgactgtctacatcatggactgaggaagacgtgaacgacaacaccttgtttaagtggatgatcttcaatggtggggcccccaactgtatcccttgtaaggaaacctgcgaaaatgttgattgtgggccaggtaaaaagtgcagaatgaacaagaaaaataagcctcgctgtgtctgtgccccagattgcagtaatattacatggaaaggacccgtgtgtggcttagacggcaagacataccggaacgagtgtgccctgttgaaagccaggtgcaaagagcagcccgagctagaggtacagtaccaggggaggtgtaagaagacgtgtagggacgtcttctgccctgggtcctctacatgtgtcgttgatcagacaaacaatgcttattgtgtgacatgcaaccggatttgtcctgaaccggcctccagcgagcagtatctttgcggaaacgatggcgttacttattcgtctgcttgccatctgcgaaaggcaacatgcctgctcgggaggagcatcgggctggcttatgaaggcaagtgcatcaaggctaaaagctgtgaagatatacagtgcacgggagggaagaagtgcctatgggacttcaaagttggcagggggcgatgttctctgtgtgacgagctctgtccagattcaaaatcagatgagccagtctgcgcgagtgataatgcaacctatgcctccgaatgcgccatgaaagaggcggcctgtagcagtggcgttttgctggaagtgaaacactccggatcttgcaattccatatcggaagacacagaagaagaagaagaggatgaggaccaagattatagctttcccatatctagcattttggagtgg

SEQ ID NO: 250087 - DNA, 1032 bp, Artificial Sequence
  Description of Artificial Sequence: Synthetic coding sequence
atggtgcgggcgagacatcagccgggtggactctgcctcttgctgctgctgctctgtcaattcatggaagacaggtcggcccaggccggaaactgctggctgcgccaagcaaagaacggccgctgccaggtgctgtacaagactgagctgtctaaggaggaatgttgtagcacgggaagactctcaacctcatggactgaggaggatgtcaatgacaacactctcttcaagtggatgatcttcaacggaggggccccaaactgcatcccatgtaaagaaacctgtgaaaatgtcgactgcggaccgggcaagaaatgtcgcatgaacaagaagaacaaaccgcgctgcgtgtgtgcccctgactgctcgaacatcacgtggaagggaccggtgtgcgggttggatggtaagacctaccggaacgagtgcgcgctgctgaaagcccgctgcaaggagcaacctgaactggaagttcagtaccagggccggtgcaagaaaacttgccgggacgtgttctgcccgggctcgtccacgtgcgtggtggaccagaccaacaatgcctactgtgtgacttgcaatcggatctgcccagagccggcgtcgtcggagcaatatttgtgtggaaacgacggagtgacctactcatcggcgtgccacttgcggaaagccacgtgtctcctgggacggtccatcggccttgcgtacgagggaaagtgtatcaaggcaaaatcgtgtgaggacattcagtgcactggaggaaaaaagtgcctgtgggatttcaaggtgggcagaggaagatgttccctgtgcgatgagctgtgtccggatagcaagagtgatgagcctgtgtgcgcgtcagataatgccacctacgcttcggaatgcgctatgaaggaggcggcctgctcgtccggggtcctcctggaggtgaagcactccggctcgtgcaattcgatctcagaagatactgaagaagaggaggaagacgaagatcaggactacagcttcccgatctcctccattctcgagtgg

SEQ ID NO: 250088 - DNA, 1032 bp, Artificial Sequence
  Description of Artificial Sequence: Synthetic coding sequence
atggtgagagccaggcatcagccgggaggcctctgtcttctgctcctgcttctctgtcaatttatggaggaccgctccgctcaagctgggaactgttggctgcgccaagcaaagaatgggagatgtcaggtgctctataaaactgagcttagtaaggaggaatgttgtagcaccggaaggctgtccacctcttggacagaggaggacgtgaatgacaatactttgtttaaatggatgatcttcaatgggggtgctcccaattgtataccatgtaaggaaacatgtgaaaacgtggattgcggcccgggcaaaaaatgtcggatgaacaagaaaaataaacctaggtgcgtttgtgcccccgattgctctaacattacttggaaagggccagtgtgtgggcttgatggtaaaacctaccgaaacgagtgcgcattgctgaaggctaggtgcaaagagcagccggaactcgaagtgcagtaccagggacgctgcaaaaagacttgtcgggacgtcttctgccccggaagctccacctgcgtggttgatcagactaataatgcctactgcgtgacttgcaaccggatctgtcctgagcctgctagttccgagcagtacctctgcggaaatgacggagtgacctattcttccgcctgtcacctgcgaaaggccacctgcctgctggggcggagcatcggtctcgcctacgagggcaagtgcatcaaggccaagtcctgtgaggatatccagtgcactggaggcaagaagtgcctctgggacttcaaggtaggccgcggtaggtgttctttgtgcgacgagctgtgcccggatagtaaatctgatgagccagtttgcgccagtgataatgccacctacgcgagtgagtgcgctatgaaggaggctgcctgtagttcaggagtgctcctggaggttaagcattcaggtagctgtaactccatctctgaagataccgaagaggaggaagaggacgaggaccaggactattcttttcccattagctctatcctcgagtgg

SEQ ID NO: 250089 - DNA, 1032 bp, Artificial Sequence
  Description of Artificial Sequence: Synthetic coding sequence
atggtgcgcgccagacaccagccgggcggcttatgtttactcctgctattgctgtgtcagttcatggaagatcgttccgcacaggctggcaactgttggctcaggcaggcaaagaacggcaggtgccaagtgttatataagactgagctgagtaaagaagagtgttgctccacggggcggctgtcaacttcctggacagaagaggacgtgaatgataacacactcttcaagtggatgatatttaatggcggggccccaaattgcattccatgtaaagaaacctgtgagaatgttgactgcgggcctgggaaaaagtgtaggatgaacaaaaaaaacaagcctcgttgcgtctgcgcacctgattgttccaatatcacatggaagggccctgtgtgcggcctcgatgggaagacataccgcaacgaatgtgcgttactgaaggccaggtgtaaagagcaacccgagttggaggtacagtaccagggacggtgtaagaagacctgtcgggacgtcttttgccccggcagcagtacatgtgtagttgatcagaccaacaacgcttactgtgttacctgcaaccgcatctgccccgaacctgctagctctgagcagtacctatgtgggaacgatggcgttacctactcctccgcctgccaccttaggaaagcaacatgcctcctgggtaggtccatcggcctcgcttatgagggaaaatgtataaaagccaagagctgcgaggacattcagtgcaccgggggaaagaagtgtctgtgggattttaaggtcgggcggggtcgctgcagcctctgtgacgagctatgccccgattcaaagtcagacgaacccgtgtgcgcgtcagacaacgcaacctacgcctccgagtgcgccatgaaggaggctgcctgtagttcaggcgttctccttgaggtcaaacacagcgggtcctgcaattcaattagcgaagacaccgaagaggaggaggaggacgaagaccaggattattcatttccaatatcttcaattctcgaatgg

SEQ ID NO: 250090 - DNA, 1032 bp, Artificial Sequence
  Description of Artificial Sequence: Synthetic coding sequence
atggtgcgcgctaggcatcaaccaggaggactctgtctccttctcttgcttctgtgtcagtttatggaggataggagcgcacaggcaggcaactgttggttaaggcaggctaagaatgggaggtgtcaagtcctttacaaaacagaactttccaaggaggaatgctgtagcaccggtagactcagcacgtcttggacagaggaggacgtgaacgacaacactctttttaagtggatgatctttaacggaggagcccctaactgtattccctgcaaggaaacttgcgaaaacgtcgactgtggcccgggtaaaaagtgccgtatgaataagaaaaataagcctaggtgtgtttgcgctcccgactgtagtaacatcacatggaaggggccagtgtgcggactggatgggaaaacatataggaacgaatgcgcccttcttaaagcaagatgcaaggaacagcctgagttggaagtgcaatatcagggcagatgcaaaaagacatgcagggatgttttctgccctggcagctccacctgcgtggttgaccagactaacaatgcgtattgcgtgacctgcaatcgaatctgtcctgaacctgcttctagcgaacagtacctgtgcggcaatgacggagtgacctatagtagtgcctgtcacttgcgcaaagcaacctgcctgctgggccgatctattgggctcgcttacgagggaaaatgtatcaaggccaaatcatgcgaggacatccaatgcaccggaggaaagaagtgcctttgggactttaaagtgggccggggcagatgctcactttgtgacgagttgtgcccagattctaagagtgatgagccagtgtgtgcaagtgataatgctacatacgcctccgaatgtgcaatgaaggaggcagcctgctccagcggcgtcctgctcgaggttaagcactctgggagctgtaactcaatctctgaggacaccgaagaagaggaggaggatgaggaccaagactattctttccctatctcctccattctggaatgg

SEQ ID NO: 250091 - DNA, 1032 bp, Artificial Sequence
  Description of Artificial Sequence: Synthetic coding sequence
atggttcgcgctcggcaccaacctggaggcctctgtctgcttctcctcctgctgtgccagtttatggaagatagaagcgcgcaggcaggtaattgctggctccgacaggcgaaaaatggacggtgccaagttctgtataaaacggagctgagcaaagaagaatgctgttcaactggacggctctccacctcttggacggaagaggacgttaacgacaacaccctattcaaatggatgatcttcaacgggggcgccccaaactgcattccttgtaaagagacttgtgaaaacgtggactgtgggcctggtaaaaagtgccggatgaacaagaaaaacaaaccgcgctgcgtatgtgctcctgattgttccaatatcacatggaaaggcccggtgtgtgggctggacggaaaaacatacagaaacgagtgtgctcttctgaaagcccgctgcaaagagcaacctgaactggaggtgcagtatcagggaagatgcaagaaaacgtgcagggatgtgttctgcccgggtagtagcacctgcgtggtagaccagactaataatgcctactgcgtgacctgtaacagaatctgccccgagcctgcctcatctgagcagtacctctgtgggaacgatggagtcacctactcttctgcctgccacctgcggaaagccacatgcttgttgggccgtagcattggcctcgcctatgagggcaaatgcatcaaagctaagagttgcgaggatattcagtgtacgggaggaaagaagtgcctgtgggattttaaagtcgggcgggggcggtgtagcttgtgcgacgaactgtgccccgatagcaagtctgatgaacccgtgtgtgcctcagacaacgcgacatacgcctcggagtgtgctatgaaggaggcagcttgcagttctggcgtgctgttggaggtaaagcattccgggtcatgtaactctatcagtgaagataccgaagaggaggaggaggacgaagatcaggattactcatttcctattagctctattcttgaatgg

SEQ ID NO: 250092 - DNA, 1032 bp, Artificial Sequence
  Description of Artificial Sequence: Synthetic coding sequence
atggtgcgggccaggcaccaacccggcggcctgtgcctgctcttgttgttgctctgtcagtttatggaggatcgcagtgcccaggctggaaactgctggctgcgccaggctaaaaatggccgatgccaggttctgtataagaccgaactcagtaaggaagagtgctgctcaacggggcgcttgtctacatcttggaccgaggaggatgttaacgataacaccctgtttaaatggatgatcttcaacggcggcgcgcccaactgtataccttgcaaggaaacatgcgaaaacgtcgactgtggtcccggtaaaaaatgtcggatgaataagaaaaacaagccccggtgcgtgtgcgcgcctgattgctctaacatcacatggaaagggcccgtgtgcggactagatggcaagacctaccgtaacgagtgcgcgttgcttaaggcacgctgcaaggagcagcctgagctcgaggtccagtaccaagggcggtgcaaaaaaacatgccgggacgttttttgccccggctctagcacctgtgtcgtcgaccaaaccaacaacgcatattgcgtaacttgtaacaggatctgtccggaacctgcaagttctgaacaatacctgtgcgggaacgacggagtgacctacagctcagcatgtcatctccggaaagcaacctgtctgctggggcgtagtatcggattagcgtatgagggcaaatgcatcaaggcaaagagctgcgaggacattcaatgtaccggaggcaagaagtgtctatgggacttcaaggttggcaggggtcgatgctccttgtgtgacgagctctgccctgactccaaatccgatgagccagtctgtgccagcgataacgcgacctacgcctccgaatgcgccatgaaggaagctgcctgctcgtccggggtactcctcgaggtcaagcacagtggcagttgcaattcaatctccgaagatacagaggaagaggaagaggacgaggatcaggattactccttccctatctcctcaatcctggagtgg

SEQ ID NO: 250093 - DNA, 1032 bp, Artificial Sequence
  Description of Artificial Sequence: Synthetic coding sequence
atggtccgggcgaggcaccaaccaggcggactctgcctgctccttctgctcctgtgtcagttcatggaggacagatccgctcaggccgggaactgttggctgcggcaggcaaaaaacggccgctgccaggtgctgtataagaccgaactttcaaaggaagagtgctgctcgaccgggcggctatctaccagttggaccgaggaggatgttaacgacaatacactgttcaagtggatgatctttaatgggggggcgcctaattgtataccatgcaaagaaacatgcgagaatgtggactgtggtcccggcaagaaatgcaggatgaacaaaaagaacaagccgaggtgcgtgtgtgcccctgactgcagtaacataacctggaaaggtcctgtgtgcggactcgatggaaagacgtaccgcaacgaatgcgcactgttaaaagctaggtgtaaggaacagccagaattagaggttcaataccaagggaggtgcaaaaagacatgtagggatgtgttttgccctggctcgtcaacatgcgtagtagaccagacaaataacgcctattgtgtcacctgtaataggatttgtccggaacccgcttcttcagagcaatacctttgcggcaacgacggggttacatactccagtgcatgtcatttgaggaaggccacatgtctgttggggagatccatcgggttagcttacgagggcaaatgcatcaaggccaaaagttgtgaagatatccagtgtacagggggtaagaagtgtctttgggatttcaaggttggtagaggtcggtgctccctgtgcgacgagttgtgccctgactccaaatccgatgagccagtgtgcgcatcagataatgcgacctacgccagcgaatgtgccatgaaggaggcggcatgtagttcaggcgttcttcttgaagtcaaacatagtggttcgtgtaatagcatcagtgaagacaccgaagaagaggaggaggacgaagaccaggattactcctttcctatcagcagtatcctagagtgg

SEQ ID NO: 250094 - DNA, 1032 bp, Artificial Sequence; identical to SEQ ID NO: 250012
  Description of Artificial Sequence: Synthetic coding sequence

SEQ ID NO: 250095 - DNA, 1032 bp, Artificial Sequence
  Description of Artificial Sequence: Synthetic coding sequence
atggtgagggcgcgacatcagccaggtggactttgcctgctgcttcttttgctgtgtcagtttatggaggaccgtagcgctcaggctgggaactgttggttgcgccaggcaaaaaacggccgttgtcaggtgctgtacaagaccgaactttccaaagaagagtgttgttccactggtcgactttcgactagctggactgaagaagatgtcaacgataacacgctgtttaagtggatgattttcaacggaggtgcaccaaattgtattccatgtaaagaaacctgcgagaacgtggattgcggtccgggaaagaagtgtagaatgaataagaagaacaagcctcgctgtgtgtgtgcgccagattgttcgaacataacctggaagggtccggtgtgcgggctggacggcaagacgtaccgcaatgaatgcgccctcctcaaggcaagatgtaaggaacaaccagaactggaggtgcaatatcagggaagatgtaaaaagacttgtagggacgtgttttgtcccgggagctccacctgcgtggtggaccaaaccaataatgcctactgcgtcacctgtaatcgcatttgtccagagcctgcatcgtcagagcagtacctgtgcggtaatgacggtgtgacctactcgagcgcgtgccacttgagaaaggccacttgtctgctcggccggagcattggcctcgcttacgaaggaaagtgtatcaaggccaagtcgtgtgaggatatacaatgtaccggcggcaagaagtgtctctgggatttcaaggtggggagaggaagatgctccctgtgtgacgaactctgtccggatagcaaaagcgacgaacctgtctgtgcatccgacaacgcaacttacgcatcagaatgtgcaatgaaggaagccgcttgttcctccggcgtgcttctcgaagtgaagcattcaggatcctgtaattcgatttcggaagatactgaggaagaagaagaggacgaggatcaagactacagcttcccaatttcgtcgattctcgaatgg

SEQ ID NO: 250096 - DNA, 1032 bp, Artificial Sequence
  Description of Artificial Sequence: Synthetic coding sequence
atggtaagggctcggcatcagccgggtggactctgtctcctgctgctactcttgtgccagttcatggaagaccgatctgcgcaggcgggcaactgctggctccgacaggccaagaacggtcgctgccaagtcctatacaagaccgaactgtccaaggaagaatgctgcagcacaggtaggctttcgactagctggactgaagaggacgtcaatgacaacacgttgttcaagtggatgatctttaacgggggtgcccctaactgtataccctgcaaggaaacgtgcgagaacgtcgattgcggtccaggcaagaagtgtagaatgaataaaaagaataagcctcgttgcgtttgtgcccccgattgttctaacatcacctggaaaggcccggtctgcggtttggacggtaagacctatcgaaatgagtgtgccctactcaaagcgcgctgtaaggagcaaccagagcttgaagtccagtaccaggggagatgcaagaaaacatgccgcgacgtgttctgcccaggaagtagcacatgcgtggttgatcaaactaacaacgcctactgtgtcacctgcaatcgtatctgtccagagcctgcctcctccgagcagtacttgtgcggcaacgacggtgtaacgtattctagcgcctgccacctgcggaaagccacctgcttgttgggccgctctatcgggttggcttatgagggaaagtgcatcaaggccaagagctgcgaggatatccagtgcaccggcggaaagaaatgcttgtgggatttcaaggttggccgtggacgctgtagcctatgcgacgagctctgcccggactccaagtctgacgagccggtatgcgcaagtgacaacgcgacctatgcctcagagtgcgccatgaaggaggctgcgtgttcctccggtgttctgctggaggtcaagcactctggaagttgtaattctatcagtgaggatacagaggaggaggaggaggatgaggaccaggattactccttccccatttcttccatccttgagtgg

SEQ ID NO: 250097 - DNA, 1032 bp, Artificial Sequence
  Description of Artificial Sequence: Synthetic coding sequence
atggtacgagcacggcaccagcctggcggtctttgccttctcctgctgctgttatgccaatttatggaagatcggtcagcacaagccggcaactgttggctgcggcaagctaaaaacggccggtgccaagtgctgtataagactgagctgtcgaaggaagagtgctgttctaccggccgactgagcacgtcttggacagaagaggacgtgaacgataacacactattcaaatggatgatttttaacggaggtgcgcccaattgcattccttgtaaggagacctgcgagaacgtggattgcggtccgggtaagaagtgcagaatgaacaagaagaataaacccaggtgcgtatgcgctccagattgcagtaatattacatggaagggacccgtatgtggcttagacggtaagacatatcggaacgagtgcgcattactcaaggcaaggtgcaaagaacagccagaactggaagtccaataccagggcagatgcaagaagacttgcagggacgtgttctgccccgggtcgtccacatgtgtagtggaccagactaacaacgcttactgtgttacttgtaatcgcatttgtcctgaacctgccagctcagaacagtatctttgtgggaatgacggagtcacatactcgagcgcttgccatctcaggaaagcaacctgcctgttggggaggtcaatcgggcttgcctacgaaggtaagtgtatcaaagcgaaatcctgcgaggatatccagtgcacaggagggaagaagtgtctgtgggattttaaagtagggcgggggagatgcagtctgtgcgacgaattgtgtccagactcgaaatcagatgagccagtatgcgctagcgataacgccacgtatgcttctgagtgtgcaatgaaagaagcggcctgcagcagtggggttctgctggaggtcaagcactcgggatcatgcaattcgatcagtgaggatactgaagaagaagaagaggatgaggatcaagactactcctttcccatttcatctatcctggaatgg

SEQ ID NO: 250098 - DNA, 1032 bp, Artificial Sequence
  Description of Artificial Sequence: Synthetic coding sequence
atggtgcgggcccgccaccagccaggtggactgtgcctcctgctgctgctactgtgccagttcatggaggatcgcagcgcacaggcgggcaactgttggctgcgccaagccaaaaatggccgatgtcaagtcctgtacaagaccgagctgtctaaggaggagtgttgttcgacaggacggctgagcacgtcctggaccgaggaggatgtcaatgataataccttgttcaaatggatgatcttcaatggtggtgcgccaaattgtattccatgcaaagagacctgcgaaaacgtggactgcggtccaggcaagaagtgccgtatgaataagaagaacaagccacgttgtgtgtgtgccccggattgcagcaatatcacttggaaaggtcctgtgtgtggcctggatgggaagacttaccgcaatgagtgtgcgctgttgaaagcacgctgcaaggaacagccggagctggaggttcaatatcaaggtcgttgtaaaaagacctgccgggacgttttttgcccgggttctagtacctgtgtagtggaccagaccaataacgcgtactgcgtgacgtgcaatcgcatttgcccggaaccggcctcctcagaacaatatctgtgcggtaatgacggtgtcacttattcttccgcgtgccatctgaggaaagcgacgtgcctgctgggcaggagcattggtctggcctatgaaggcaagtgcatcaaggccaagtcttgcgaagatatccaatgtaccggtggtaagaagtgcctgtgggattttaaggttggtcgggggcgttgtagcctgtgcgacgagctgtgcccggatagcaagtcggacgagcccgtctgcgcctctgacaatgcgacctatgcaagtgagtgcgctatgaaggaggctgcatgttcctctggagtgcttctggaggtgaaacacagcggcagctgcaacagcatcagcgaagacaccgaggaggaggaagaagacgaggatcaggattatagcttcccgatcagcagcatactagagtgg

SEQ ID NO: 250099 - DNA, 1032 bp, Artificial Sequence
  Description of Artificial Sequence: Synthetic coding sequence
atggtgcgagcaaggcatcagcccggagggttgtgccttctgctcctgttgctgtgtcagttcatggaagacaggtcagctcaggcaggtaattgttggttacgacaagccaagaatggccgctgccaagttctctacaaaacagaattgtccaaagaggaatgctgcagcacaggtaggctttccacctcttggaccgaagaggatgtaaacgacaacactcttttcaagtggatgatttttaacggtggggctccaaactgcattccctgcaaggagacatgtgagaatgtggactgcggcccggggaagaaatgccgcatgaacaaaaaaaacaaaccacgctgtgtgtgcgccccagattgctccaacataacctggaagggaccagtgtgtggcctggacggaaagacataccggaacgaatgcgctctcctgaaggccaggtgcaaagaacaacccgaattggaagtgcaatatcaggggcgttgcaaaaaaacttgcagggatgttttctgtccaggcagctccacttgcgtagtggatcagacgaacaatgcatattgcgtcacctgcaaccgcatctgccccgagcccgcttcctccgaacagtatctctgtggcaacgacggggttacctactctagcgcatgccacctgagaaaagccacgtgtttgctgggccggtccattggcctagcatatgagggtaagtgcatcaaggctaagtcctgcgaagacatccagtgtaccggcggaaagaagtgcctgtgggacttcaaggttgggagaggacgttgcagcctttgtgacgagctgtgtcctgatagcaagtctgacgaacccgtctgcgctagcgacaacgctacatacgcgtctgaatgcgcgatgaaggaggccgcatgtagttctggcgtgctgctcgaggtgaaacacagtggatcttgcaactccattagcgaagatactgaagaagaagaggaagatgaggaccaggactactccttccctatctcatctatcctcgagtgg

SEQ ID NO: 250100 - DNA, 1032 bp, Artificial Sequence
  Description of Artificial Sequence: Synthetic coding sequence
atggtgagggctcggcatcagccgggcggcctgtgcttactgttgctgcttctttgtcaattcatggaggacagaagcgctcaagccggcaactgctggctgaggcaagccaaaaacggtcggtgtcaagtgttgtacaaaactgagctgagcaaagaggaatgttgttctaccggccgactttctacctcctggaccgaggaagacgtcaacgacaacactctgttcaaatggatgattttcaatggcggagccccaaactgtatcccatgcaaagagacttgtgaaaacgtcgattgcggcccaggaaagaaatgtcggatgaacaaaaaaaacaagcctagatgcgtttgtgcccccgactgttctaacataacatggaaaggaccggtgtgtgggcttgatgggaagacctacagaaacgagtgtgcacttctgaaggcccgctgcaaggagcagccagagctcgaagtgcagtatcagggacgctgcaagaaaacatgccgggatgtcttctgccctggcagcagcacatgcgttgttgaccagacaaacaacgcctattgcgttacctgcaacaggatctgccccgagccagcttcctcggagcagtatttgtgtggcaatgatggggtgacctacagctccgcctgccatctccgtaaagctacctgcctgctcggcaggtctattgggctcgcatatgaaggaaagtgtataaaagccaagtcatgtgaagatatacagtgcaccggaggaaagaagtgtttgtgggatttcaaagtgggaagagggcgatgcagcttgtgcgacgagctgtgccccgattcaaaatcggacgagcccgtttgtgctagtgataacgccacctacgcgagcgagtgtgcaatgaaagaggccgcttgcagctctggcgtgctgttggaggtgaaacactccggatcttgtaactccatctctgaagacactgaggaggaggaagaagatgaggatcaggactactcatttcctatctcaagcattctcgagtgg

SEQ ID NO: 250101 - DNA, 1032 bp, Artificial Sequence
  Description of Artificial Sequence: Synthetic coding sequence
atggtgcgcgcaagacaccaaccaggaggtctctgtctgctgctactcctcctttgtcagtttatggaggacaggtccgcccaggcaggaaactgctggctccgccaggccaaaaacggccggtgccaagtcctttataagaccgagttgtcaaaggaagaatgttgcagtactggaaggctttctaccagctggacagaagaagacgtgaacgacaacactctgtttaagtggatgatcttcaacggaggcgcccctaattgtatcccttgcaaagaaacctgcgagaacgttgattgtggtcctggcaagaagtgtcgtatgaacaagaaaaacaaaccgcgctgcgtgtgcgctcctgactgttctaacattacgtggaaaggaccagtgtgcggactggacggaaaaacttaccggaatgaatgcgcactgctgaaggctaggtgcaaggagcagcctgaactagaggtccagtaccaaggaagatgcaagaaaacatgcagggatgttttttgtccaggctcttccacctgtgtagtggaccagacaaacaatgcttactgtgtcacatgcaaccgtatctgccccgagcctgctagcagcgagcaatatctatgcggcaacgatggggtaacttacagtagcgcttgtcacttgcggaaggcaacctgtctacttggccggagcattggcttagcatatgaaggcaaatgcattaaagcaaagagctgcgaagacatccaatgtaccggggggaaaaagtgtctttgggactttaaagtgggtaggggcagatgttccctgtgtgatgaattgtgtccagatagcaagtctgatgagccagtgtgtgcctctgacaacgctacttacgcctctgaatgtgctatgaaagaagctgcttgcagtagtggcgttctgctcgaagtgaaacattccggtagctgtaactccatcagcgaagatacggaggaagaagaagaagacgaggaccaggactactcctttccaatctcatcaatcctggagtgg

SEQ ID NO: 250102 - DNA, 1032 bp, Artificial Sequence
  Description of Artificial Sequence: Synthetic coding sequence
atggtacgagccagacatcaacccggcggcctgtgtctcctgctcctcctgctgtgccagttcatggaagaccgatctgcccaggcggggaactgctggttgcgtcaagctaaaaacggccggtgtcaggtcttgtataagaccgagctgtcaaaagaggagtgttgctcaaccgggcggctgtccacatcctggaccgaggaggatgtgaacgataacacactctttaagtggatgatctttaatggtggcgccccaaattgcatcccctgtaaggagacatgcgagaatgtcgattgtggacctggaaagaagtgcaggatgaataagaaaaacaagccccggtgcgtttgtgctcccgattgctccaacattacatggaagggccccgtctgcggcctggatggaaagacctataggaatgaatgtgcccttttgaaggcgcgttgtaaagaacagcccgagcttgaggtgcagtaccaagggagatgtaagaagacatgtcgcgacgttttctgcccgggctcttctacctgtgtggtggatcagaccaataatgcatactgtgtgacctgtaaccgcatctgcccagagcccgcatcttcagaacagtacctgtgtggcaatgacggtgtgacgtattctagcgcctgccaccttagaaaggccacttgtctgctgggcagatccatcggcttggcctatgagggaaagtgcattaaggctaagtcatgcgaagacatccagtgcacgggtggcaaaaagtgcctgtgggacttcaaggtgggtaggggacgatgttccttatgcgacgaactgtgccccgacagtaaatccgacgaaccagtatgtgccagtgataacgcgacatacgcttctgagtgtgcaatgaaagaggctgcatgtagctcaggcgtgcttcttgaggtgaagcattcgggtagctgcaattccatcagtgaggacacggaggaggaggaagaggatgaagaccaagactactcgtttcctatctcaagtatactggagtgg

SEQ ID NO: 250103 - DNA, 1032 bp, Artificial Sequence
  Description of Artificial Sequence: Synthetic coding sequence
atggtgagagcccgccatcagcccggcggcctgtgcttgctcctcttgctgctttgtcagtttatggaggatagaagtgcccaggctgggaactgttggctgcggcaggccaagaatggtcggtgccaggtcctgtataagacagaactttccaaagaagagtgctgcagcacaggtaggctcagcactagctggactgaagaggatgtcaatgacaatacactcttcaaatggatgattttcaacgggggcgcccctaattgtattccatgtaaggagacttgcgagaacgtagactgcgggcctggaaagaaatgccggatgaataagaagaataaacctaggtgtgtctgtgcgcccgattgctcaaacataacgtggaagggccccgtctgcggcctcgatgggaagacttacaggaatgaatgcgctctgctcaaagcaaggtgcaaggaacaaccggagcttgaagtacagtatcaaggtcgatgcaagaaaacttgtagggacgttttttgccccggcagcagcacctgcgttgttgaccagactaacaacgcgtactgcgttacctgcaatcgaatctgtccggaaccggccagcagcgagcagtacctgtgcggcaacgacggcgtgacctacagcagcgcttgccatcttaggaaggcgacttgccttctcggacgctcaataggcctcgcgtacgagggaaagtgtataaaggcaaaatcctgtgaggatatccagtgcaccgggggtaagaaatgtctgtgggatttcaaggtgggccggggccggtgcagtctttgtgacgagctttgtcctgattccaaaagcgacgagcctgtctgcgctagtgacaacgctacctacgcgtccgagtgcgcaatgaaagaggcagcatgcagttccggtgtgctgctcgaggtcaaacattcagggagctgtaactctattagcgaggatacagaggaagaagaggaggatgaagaccaggactacagctttcctatctcatcaattctggagtgg

SEQ ID NO: 250104 - DNA, 1032 bp, Artificial Sequence
  Description of Artificial Sequence: Synthetic coding sequence
atggttagagccaggcatcagcccggaggactgtgtctgctgctgctcctgctatgccaattcatggaagataggtctgctcaggccgggaactgttggctaagacaggctaaaaacggccgctgccaggtgctatataagaccgaactgtctaaagaggagtgttgctcaaccggcagattgtctactagttggactgaagaagatgtcaatgataacacattgttcaaatggatgatcttcaacggaggagctccgaattgcataccttgcaaagagacatgtgaaaacgttgattgtggccccggtaagaagtgccggatgaacaagaaaaacaagccgcgatgcgtgtgcgcacccgactgttccaacatcacatggaaaggacctgtgtgtggtctggatggaaaaacctacagaaacgaatgcgcattgcttaaggccaggtgcaaggaacagccggagctggaggttcagtatcagggaaggtgtaagaaaacttgtcgtgacgtgttctgcccaggttcgagcacatgtgtggtggatcagacaaacaatgcgtactgcgtaacatgtaatcgtatttgccctgagccggcaagttccgagcagtacttatgtggaaacgacggggtgacctactcctccgcatgccatctgaggaaggcaacatgcctgttgggacgcagcattggacttgcgtacgaggggaaatgcatcaaagcaaaatcctgcgaggatatccagtgcaccggaggaaagaagtgcttgtgggacttcaaagttggcaggggccgctgttcactctgcgatgaattgtgtcctgattctaagtccgacgagccggtgtgcgcctccgataatgccacttatgcctccgaatgtgctatgaaggaggcggcatgctcctctggagtccttctggaagtaaagcatagtggttcctgcaattccatctcagaagatacagaagaggaagaggaggacgaggatcaagattactcctttccaatctcgtccatactggaatgg

SEQ ID NO: 250105 - DNA, 1032 bp, Artificial Sequence
  Description of Artificial Sequence: Synthetic coding sequence
atggtccgcgcacggcaccagcctggtggtctttgtttgttgctgttgcttctctgccagtttatggaggaccgctcggcccaggcggggaattgttggctgagacaggcaaaaaacggcagatgccaggtgctgtacaaaaccgaactgtcaaaagaagaatgttgttccaccggacgactgtccacctcctggactgaagaggacgttaatgataacaccttgtttaagtggatgatctttaatggtggtgccccaaactgtatcccttgcaaggagacgtgtgagaacgtggattgcggaccgggtaaaaagtgtcgaatgaacaagaaaaacaagccccgctgtgtgtgtgccccggattgctcgaatatcacctggaagggacccgtctgtgggcttgacggtaagacgtacaggaacgaatgtgcgctgctgaaggcaagatgcaaggaacaacctgaacttgaagtccagtaccaagggcggtgtaaaaagacttgcagagatgtgttttgtcctggctcctcaacctgtgtggtggaccaaaccaataacgcctactgcgtcacgtgtaaccggatttgccctgagccagcgtccagcgagcaatacctgtgcggtaacgacggtgtgacttactcgtcggcgtgtcatttgcgaaaggcaacttgtctgctcgggcgatccattggtcttgcatacgagggaaagtgtatcaaagccaaaagctgtgaagatattcaatgcaccggcggcaaaaagtgtctgtgggatttcaaggtgggaagaggtagatgctcgctttgcgatgaactgtgccccgattctaagagcgatgagccagtttgtgcaagcgataacgcgacctacgcatcggaatgtgcaatgaaagaagcagcatgctcaagcggtgtgctgctggaggtgaagcatagcggatcatgtaacagcattagcgaggacacggaagaagaagaggaggatgaagatcaggattactcgttccctatctcgtccatattggaatgg

SEQ ID NO: 250106 - DNA, 1032 bp, Artificial Sequence
  Description of Artificial Sequence: Synthetic coding sequence
atggtgcgagccaggcatcagccaggtggcttgtgcctgctgctcctgttactctgtcaattcatggaggataggagcgcacaggccggcaactgctggctgaggcaggccaaaaacggcaggtgccaagtcttgtataagacagaactctctaaagaagagtgctgtagcacaggcaggctctctactagctggaccgaggaagatgtcaacgataacaccctcttcaagtggatgatattcaatggtggagcccccaactgtatcccttgtaaagagacatgcgaaaacgtagattgcggcccaggcaaaaaatgtcgtatgaataagaaaaacaagccacggtgcgtgtgcgctcccgattgctctaatatcacttggaaaggaccggtgtgtgggcttgacggcaaaacctataggaacgagtgtgccctgctgaaggccagatgtaaggagcaaccagaactggaggttcagtatcaggggagatgcaagaaaacttgtcgtgatgtcttctgtcctgggagttcaacctgcgttgtggaccaaacaaacaatgcatactgtgtgacctgcaaccggatatgtccagagccagcctcctctgagcaatacctctgtggtaacgatggcgtcacatactcgtccgcctgtcatctaaggaaggctacttgtctgttagggagaagtataggcttggcgtatgaggggaagtgtatcaaagctaaatcttgtgaggacattcaatgcacaggcgggaagaaatgtctatgggatttcaaagtggggagaggacgatgtagtctctgcgacgaactgtgtccggactcgaaatctgacgagcccgtgtgtgcctcagacaacgccacttatgcctccgagtgcgcgatgaaagaggcggcctgcagttctggagtgctcctcgaagtaaaacactctggttcctgcaactcgatctcagaagacaccgaggaggaagaagaggatgaagaccaggactattctttccccatctcgtcgatcctggaatgg

SEQ ID NO: 250107 - DNA, 1032 bp, Artificial Sequence; identical to SEQ ID NO: 250082
  Description of Artificial Sequence: Synthetic coding sequence

SEQ ID NO: 250108 - DNA, 1032 bp, Artificial Sequence
  Description of Artificial Sequence: Synthetic coding sequence
atggtgcgcgctcggcaccagccgggcggcctgtgtctgctgctcttgctcctgtgccaattcatggaggaccggtcggcacaagcagggaactgttggctgcggcaggccaaaaacggacgatgccaggtgctgtacaagactgaactgtccaaagaagaatgctgcagcaccggtcggctctctacctcctggaccgaggaagatgtgaacgacaataccctgtttaagtggatgattttcaatggaggggccccaaactgcatcccttgcaaggaaacgtgcgaaaacgtcgactgcggaccgggaaagaagtgcaggatgaacaagaagaataagccgcgctgtgtgtgcgcgcccgactgctccaatatcacttggaagggaccggtctgcgggctcgacggaaagacctaccgaaatgagtgcgccctgctgaaggcccgctgcaaggagcaacctgaattggaggtccaataccagggacggtgcaagaaaacttgtagagatgtgttctgtccaggctcatcgacttgcgtggtggatcagactaacaacgcatactgcgtgacttgcaacagaatctgcccggaaccagcttcatccgaacagtacctgtgcggcaacgacggagtgacctattcatcggcctgtcatcttcgcaaggccacttgcttgctgggacggtccatcggactggcctacgaaggcaagtgcatcaaagccaagtcgtgcgaagatatccagtgcaccggaggcaagaagtgcctgtgggatttcaaagtggggcgcggcagatgctccctctgtgacgaactttgcccagattccaaaagcgacgagccggtctgcgcgtcggacaatgctacttacgcctccgaatgtgcgatgaaggaggccgcatgttcgagcggggtgctgctggaagtgaagcacagcggctcatgcaattccatctcggaagataccgaagaggaggaagaggatgaagatcaggattactcattcccgatttcgtccatcctcgaatgg

SEQ ID NO: 250109 - DNA, 1032 bp, Artificial Sequence
  Description of Artificial Sequence: Synthetic coding sequence
atggtgagagctcgacaccagcccgggggactttgccttttgctcctcctgctctgtcagttcatggaagaccggtctgcccaggcagggaattgctggctgagacaggctaaaaatggaaggtgtcaggttctctataaaactgaactgtcaaaagaagaatgctgctccactggaaggctttcaacttcctggacagaggaagatgtgaacgacaacacattatttaagtggatgatcttcaatggaggggctcccaactgcataccctgcaaagagacatgcgagaacgtggattgtggacctggaaaaaaatgccggatgaataaaaaaaataaaccccgatgcgtatgtgctcccgattgctcgaatattacttggaaagggcccgtttgcgggctcgatgggaaaacttatagaaatgaatgtgccctattgaaggccagatgcaaggaacagcccgaactggaggtccagtatcaggggcgatgtaaaaaaacttgtcgggatgtgttttgtcccgggtcttctacatgcgtagtggatcagactaacaatgcttactgtgttacatgtaaccgcatctgccccgagccagccagtagtgaacagtatctgtgtgggaacgatggagttacttactcttctgcctgtcaccttcgaaaggctacttgtctcctggggcggtctataggactagcctatgaggggaaatgtataaaagctaaatcttgtgaggatattcagtgcacaggggggaaaaaatgcctttgggactttaaagtaggaagaggacggtgttcattgtgcgacgagctatgccccgatagtaaatctgatgagcccgtctgtgcatcggataacgcaacatatgcctcagaatgtgctatgaaagaagctgcatgcagtagtggagtccttttagaagtgaaacattctggatcctgcaattccatctctgaagatacagaagaagaggaagaagatgaagatcaggactattcttttcctataagttcaatactagagtgg

SEQ ID NO: 250110 - DNA, 1032 bp, Artificial Sequence
  Description of Artificial Sequence: Synthetic coding sequence
atggtgcgggctaggcatcaacccggagggctctgcctcttgcttctgttactgtgccagttcatggaagaccggagcgctcaggcggggaactgttggctgagacaggcaaaaaatggaagatgccaagtgctgtacaaaaccgagctttctaaggaggagtgctgcagtaccgggagattgagcactagctggactgaggaggacgtcaatgacaacactctgttcaaatggatgatcttcaatgggggtgcaccaaattgtattccatgcaaagagacttgtgagaatgtagattgtggacctggtaagaagtgtcggatgaacaagaagaacaaacctagatgcgtctgcgcccctgattgttctaatatcacatggaaagggccagtctgtgggctcgatgggaaaacctataggaacgagtgtgccttgctgaaagcgcgctgcaaagagcaaccggaactggaagttcagtaccaggggaggtgcaaaaagacctgccgggacgtgttttgtccagggagctccacatgtgtggtggatcagacgaataacgcgtactgtgtaacatgtaatcgaatatgccccgagcctgcttcctcggaacagtacctctgtgggaacgacggcgtcacatatagctccgcatgccatctgcggaaggcaacatgtctcttaggtagatctattggactggcctatgaaggcaaatgtattaaggccaaaagctgtgaagatatccagtgcactggtggcaagaagtgtctgtgggacttcaaggtgggccgcgggcggtgcagcctgtgtgacgagctgtgtcccgactcaaagtcggacgaaccggtctgtgcgtcagacaatgcgacgtacgctagtgaatgtgctatgaaagaagctgcttgctcgtctggggttttgctagaggtgaaacattctggatcctgtaattcaatctcggaagataccgaggaggaggaggaggacgaggatcaagattactcgtttccaatctcaagcattctggagtgg

SEQ ID NO: 250111 - DNA, 1032 bp, Artificial Sequence
  Description of Artificial Sequence: Synthetic coding sequence
atggtgcgtgccaggcatcagccaggcggcttgtgtctccttctgctcctgctctgtcaattcatggaagatcgatcggcgcaagctggtaactgttggctcagacaggcgaagaacggacgctgtcaggtcctctacaagactgaactgtcgaaggaggaatgttgtagcaccggacgcctttccacctcctggaccgaagaggatgtgaatgataatacccttttcaagtggatgatctttaacggcggagcacctaactgtattccttgcaaagaaacttgcgaaaacgtggactgtggaccaggtaagaagtgtcgcatgaacaagaagaataagccacgatgtgtgtgcgcacctgactgctccaacattacctggaagggtcctgtgtgtggattggatggcaagacgtacagaaatgaatgtgcacttctgaaagcacgttgtaaggaacagccggaactggaagtgcaatatcaagggagatgtaaaaagacctgcagagatgtgttctgccctggttcatcgacttgtgtcgtcgaccagacgaataacgcatactgcgtgacttgcaaccggatctgcccagagccagcatcgagcgagcaatatctgtgtggaaacgacggagtcacttactcctcagcttgtcatctgcgaaaggccacttgtctcttgggccggtcgatcggcttggcgtacgaggggaaatgcatcaaagccaagagctgtgaggatatccagtgcaccggaggaaagaagtgtctgtgggatttcaaggtgggtagaggacgctgttctctgtgcgacgaactttgtcctgacagcaagtcggatgaacccgtgtgtgcgtcggacaatgcgacttacgccagcgaatgtgccatgaaagaggccgcttgcagctccggcgtgcttctcgaagtcaagcattcggggtcgtgcaattccatctccgaagataccgaagaagaggaggaggatgaagatcaagactactcattcccaatctcatccatcttggagtgg

SEQ ID NO: 250112 - DNA, 1032 bp, Artificial Sequence
  Description of Artificial Sequence: Synthetic coding sequence
atggtgcgagcaaggcaccagcccggcggtctctgcctgttactgctgctgctgtgccagtttatggaagaccggagcgcccaggccggaaattgctggctgaggcaggccaaaaacggacggtgccaggtgctgtacaagacagagctgtctaaggaagagtgttgcagtaccggacgcctgtctacaagctggaccgaggaagacgtcaatgataatactctgttcaagtggatgatcttcaacggcggcgctccaaactgcatcccatgtaaggagacatgcgagaacgtggactgtggtccaggcaagaagtgcaggatgaacaagaaaaacaaacctaggtgcgtgtgtgctccagattgctctaatatcacttggaagggcccagtgtgtggcctggatggtaaaacatatcgcaacgaatgcgcattgttgaaggctcgttgcaaggagcagcccgagctggaggtgcagtatcagggccggtgcaagaagacctgtcgcgatgtgttctgcccagggtcctccacttgcgttgtcgaccaaacaaacaatgcctactgcgtgacttgtaatagaatctgccctgaaccagctagctctgagcaatacttatgcggtaacgacggcgtgacttatagcagtgcctgtcatctgaggaaggcaacttgcctgctcggtaggtctattgggctcgcttatgaaggcaaatgtatcaaggctaagtcttgcgaagacattcagtgcaccggcggtaaaaagtgtctgtgggattttaaagtcggcagaggacgatgctcactttgtgatgaattgtgtcccgacagtaaatctgacgagcccgtatgcgctagcgacaacgctacatatgcaagcgagtgtgccatgaaggaagctgcatgcagtagcggggtcttgctggaggtgaagcattctggttcctgtaactccatctccgaagatacagaggaggaagaagaggatgaggatcaagattactcatttccaatttcaagtattctggaatgg

SEQ ID NO: 250113 - DNA, 1032 bp, Artificial Sequence
  Description of Artificial Sequence: Synthetic coding sequence
atggttagggcaagacaccaaccaggtggtttatgtcttttacttttacttttatgccaattcatggaagatagatcagctcaggcaggtaattgttggcttagacaagcaaaaaacggacgttgtcaagtgctttacaaaacagaattgtcaaaggaagaatgttgtagtactggtagactttcaactagttggactgaagaagatgttaatgataatactttgtttaaatggatgattttcaatggaggagcaccaaattgtattccatgtaaggaaacatgtgagaatgttgattgtggtccaggtaaaaaatgtagaatgaataagaaaaataaaccacgatgtgtatgtgcaccagattgttcaaatattacttggaaaggaccagtatgtggattagatggaaaaacatatagaaatgagtgtgcattattaaaggctagatgcaaagaacaaccagaattagaagtccaatatcaaggaagatgtaagaaaacttgtagagatgttttttgtccaggatcatctacatgtgttgttgatcaaaccaataatgcttattgtgtaacatgtaatagaatttgtccagaacctgcttcatctgaacaatatttatgtggaaatgatggagttacatattcatctgcttgtcaccttagaaaagctacttgtttacttggtagatcaattggacttgcatatgaaggtaagtgtataaaagctaaatcttgtgaagatattcaatgtacaggtggaaagaaatgtttatgggattttaaggttgggagaggaagatgctcactttgtgatgaattatgtccagattctaagtcagatgaaccagtttgtgcttctgataatgctacatatgcctcagaatgtgcaatgaaagaagcagcatgttcttcaggagttttattagaggttaaacattcaggttcttgtaattcaatttctgaagatacagaagaagaagaagaagatgaagatcaagattattcatttccaatatcttctattttagagtgg

SEQ ID NO: 250114 - DNA, 1032 bp, Artificial Sequence
  Description of Artificial Sequence: Synthetic coding sequence
atggttcgcgcacgtcaccaaccgggggggctttgtctgcttttacttctcctgtgccagttcatggaggacaggtctgctcaggcaggaaattgctggctcaggcaggccaagaatggacgttgtcaggtcctgtacaaaacagagctgagcaaggaagaatgctgctctacaggtcggctgagcacgtcgtggaccgaggaggacgtcaatgataacacactatttaaatggatgatcttcaatggtggggcccccaattgtattccatgtaaggaaacttgcgagaatgtggactgtggcccaggaaaaaagtgccgcatgaacaaaaaaaataagcctcgctgcgtgtgcgctcctgattgttccaacatcacatggaaaggaccagtgtgtggactggacggcaagacctatcgcaacgaatgcgcactcctcaaagcccgttgtaaggaacagcccgagttggaagttcagtaccaggggcgatgcaagaagacctgccgggatgtgttttgtccagggagctccacttgtgtggtggatcagacaaataatgcatactgcgtgacttgcaatcggatctgccccgaacctgcctcctccgagcagtatctatgtgggaatgatggagttacctattcctcggcatgtcatctgcgaaaagcgacctgtctccttggacggtccataggcttggcttatgagggaaaatgcataaaggcaaaatcttgtgaggacatacaatgcacgggtggaaaaaaatgcttatgggacttcaaggtcggtcgcggccgatgcagcctctgcgatgagctctgtccagattccaagtccgatgaacctgtatgcgccagcgataacgcaacctacgcttccgaatgcgccatgaaagaggcagcatgtagttctggcgtgctgttagaggttaaacattcaggttcctgcaatagcatatccgaagataccgaggaggaagaagaggatgaagatcaggactattccttcccaatcagctctattttagaatgg

SEQ ID NO: 250115 - DNA, 1032 bp, Artificial Sequence
  Description of Artificial Sequence: Synthetic coding sequence
atggtgagagcacgccatcaaccgggtggtctttgccttctgttgcttctgctgtgccagtttatggaagatagatcagcacaagccggcaactgctggctgcgccaagcgaaaaacggcagatgccaagtgctgtataagaccgagctttccaaagaggaatgctgctcaaccggacggctctccaccagctggactgaagaagatgtgaacgacaataccctctttaagtggatgattttcaatggcggggcacctaactgtatcccttgtaaagaaacctgtgaaaatgtggattgtgggccagggaagaagtgtcgcatgaataagaaaaacaagccacgatgtgtgtgcgcgcctgattgttcgaacattacgtggaagggaccagtgtgcggactggatggaaaaacttacaggaacgagtgtgctcttctgaaagcaagatgtaaggagcaacctgaactcgaagtccagtaccagggaagatgtaaaaagacttgtcgtgatgtgttctgtcccggctcctcgacgtgtgtggtggaccagaccaacaatgcctactgtgtgacttgtaacaggatatgcccggaacccgccagcagcgagcagtacctgtgtgggaatgatggcgttacctactcatcagcatgtcatctgaggaaggctacttgtctgcttgggaggtccatcggacttgcgtacgaagggaaatgtatcaaagcaaagtcatgcgaggatattcagtgtaccgggggcaaaaagtgtctttgggactttaaggtgggtagaggaagatgttccctgtgtgacgaactttgccctgatagcaaatccgacgagcctgtgtgtgcatcagacaatgccacctacgcatccgaatgtgcgatgaaggaagcagcatgctcctcaggcgtgcttctggaagtcaagcactcaggttcatgcaactcaatctcagaggatacggaagaggaagaagaggacgaagatcaagattacagctttcccatctcgtccatcctcgaatgg

SEQ ID NO: 250116 - DNA, 1032 bp, Artificial Sequence
  Description of Artificial Sequence: Synthetic coding sequence
atggtacgcgcgcggcaccagccggggggcttgtgcctgttgttgctcctcctgtgccagttcatggaggaccgaagcgcgcaggccggcaactgctggcttagacaagcgaagaacggacgctgtcaagtgctgtacaagaccgaactgtcaaaggaagagtgctgctccactggacggctttctacttcctggaccgaagaagatgtcaacgacaacactctcttcaagtggatgatctttaatgggggagcaccgaattgcatcccttgcaaggagacgtgtgagaacgtggactgcggccctggtaagaagtgtcgcatgaacaagaaaaacaagccgcggtgtgtgtgcgcaccggattgtagcaacattacgtggaagggcccggtctgcggcctggacgggaaaacctaccgcaacgaatgtgcccttcttaaagctcgctgtaaggaacagcctgaactcgaagtgcaataccagggacgatgtaaaaagacctgccgggacgtgttctgccccggctccagcacgtgtgtggtggaccagaccaataatgcctactgtgtaacttgtaacagaatctgccctgagccggcatcctccgagcagtatctctgtggtaatgatggggtcacttactcatcggcctgccatctgagaaaggctacctgcttgctcggaaggtcgattggactggcttacgaaggaaagtgcatcaaagccaaatcgtgcgaggatatccagtgcaccggaggtaagaaatgcctctgggacttcaaggttggacgcggaaggtgctctctgtgcgacgagctgtgccctgattcaaaatcggatgagccagtctgcgcatcggacaacgccacttacgcctcagaatgtgccatgaaagaagcggcgtgttcctcgggtgtcctcctcgaggtgaaacacagcggctcatgtaactcgatcagcgaagatactgaagaggaagaagaggacgaggatcaagactacagctttcccatatcatccatcctggagtgg

SEQ ID NO: 250117 - DNA, 1032 bp, Artificial Sequence
  Description of Artificial Sequence: Synthetic coding sequence
atggtgcgggctagacatcaaccaggtgggctatgtctcctgctgctgctattgtgccagtttatggaagaccgatctgctcaagcagggaactgttggctaaggcaggccaagaacggcagatgccaagtgctttacaaaacagagctatccaaagaagagtgttgttctactggccgcctgagtacttcctggactgaagaagacgttaacgataacacactctttaagtggatgatctttaacgggggcgctcccaattgtatcccttgtaaagagacctgcgagaatgtagactgcgggccaggtaaaaagtgccgcatgaacaagaagaacaaacccaggtgcgtatgtgctcccgattgtagtaacattacctggaaaggtcccgtgtgcggtctggacggtaagacctatagaaatgaatgtgctctgctgaaggctcgatgcaaagagcaaccagagttagaagtccagtaccaagggaggtgcaagaagacctgtagagatgttttttgtcccggttcatctacatgtgtggtcgaccagaccaacaatgcctattgcgtaacttgtaatcgcatttgcccagagcccgccagcagcgagcaatatctgtgtgggaacgatggcgtcacctactctagcgcttgccatctgaggaaagccacctgtctgctggggcgatctattggcttggcctatgagggaaagtgcattaaggcaaaatcttgcgaggacatccagtgcactggaggcaagaaatgtctgtgggatttcaaggtggggagagggcgatgttcattatgcgacgagctgtgtcctgatagtaagtctgacgaacctgtgtgtgccagcgataacgccacctacgcctctgagtgcgcaatgaaagaagctgcctgctcctctggggtattactcgaggttaagcattccggctcatgcaactccattagtgaagacaccgaagaggaggaggaggatgaggaccaggattactcctttccaatctcttcaattctggaatgg

SEQ ID NO: 250118 - DNA, 1032 bp, Artificial Sequence
  Description of Artificial Sequence: Synthetic coding sequence
atggttcgcgcgagacatcagccaggtggactgtgtctgctcttgctacttctttgtcagttcatggaggatagatccgctcaggccggtaattgctggctgcgccaagcaaaaaacggtaggtgccaggttctgtataaaactgaactatctaaagaggaatgttgtagtacaggtagacttagcacctcctggactgaggaggacgttaatgacaataccttatttaagtggatgattttcaatggaggtgccccaaactgcatcccttgcaaggaaacttgtgagaatgtggattgcggccccgggaagaaatgtagaatgaacaagaaaaataaacctaggtgcgtgtgtgcgcctgattgctcgaacattacatggaaggggccagtctgcggtttagatgggaaaacttatagaaacgagtgtgcactgctgaaggcccggtgcaaggagcagccagaattggaggtgcagtatcaggggcgctgtaagaagacctgtcgggacgtcttctgcccaggcagctctacctgcgtggttgatcaaaccaataatgcctattgtgtgacctgcaatcgaatttgccccgaacctgcaagcagtgaacagtacctctgcggcaatgacggcgtgacttatagttctgcctgccacctcagaaaggctacctgtctgctgggtagatcgatcggccttgcttatgagggtaagtgtattaaagctaagagctgtgaggacattcagtgtacaggagggaagaaatgtctgtgggactttaaagtcggacgcggcagatgttcactgtgcgatgagctttgccctgactctaagtctgatgagccggtatgtgcatctgataacgccacgtacgcttcggagtgcgccatgaaggaggccgcttgctccagcggtgtcctgctggaggtgaaacactcaggtagttgcaatagtattagcgaggacacagaagaagaggaggaggacgaggaccaggattactcttttcctatctcctccatactcgagtgg

SEQ ID NO: 250119 - DNA, 1032 bp, Artificial Sequence
  Description of Artificial Sequence: Synthetic coding sequence
atggtgcgcgcgcgccatcagccaggcggcttgtgcctgctccttctcctgttgtgccagttcatggaagataggagcgcccaagccggaaactgctggctccgccaggcaaaaaacggaagatgccaggtgctctacaagactgagttgagcaaggaagagtgctgttccaccggacggctctcgacgtcctggaccgaggaagatgtaaacgacaacactctgttcaagtggatgatctttaacggaggtgcaccgaactgcatcccgtgcaaggaaacctgcgagaatgtcgattgcggtccaggcaagaaatgccggatgaataagaagaataagccgcgctgcgtctgcgcccccgattgcagcaacatcacgtggaaaggccctgtttgtggcctcgacggaaagacttaccggaacgagtgcgcactgctgaaagcgcggtgcaaggagcaacccgagttggaagtccaataccagggacggtgcaaaaagacctgccgcgacgtcttttgccctgggtcgagcacctgcgtggtggaccagacgaacaatgcttattgtgtcacctgcaatagaatatgtccagagccagcttcctcagaacagtacctgtgcggcaacgacggggtgacttactcttccgcctgtcacctgagaaaggctacgtgtctgcttggacgctcgatcggtcttgcctacgaagggaaatgtatcaaggccaagtcatgcgaggacatccaatgcactggagggaaaaagtgtctgtgggacttcaaagtgggaagaggccggtgcagcctgtgcgacgagctgtgccctgactctaagagcgatgagccggtatgtgcgtcagataatgctacttacgcatcggaatgtgcgatgaaggaggccgcctgtagctcgggcgtgctgctcgaagtgaaacactcgggcagttgtaattccatctcagaagataccgaggaagaagaggaagatgaagatcaggactactcattcccgatctcgtcgattctggaatgg

SEQ ID NO: 250120 - DNA, 1032 bp, Artificial Sequence
  Description of Artificial Sequence: Synthetic coding sequence
atggtccgagcgcgccaccagcctggtggcctttgccttcttcttctcctcctttgtcaattcatggaggacagatccgcacaagcaggaaattgctggctgaggcaagcaaagaatggacggtgtcaagtgttgtacaagaccgaactttcgaaggaagaatgctgttcgactggaaggctgtctacttcgtggaccgaagaggatgttaatgacaatacgctctttaagtggatgatctttaatggtggtgcacccaattgtattccttgtaaggaaacctgtgagaacgtcgattgtggacctgggaagaaatgcagaatgaacaagaaaaacaagccacgttgtgtctgcgcacccgattgtagcaacattacctggaagggtcctgtgtgtggactggatggcaagacttaccgcaacgaatgcgccctgctgaaggcccgctgtaaagaacaacccgagcttgaagtccaataccagggaagatgcaagaaaacttgcagagacgtgttttgtcccggatcatcaacctgcgttgtggatcagaccaataacgcgtactgtgtgacctgcaacaggatttgtccagaaccggcaagttcggaacagtacctgtgtggtaacgacggggttacctattcatctgcctgtcatctccggaaggctacttgcttgcttggacggagcattgggctcgcatacgagggaaaatgtatcaaggcaaaatcctgtgaagatattcagtgcaccggtggaaaaaagtgcctttgggatttcaaggtcggccgaggcagatgttcgctgtgtgatgaactgtgtcctgattctaagagcgacgagccggtttgcgcctccgacaacgcgacttacgcatcagaatgtgctatgaaagaagccgcttgttcgtccggagtgctcttggaggttaagcattcaggttcatgcaactccatctcagaagataccgaggaggaagaggaggacgaagatcaggattactcttttccgatctcctcaatactggaatgg

SEQ ID NO: 250121 - DNA, 1032 bp, Artificial Sequence
  Description of Artificial Sequence: Synthetic coding sequence
atggtgcgcgcgaggcaccaaccaggtggcttatgcctgctgctgctgctgctctgtcagttcatggaggatcggagtgctcaggctggaaattgttggctgcgccaggctaaaaacgggcgatgccaggtgctgtataaaaccgaactgagcaaggaggaatgctgtagcacggggcgtttatctacctcctggaccgaggaggatgtgaacgacaacaccctgtttaagtggatgatttttaatgggggtgccccaaactgtatcccatgtaaagaaacatgcgagaacgtggattgcggtccgggtaaaaaatgccgaatgaacaagaaaaacaagccacgctgcgtttgcgctcccgattgcagtaacatcacgtggaagggtccagtttgcggcctggatggcaaaacgtaccgcaatgagtgcgcgttgttaaaagcccgatgtaaggaacaaccggaactggaagttcagtaccaaggacgctgcaaaaagacctgccgcgacgttttctgtccaggtagctctacgtgtgtggttgaccaaaccaataatgcatattgcgtcacgtgcaatcgaatttgccccgagccggcgtcgagcgagcaatacctttgcgggaatgatggcgtgacgtactctagtgcttgccacttaaggaaagcgacgtgcctcctgggtagaagcatcggcctggcctacgagggtaaatgtatcaaggccaagagctgtgaagacatccaatgcactggtggtaagaagtgcctgtgggattttaaagtcggtcgcggccgttgttccttgtgtgatgagctttgcccagattcgaagagcgatgagccggtatgcgcttccgataatgcgacgtatgcatctgagtgcgcgatgaaggaggctgcctgtagctcaggcgttctgctagaagtcaaacacagcggatcctgtaatagcattagcgaagatacggaggaggaggaagaagatgaggaccaagactacagcttccctatttccagcatcctagagtgg

SEQ ID NO: 250122 - DNA, 1032 bp, Artificial Sequence
  Description of Artificial Sequence: Synthetic coding sequence
atggtgcgtgcccgccaccagccaggtggactgtgcctgctcctccttctcctctgccagttcatggaggatcgctcggcccaggcaggtaactgttggctccgtcaggctaagaacggccgctgccaggtcctctacaaaactgagctctccaaagaggagtgctgttcgaccggtcgattgagtaccagctggacggaggaggacgtgaacgataacaccctcttcaagtggatgatcttcaacggtggcgcgcccaattgtattccctgcaaggagacttgcgagaacgtggactgtggccctgggaagaagtgccgaatgaataagaagaacaagccacgctgcgtgtgcgctcctgattgcagcaatatcacatggaaggggcccgtctgtggactcgacgggaagacctatcgaaatgagtgtgcccttctaaaagcccgctgcaaggagcaaccggagttggaggtgcagtaccagggtcgatgtaaaaagacctgtcgtgatgtgttctgccccggatcctcgacctgtgttgtcgatcagaccaacaacgcctattgcgtcacttgcaaccgcatctgccctgagcctgcctcctctgagcagtacctgtgtggtaacgatggagtcacatacagtagcgcctgccatttgcgcaaggccacatgcctcctgggacgctccattggtctcgcatatgaaggcaagtgcattaaggccaagtcttgcgaagatatacagtgcaccggtggcaaaaagtgcctctgggatttcaaggttgggcgtggccgctgctctttgtgcgatgaactctgcccggattccaagagtgacgaacccgtatgtgcttctgacaacgctacgtacgcgtccgagtgtgccatgaaagaggctgcttgcagtagcggcgtccttctcgaggtgaagcactcgggttcgtgtaacagcatcagtgaggacacagaggaggaggaggaggatgaggaccaggactactctttccccatcagttccatcctcgagtgg

SEQ ID NO: 250123 - DNA, 1032 bp, Artificial Sequence
  Description of Artificial Sequence: Synthetic coding sequence
atggtaagagctcgtcatcaaccaggtggactttgtcttctgcttctccttttatgccaatttatggaagaccgaagtgcacaggcaggaaactgctggctacggcaagctaaaaacggacgttgtcaggtgctctataagactgaattatctaaagaagaatgttgcagcacgggacggttgtcaacctcctggacagaagaagatgttaatgataatactcttttcaagtggatgattttcaatggaggggctccaaactgcataccatgtaaagaaacgtgtgaaaatgtcgattgcggtcccgggaaaaaatgccgtatgaataaaaaaaacaaaccccgatgtgtgtgtgcaccggattgctcaaatattacttggaaaggacccgtctgcggacttgatgggaagacatatagaaatgaatgtgcattactgaaggctaggtgcaaggaacaaccagagctcgaagtacaataccaaggaagatgtaaaaaaacatgtcgagatgttttctgcccaggatcctctacgtgtgtcgtcgatcaaacaaacaatgcttattgcgtgacttgtaaccgtatatgcccagaaccagcatcaagcgagcaatatttatgtggaaatgatggagtgacatattcttctgcttgtcatctccggaaggcaacttgtttattgggtagatctatcggactcgcatacgaaggaaagtgtattaaggctaaatcatgtgaagatatccaatgtacaggaggaaaaaaatgcttgtgggacttcaaggttgggagaggacggtgttcattgtgcgatgagctgtgtccagattcgaagagtgacgaacctgtttgtgcctcggataatgcaacatacgcatcggaatgtgctatgaaagaagctgcgtgctcaagtggcgtactcctagaggttaagcactccggatcctgcaactccatctcagaagatactgaagaggaggaagaagatgaggatcaagattactcatttcctattagtagcatcttagaatgg

SEQ ID NO: 250124 - DNA, 1032 bp, Artificial Sequence
  Description of Artificial Sequence: Synthetic coding sequence
atggttcgggcgagacaccagcccgggggtctgtgcttactgcttcttctcttgtgccagttcatggaggacagatctgcacaggcaggaaattgttggctgcgccaagctaaaaatgggcgatgccaggtgctctacaagaccgaacttagtaaggaggagtgttgctccaccggaaggctgtccacgagttggaccgaagaagatgtgaacgataacacactgtttaagtggatgatcttcaatggaggcgccccaaactgcattccttgtaaggagacctgcgaaaacgtggattgtggacccggcaaaaagtgccgaatgaacaagaaaaataagccgagatgtgtgtgtgctcctgattgtagtaatattacctggaaggggcctgtgtgcggactcgacggtaagacctaccggaatgagtgcgccctgcttaaggctagatgtaaggaacagcctgaacttgaagtgcagtaccagggccgctgcaaaaagacctgtcgagatgtgttctgtccaggatcatcaacttgtgtggtggatcagactaataacgcatattgcgtcacttgcaatagaatttgccctgagcctgcctccagcgagcagtacttgtgtggtaatgatggcgtaacttatagctcagcctgtcacctgcgcaaagccacatgcctgttaggccggtccataggactcgcatatgaagggaaatgtataaaggccaagtcgtgcgaagacatccagtgcacaggaggtaaaaaatgcctttgggatttcaaggtcggtcgaggccggtgttccttatgcgatgagctctgccctgattcaaagagtgacgaacctgtgtgcgcttccgacaatgccacctatgcaagcgagtgtgcaatgaaagaagccgcttgctcatcgggggtgctgctcgaggtcaagcactcaggttcctgtaacagcatatccgaggacaccgaggaagaagaggaagatgaagatcaggattatagtttcccaatttcctccattttggaatgg

SEQ ID NO: 250125 - DNA, 1032 bp, Artificial Sequence
  Description of Artificial Sequence: Synthetic coding sequence
atggtgcgtgcccggcaccagccgggtggcctgtgccttctgttgctgctcctgtgtcaattcatggaggaccgaagcgcacaagcggggaattgttggcttagacaggctaaaaacggaaggtgtcaggtgctttacaagaccgaactgtcaaaagaggagtgctgtagcaccggaaggttgtctacttcatggacagaggaggatgtgaacgacaatacgctgttcaaatggatgatcttcaacgggggagctcctaactgtatcccatgtaaggaaacatgcgagaatgttgactgcggacccggcaagaagtgtaggatgaacaagaagaataagcctcggtgcgtttgcgccccagactgctcaaacatcacttggaaaggccctgtatgcggtttagatgggaaaacatacaggaacgaatgcgccctcctcaaagcacgctgcaaagagcagcctgagctcgaagtgcagtatcagggtcgctgcaagaagacatgccgcgatgtgttctgccccggttcttccacctgcgtggtggaccaaaccaataatgcttactgcgtgacatgcaatcgaatttgccctgaacccgctagctctgagcagtacctttgcgggaacgacggagttacctacagcagcgcctgccacttgaggaaggcaacctgtctgctggggaggagtatcgggctggcatacgaaggaaagtgtatcaaagcaaagtcttgtgaggacatccagtgcacgggcggtaaaaaatgtctctgggatttcaaagtcggacgcgggagatgttccttgtgcgacgagctgtgtccagactcgaagtcagacgaacctgtttgcgcaagcgacaacgccacttatgcttccgagtgcgccatgaaagaggccgcatgctcatccggcgtattgcttgaggtcaagcattctggctcgtgtaattctattagtgaagataccgaggaggaagaggaggatgaggaccaggattactccttcccaatctcatctatcctagagtgg

SEQ ID NO: 250126 - DNA, 1032 bp, Artificial Sequence
  Description of Artificial Sequence: Synthetic coding sequence
atggtgagagccaggcaccaacccggaggtctctgtctgctgctccttctcctttgccagtttatggaggatcgctctgcccaggccgggaactgctggctccggcaggcaaaaaatggcagatgtcaggtcctgtacaaaacggagctctctaaggaggaatgttgtagcacagggagattatctaccagctggactgaggaggacgtcaacgataatactctcttcaaatggatgattttcaacggcggagcacctaattgcataccttgtaaggagacatgcgagaatgtagattgtggtccaggtaaaaaatgtaggatgaataagaaaaacaagcccagatgtgtgtgcgcaccagattgcagtaatattacctggaaaggtcctgtgtgtgggctggatggaaagacatacaggaatgagtgcgccctgttgaaggcacgctgtaaagagcagcctgaacttgaggtgcagtaccaggggaggtgcaagaaaacctgtcgagatgtcttctgtccaggcagtagcacttgcgtggtggatcagacaaacaatgcctactgcgtgacctgtaatcggatctgcccggagcccgcaagttccgagcagtatttatgtgggaatgatggagtgacttacagctctgcctgccatctgcgcaaagcaacctgcctcctcggtcgaagtatcgggttggcctatgagggcaaatgcattaaagccaagagctgcgaggatatacagtgcactggagggaaaaagtgcctgtgggactttaaggtgggacgcggacgctgctctctgtgcgatgagctttgtcctgactctaagtcagatgaacctgtgtgtgcatccgacaatgcaacttacgccagtgagtgtgcaatgaaggaggccgcctgctcatcaggcgttctgctcgaggtcaagcattcaggatcctgtaacagtatctccgaggacaccgaggaagaggaggaagacgaggaccaggactactctttccccatctctagtattctagagtgg

SEQ ID NO: 250127 - DNA, 1032 bp, Artificial Sequence
  Description of Artificial Sequence: Synthetic coding sequence
atggtgcgggcacggcatcaaccaggaggactatgcctcctgcttttacttttatgtcagtttatggaagatcgatcagctcaagctggaaactgctggttgcggcaagctaaaaacggtcgatgtcaagttctttataagaccgaattgagtaaagaggagtgttgcagcactggacgactttcgacttcttggactgaagaggatgtcaatgacaacacgttattcaagtggatgatttttaatggtggagctcctaactgcatcccgtgtaaagaaacttgtgagaatgtagattgcggaccgggaaaaaaatgtagaatgaacaaaaaaaataaaccaaggtgcgtctgcgcacctgattgctcaaatatcacttggaaaggcccagtctgcggattggatggtaaaacctaccgaaacgagtgcgctctcttgaaggcaagatgcaaagaacaacctgaattggaggttcagtatcagggccgatgcaagaaaacatgcagagacgtcttctgcccaggttcgtcaacatgcgttgtggaccagacaaataatgcttattgtgtgacttgtaaccgtatctgtccagagccagcctcaagtgagcagtacctatgtggaaatgacggagtgacttattcttcggcttgccaccttcgaaaggccacttgcctgctagggcgaagtataggccttgcatacgagggaaaatgcattaaagcgaaatcgtgtgaggatattcagtgtacgggcggaaagaaatgtctatgggattttaaggttggtagggggagatgttccttgtgtgacgaactgtgtccagactccaaaagtgatgaaccagtctgcgcatctgataatgccacctacgctagcgaatgtgctatgaaagaagcagcttgttcgagtggagtactactggaagtgaaacattcaggatcgtgtaacagtatatctgaagataccgaagaagaagaagaagatgaagatcaagattacagtttccccatttcttcgatactggagtgg

SEQ ID NO: 250128 - DNA, 1032 bp, Artificial Sequence
  Description of Artificial Sequence: Synthetic coding sequence
atggtacgtgctcgccatcagccaggtgggctgtgcctgcttctcctactgttatgccaattcatggaggaccgctcagcccaggcgggtaattgttggctgcgacaggccaagaatggacgctgccaggtactgtacaagaccgaactcagcaaggaggaatgctgcagcaccggaagactcagcacaagttggacagaagaagatgtaaacgataatactttgtttaagtggatgatctttaatggcggcgctccgaactgtatcccttgcaaggaaacctgtgagaacgtggactgtgggcccggcaaaaagtgcaggatgaataaaaaaaataagcccaggtgcgtgtgcgctcctgactgctctaatatcacctggaaaggccccgtgtgtggcttggatggaaagacgtataggaacgagtgcgccctcctcaaagcacgctgcaaagagcagcccgagttggaggtgcagtatcagggcagatgcaaaaaaacctgtcgcgacgtcttttgtccagggagctcaacttgtgtggtggaccagactaataacgcttactgcgtaacatgcaacagaatatgcccggagccggcaagctctgagcagtacctttgtggaaacgatggcgtgacatatagttccgcttgccatttgcgaaaagcaacttgcctgttggggcggagcattggtctggcatatgaggggaagtgtattaaggctaagtcctgcgaagatatccaatgtactggaggaaagaaatgtttgtgggatttcaaagtgggcagaggacgctgtagcttgtgcgacgagctgtgcccagactctaaaagtgacgagccggtctgcgccagcgataatgctacctacgcctctgagtgtgccatgaaggaagccgcgtgctcgtctggagttcttttggaggtgaagcactccggaagctgcaactccattagtgaggacacagaggaggaggaggaagatgaggatcaagactatagctttcccatttcctccatactcgagtgg

SEQ ID NO: 250129 - DNA, 1032 bp, Artificial Sequence
  Description of Artificial Sequence: Synthetic coding sequence
atggtgagggcgcgccaccaaccgggcggactgtgcctcctgctgctgttgctctgtcagtttatggaagataggtcagcacaggcagggaattgttggcttcggcaggcgaaaaacggacgctgtcaagttctgtacaagaccgaattgtccaaagaggaatgttgtagcacgggacgactcagcacgtcatggactgaagaagatgtgaacgacaacaccctgttcaaatggatgatcttcaacggtggagcgccgaactgcatcccctgcaaggaaacttgcgaaaatgtggactgcgggccgggcaagaagtgccgcatgaacaagaagaacaaaccacgctgcgtctgtgctccggactgctccaacatcacttggaagggacctgtgtgcggcctggacggaaagacctaccgcaatgaatgcgctctgctcaaggcacggtgtaaggagcagccggagttggaggtccagtaccaaggacgctgtaagaaaacctgccgtgacgtcttttgcccgggcagctcaacctgcgtcgtggatcagaccaacaatgcttactgtgtcacttgcaacagaatctgtcccgagcccgctagctcggaacagtacctgtgtggcaacgacggagtcacctatagctcggcctgccacctgcggaaagccacctgcctgcttggaagaagcatcggacttgcctacgagggtaagtgcatcaaggccaaatcatgcgaggacatccagtgcaccggcggcaagaaatgcctgtgggatttcaaggtcggacgtgggcgctgcagtctgtgcgatgaactctgccccgatagcaagagcgatgaaccagtctgcgcctcggacaatgcaacttacgcgtccgaatgtgccatgaaagaggccgcatgctcgtctggcgttctgcttgaggtgaaacacagcggatcatgtaattcgattagcgaggatactgaagaagaagaggaggatgaggaccaggattactcgttccccattagctccatcctcgaatgg

SEQ ID NO: 250130 - DNA, 1032 bp, Artificial Sequence
  Description of Artificial Sequence: Synthetic coding sequence
atggtgcgcgcccgacatcagcccggaggcctgtgtttgctgttgctgctcctctgtcaatttatggaagatagaagcgcccaggccggcaactgctggctccggcaggccaaaaacgggagatgccaggtgctgtacaaaacagagctgtctaaggaggaatgctgctcaaccggcaggttatctactagctggacagaggaagacgtgaacgacaacaccctgttcaaatggatgatcttcaacggaggcgcccccaactgcattccctgcaaggaaacgtgcgagaatgtggattgcggtccagggaagaagtgccggatgaacaaaaagaacaagccgcggtgcgtgtgcgcacctgactgttccaatattacgtggaagggtcctgtgtgcggtttggatgggaaaacctacaggaatgagtgcgctctgcttaaggcacgatgcaaagagcagccggaactggaagttcagtatcaaggcagatgcaaaaagacctgccgcgacgttttttgcccaggatcctcaacctgtgtggtggatcaaactaataacgcctattgcgtgacttgcaatcggatatgccctgagcccgctagctccgagcagtacctgtgcgggaacgacggcgtgacctattcatccgcttgccacttgcgcaaggcgacatgtttgttgggccgctccatcggactggcttacgagggtaaatgcatcaaagccaagtcttgcgaagacatccagtgcacgggtgggaaaaagtgcctgtgggacttcaaggtggggcgcgggagatgctcactctgtgacgagctctgccctgacagcaagagcgacgagccggtatgcgctagtgacaacgcaacgtatgcaagcgagtgtgccatgaaggaggctgcctgcagttccggcgtgctgctcgaagtgaagcacagtgggagttgtaatagtattagcgaggacactgaggaggaggaggaggatgaagatcaggactacagcttcccaatcagctcaatcctggagtgg

SEQ ID NO: 250131 - DNA, 1032 bp, Artificial Sequence
  Description of Artificial Sequence: Synthetic coding sequence
atggtccgcgccagacaccaaccgggaggcttgtgcctgttgctcctgctgttgtgtcagtttatggaagatcggtccgctcaggcgggaaattgttggttgaggcaggcaaagaatgggagatgccaagtcctgtacaaaactgaactgtcgaaggaggaatgttgctcgactggaaggctgagcacctcctggactgaggaggacgtgaatgataacaccctgtttaagtggatgatcttcaacggaggcgctccgaactgcatcccttgcaaggaaacttgcgaaaacgtggactgcgggcctggcaagaagtgccggatgaacaagaaaaacaagccgcgctgcgtctgcgccccggattgttcaaacatcacttggaagggtcccgtgtgtggattggatggaaagacgtacagaaacgagtgtgctctgctgaaggcacggtgcaaggaacagccagaacttgaggtgcaataccagggacggtgcaaaaagacctgccgcgacgtcttttgcccgggcagctcaacttgtgtggttgatcagacgaataatgcgtattgcgtcacttgcaaccggatctgtccagagccagcttcctcagagcagtacttgtgcggaaatgacggagtgacctactcctccgcatgccacctccgcaaggccacctgcctgctggggaggtcgatagggctcgcatatgagggaaagtgtatcaaagcgaagagctgcgaggacatccaatgtactggaggaaaaaagtgcctttgggatttcaaggtgggacgaggtcgctgctcgctttgtgacgagctctgcccagactctaagtccgacgaaccggtttgcgccagcgacaacgcgacttatgccagcgagtgcgcgatgaaggaggctgcctgcagctcgggcgtgctgctggaagtgaaacattctggttcctgcaattcgatctcggaggacaccgaggaagaagaagaagatgaagatcaggactactcgttccctatcagctctatcctggaatgg

SEQ ID NO: 250132 - DNA, 1032 bp, Artificial Sequence
  Description of Artificial Sequence: Synthetic coding sequence
atggtgagggccaggcatcagccaggggggctgtgcctgctgctgttattactctgtcaattcatggaggatcggtcagctcaggccggcaactgctggctccggcaggcaaagaatggcagatgccaagtcttgtataagacagagttgtccaaggaggagtgctgtagtactggtcgcctgagtacttcctggactgaggaggacgttaatgataataccctttttaagtggatgattttcaatgggggcgcccccaactgtatcccttgcaaagaaacttgcgagaacgtggattgtggacccgggaagaaatgtcggatgaataagaagaataagccacggtgcgtgtgcgctcccgactgctcaaacattacatggaagggcccagtctgcggactggacgggaagacctaccgcaacgagtgcgcattacttaaagcacgttgcaaagagcagcctgagctagaggtgcaataccagggtaggtgcaagaagacctgcagagatgtcttttgccctggctctagtacgtgtgtcgtagatcagacaaataatgcctattgtgtcacatgtaaccgcatttgccctgagcctgcgtcttctgagcaatacttatgcggaaacgacggcgtaacttactcttcggcatgccatctgagaaaggccacatgcctgctgggtcggagtatcggtcttgcgtacgaggggaaatgtataaaggccaagagctgcgaagatatacagtgcacagggggcaagaagtgcttatgggatttcaaggtgggtcgcggccgatgttccctctgcgatgagctgtgccctgatagcaagtctgacgagccggtctgcgcctcagataatgcaacatacgcctccgagtgtgctatgaaggaggcggcttgctcatccggcgtactgctcgaagtcaagcacagtggaagctgcaacagtatatccgaagacacagaagaggaggaggaggacgaagatcaggactacagttttccgatttcctctatcctcgagtgg

SEQ ID NO: 250133 - DNA, 1032 bp, Artificial Sequence
  Description of Artificial Sequence: Synthetic coding sequence
atggtgcgcgctcgccaccaaccaggcgggctttgcctgttgttgctcttgctgtgccagttcatggaggacagatcggcacaagctggaaattgctggctgcgacaagccaagaacggtcgctgtcaagtgctgtacaagactgagttgagcaaagaggaatgttgctccactggaaggctgtcgacgagctggaccgaagaggatgtgaacgacaacacgctgttcaagtggatgattttcaacggtggggcacccaactgcatcccatgtaaggagacgtgcgagaatgtggattgcggaccgggaaagaagtgccgtatgaacaagaagaataagccgaggtgcgtgtgcgccccagactgctccaacattacctggaaaggtcccgtgtgcggactggacgggaaaacctaccgcaatgaatgcgcgctcctcaaagcacgctgtaaggaacagccggaattggaagtgcagtatcaggggcggtgtaaaaagacctgtcgggacgtgttctgcccaggatcgtcgacctgtgtggtggaccaaactaacaacgcctactgcgtgacctgcaacagaatctgccccgagcctgccagctcggagcagtacttgtgcggaaatgatggagtgacgtattcctcggcttgccatctgcggaaggccacttgtctcctggggcggtccatcgggctggcctacgagggtaagtgcattaaagcgaaatcatgtgaagatattcagtgcacgggcgggaagaagtgcctctgggacttcaaggtgggacggggccggtgttcactctgcgacgagttgtgcccggattcgaagtctgatgaacctgtgtgcgcgtccgataacgccacttacgccagcgaatgtgcgatgaaggaggcagcctgcagctcaggcgtgctcctcgaagtcaagcacagcggctcatgtaactccatctcggaggacactgaagaagaagaagaggatgaggaccaggattacagctttccgatctcatccatcctcgaatgg

SEQ ID NO: 250134 - DNA, 1032 bp, Artificial Sequence
  Description of Artificial Sequence: Synthetic coding sequence
atggtccgggcaaggcaccaacccgggggcctctgcctgctactgctgttactttgtcagttcatggaagacagatccgcgcaagcggggaactgttggctgcggcaagccaaaaacgggaggtgccaggtgctctacaagaccgaactatctaaagaggaatgctgctccacgggtcgactatccacatcttggaccgaggaagatgtgaacgacaacaccctgtttaaatggatgatattcaatggcggtgccccgaactgtataccatgtaaagagacctgcgagaacgtagattgtggcccaggaaagaaatgccgcatgaataagaaaaacaagccccgctgcgtgtgcgccccagactgtagtaatattacgtggaagggacccgtgtgcggactggacgggaaaacttacagaaatgaatgtgccttactaaaagctaggtgtaaagagcaaccagaactggaagttcaataccagggtcggtgtaaaaagacatgcagagacgttttctgccctggctcgagcacgtgtgtggtcgatcagactaacaatgcctactgcgtcacatgcaatcggatttgccccgagcccgcctcgagtgagcagtacctgtgtggaaacgatggtgtgacttacagcagcgcgtgtcatcttagaaaagcaacatgcttattgggtcgcagtatcggactcgcctatgaggggaaatgcattaaggccaaatcctgtgaggacatacaatgcaccggtgggaagaagtgtctgtgggacttcaaggttggtaggggcagatgctccctgtgcgacgagttatgccctgatagcaagtctgacgagcccgtctgcgccagtgataatgccacctatgcctccgaatgcgcgatgaaagaggcagcctgcagttctggggtgctactcgaggtgaaacatagcgggagctgcaactctatctctgaggacacagaggaagaagaggaagatgaggatcaggactactccttccccatctcctccatcctcgagtgg

SEQ ID NO: 250135 - DNA, 1032 bp, Artificial Sequence
  Description of Artificial Sequence: Synthetic coding sequence
atggttcgcgcaagacatcaaccgggcggattgtgcttattattgctgcttctgtgtcaatttatggaagaccgctcagcacaagccggcaattgttggctccgccaggctaaaaacggccggtgccaggttttgtacaaaactgaattaagcaaagaagaatgttgcagcactgggcggttatctacgtcttggacggaagaagacgtgaacgacaataccctgttcaagtggatgatctttaacggcggcgcgccaaactgtattccatgcaaggaaacgtgcgaaaacgttgattgcggcccgggcaaaaagtgccggatgaataaaaagaataagcctcgctgcgtttgtgcaccggactgcagcaacattacgtggaaggggcccgtgtgcggtctggatggtaaaacataccgcaacgagtgcgccctccttaaggccaggtgtaaagagcagccggaactggaagtacaatatcagggtcgctgcaaaaagacatgccgggatgtgttttgcccaggaagctcgacatgtgtcgtggatcaaacaaataatgcctactgtgtcacctgtaaccggatttgtccggaaccggcatcatctgagcagtacctgtgtggtaatgatggggttacttactcttcagcgtgtcatctccggaaagccacatgtcttctgggaaggagcataggactggcctatgaaggcaaatgcatcaaagcaaaatcatgcgaagatatccagtgcacaggtggcaaaaaatgcttatgggactttaaagtggggagaggcagatgttccctgtgcgatgaactatgcccggattcaaaaagtgatgaacctgtctgtgcttccgataatgctacatatgcctccgaatgtgctatgaaagaggcagcttgttcaagcggggttttgctggaggttaaacattcaggaagctgtaactcaatttctgaagacacagaggaagaagaagaagatgaagatcaggattattcctttcctatttcaagtattctggagtgg

SEQ ID NO: 250136 - DNA, 1032 bp, Artificial Sequence
  Description of Artificial Sequence: Synthetic coding sequence
atggtgagagctagacatcaaccaggggggctttgtttattattacttttattatgtcaattcatggaagatagatcagctcaagcaggaaattgttggcttagacaagcaaaaaatggacgatgccaagtattatataaaacagaactttctaaggaagaatgttgtagtactggtagattatctacatcatggactgaagaagatgttaatgataatactttgtttaaatggatgatctttaatggaggagctccaaattgtattccatgtaaagaaacctgtgaaaatgttgattgtggacctggaaagaaatgtagaatgaataagaaaaataaaccaagatgtgtgtgtgctccagattgttcaaatattacttggaaaggaccagtatgtggattagatggaaagacttatagaaatgaatgtgctttgttaaaagcacgttgtaaggaacaaccagaattagaagttcaatatcaaggaagatgtaagaaaacatgtagagatgttttttgtcctggatcttcaacatgtgttgtagatcaaacaaataatgcatattgtgtaacttgtaatcgtatttgtccagagccagcatcttcagagcaatatttatgtggaaatgatggagttacctattctagtgcttgtcatcttagaaaagcaacttgtcttttaggtagatcaattggtttagcttatgaaggaaaatgtattaaagcaaaatcttgtgaagatattcaatgtacgggtggtaaaaagtgtctttgggatttcaaagttggaagaggaagatgttcattatgtgatgaattatgtccagattctaaatctgatgaaccagtttgtgcaagtgataatgctacttatgcaagtgaatgtgctatgaaggaagcagcatgttctagtggtgttttacttgaagtcaagcattccggttcatgtaacagtatttcagaagacactgaagaagaggaagaagatgaagatcaagattatagttttccaattagtagtatcctcgaatgg

SEQ ID NO: 250137 - DNA, 1032 bp, Artificial Sequence
  Description of Artificial Sequence: Synthetic coding sequence
atggtcagggctcgtcaccaaccgggcggcctgtgtctgctcctgctgctcctgtgtcagtttatggaagacaggtctgcccaggccggaaactgttggctccgacaggccaagaacgggaggtgccaggtcctttacaagactgagttatccaaggaggagtgttgctccacaggaaggttgtcgaccagttggaccgaagaagatgtgaatgataacaccctgttcaagtggatgatatttaatggcggcgcacctaactgtatcccctgtaaggaaacatgcgagaacgtcgactgtgggcccggtaagaagtgtagaatgaacaaaaagaacaagcccagatgtgtttgcgctcctgattgctctaacattacatggaagggacccgtgtgtggactggacgggaagacataccgtaatgaatgcgccctgctgaaagcacgttgcaaagaacagccggaattggaagtgcagtaccaaggcaggtgcaaaaagacgtgtagggatgtgttctgtcctggctcgtcaacgtgtgtggtggatcagactaataacgcttattgtgtcacatgtaatcggatctgcccagaacctgctagcagtgaacagtatttgtgcggcaatgatggggttacgtacagctccgcctgtcacctgcgaaaggctacctgccttttgggacgtagtatcggcctcgcttacgaggggaaatgtattaaagcaaaaagttgtgaagatattcaatgtaccggcgggaagaagtgtctctgggactttaaggttggacgtggacgatgtagtctgtgcgacgaattatgccccgattctaaaagcgatgagccagtctgcgcgagtgacaatgccacctacgcctctgagtgtgcgatgaaggaagcggcctgcagcagcggagtgctcctagaggtcaagcattcaggaagttgtaatagcatatccgaggatacggaggaggaagaagaagacgaagaccaggattactccttcccaatttcatccattctggagtgg

SEQ ID NO: 250138 - DNA, 1032 bp, Artificial Sequence
  Description of Artificial Sequence: Synthetic coding sequence
atggtccgagcaaggcatcaacccggcgggctatgtcttctactgctgctcctttgccagtttatggaggaccggtctgcacaggcaggcaactgctggctacgccaagctaagaacggacgctgccaggtactgtataaaacagagctgagcaaggaagagtgttgtagtaccggtagactgtctacttcctggaccgaggaggatgtcaacgacaacacactgttcaagtggatgattttcaacgggggggcacccaattgcattccctgcaaggagacttgcgagaatgttgactgtggacccggcaagaaatgtagaatgaataagaaaaacaaaccaaggtgtgtgtgcgcacccgactgttctaacattacctggaagggtccagtctgtggattggatggcaaaacctatcggaatgaatgtgccctgctgaaagcacgctgcaaggagcagcccgaattagaagtgcaataccaaggtcgctgcaaaaagacttgtcgggatgtcttttgccccggctcttctacctgtgtggttgatcagacgaacaacgcgtattgtgtcacatgcaatcgcatctgccctgaaccagccagttcggaacagtatctctgcggcaatgatggtgtgacatacagctccgcatgccacctgaggaaggccacttgtctcctagggagaagcatcgggcttgcatatgaggggaagtgtatcaaggcaaagtcatgcgaggacattcaatgtacaggcgggaaaaagtgtctgtgggacttcaaggtgggcagaggccgttgttctctgtgtgacgaactgtgcccagactcaaagtccgacgaacctgtatgtgcatcggataatgcaacctatgcatcggagtgcgctatgaaggaagccgcctgtagctcaggggtcttacttgaagtaaagcactcaggaagctgtaactctatctccgaagatactgaggaagaggaggaggacgaggaccaggactacagcttccctatctctagcatcctcgagtgg

SEQ ID NO: 250139 - DNA, 1032 bp, Artificial Sequence
  Description of Artificial Sequence: Synthetic coding sequence
atggtcagagcacgccaccagccagggggtctttgcctgttgctgttgttgctctgccagttcatggaggataggtcggcccaggccggaaattgctggctcagacaagccaagaacggcaggtgccaggtcctctacaagaccgaactgtccaaagaagagtgttgcagcacgggacggctgtccacttcatggactgaagaggacgtgaatgacaatactctgttcaagtggatgatcttcaacggaggagccccgaactgtattccgtgtaaagaaacgtgcgagaacgtggattgcgggccaggcaagaagtgcaggatgaacaagaagaacaaacccagatgcgtgtgcgccccggactgttcgaacatcacctggaaagggcccgtgtgcggccttgacggaaagacctatcgcaatgagtgtgcactgctcaaggcacgatgtaaggagcaaccggaactcgaagttcagtaccagggtcgctgtaaaaagacctgcagagatgtgttttgcccggggtcgtccacgtgcgtggttgaccaaaccaataatgcgtactgcgtgacctgcaacaggatctgtcccgaaccggcctcaagcgagcagtacttgtgcggtaacgatggggtgacctactcgtcggcatgccatctccggaaggccacctgcctgctcgggcgcagcatcggcctggcgtacgaaggcaaatgtatcaaggccaagtcctgcgaggacatccagtgtactggcggaaagaagtgcctctgggactttaaagttgggagaggcagatgcagcctgtgcgatgaactgtgcccagactcgaaaagcgacgagccagtgtgcgcctcggacaacgctacttacgcctcggaatgcgcaatgaaagaggcggcctgcagctcgggtgtgctgttggaggtcaagcactccggtagctgcaatagcatttccgaggacaccgaggaggaagaggaagatgaagatcaagattactcgttcccaatctcttcgatcctggaatgg

SEQ ID NO: 250140 - DNA, 1032 bp, Artificial Sequence
  Description of Artificial Sequence: Synthetic coding sequence
atggtccgcgctcgccaccaacctggagggctttgtctactcctcctgctcctatgtcagttcatggaagatcgctcagcgcaggccggaaattgttggcttagacaagcaaaaaacggaaggtgccaggtgctatataaaactgaactgagtaaggaagaatgttgctccacagggagactatctacatcctggactgaagaagatgtgaatgataacacactgttcaagtggatgatatttaatgggggggctcccaactgtattccctgcaaagaaacatgtgagaatgtcgattgtggacccggaaaaaaatgtagaatgaacaaaaaaaataaacctagatgcgtttgcgcacccgattgttcaaatataacgtggaaaggacccgtttgtgggcttgatggaaaaacttatcggaacgaatgtgccctgctaaaagcccgctgcaaagaacagcccgaactagaagtccagtaccaggggaggtgcaaaaaaacatgtcgcgatgtattctgcccaggatctagtacatgtgtggtcgaccagactaataatgcatattgcgtcacatgtaatcgcatctgcccagaacccgctagttctgaacagtatctatgtgggaacgacggagttacgtatagttccgcatgccatcttcggaaggccacttgtctccttggacgctctatagggctagcttatgaaggaaagtgcataaaagctaaatcctgcgaggatattcagtgtacaggggggaaaaaatgcctctgggatttcaaagtagggcgcggacggtgtagtctatgtgatgaactgtgccccgattcaaaatccgatgagcccgtgtgtgcatccgataatgcgacttacgcgagtgaatgtgccatgaaagaagccgcctgttcctctggggtcctcttagaggtaaaacactctggaagttgtaacagtatctctgaagacacagaagaagaagaagaagacgaagaccaggattattccttcccaatcagttctatattggaatgg

SEQ ID NO: 250141 - DNA, 1032 bp, Artificial Sequence
  Description of Artificial Sequence: Synthetic coding sequence
atggtgcgcgcaaggcaccaacctggtggattatgtctactgctgctgctcctgtgccagtttatggaagaccggtcagcacaggccggaaactgttggttacgacaggctaaaaatggaagatgccaggtgctctacaaaacagagctctctaaagaggagtgttgtagcacaggaaggttgtccacctcgtggacggaggaagatgtgaatgataacactctgttcaagtggatgattttcaacggcggtgctcctaactgcataccgtgcaaggagacctgtgaaaacgtggactgtggtccaggcaagaagtgtaggatgaataagaagaacaagcccagatgcgtgtgtgcccctgattgctccaatattacgtggaaaggccctgtgtgcgggctggacggcaagacctacaggaacgagtgtgcattacttaaggcaaggtgcaaggaacagcccgaactcgaagtgcagtaccagggaaggtgcaaaaagacatgccgagacgtgttctgccctggatcgtccacttgcgtcgtcgaccaaaccaataatgcctactgtgtgacgtgcaataggatttgtcccgagccagcctcatcagaacagtacctgtgcggtaacgatggcgtcacctattcgagcgcttgccacctcagaaaggccacttgcctgcttggccgctccattggccttgcctatgaagggaagtgcatcaaggccaagagctgcgaggacatacagtgcacgggcggaaagaaatgtctgtgggatttcaaggtgggcagggggcggtgttctctgtgcgatgagctctgtcctgacagcaaatctgacgagcccgtgtgcgcctcagacaatgctacttatgctagtgaatgtgctatgaaggaggccgcttgctcctccggagtgctcctggaggtcaagcactctggcagttgcaattccatctcggaagataccgaagaggaggaagaggacgaagaccaggactactcttttcctatctctagcattctcgaatgg

SEQ ID NO: 250142 - DNA, 1032 bp, Artificial Sequence
  Description of Artificial Sequence: Synthetic coding sequence
atggtcagagcaaggcatcagcccggggggctctgcctgctccttttgctcctctgccagtttatggaggaccgatctgctcaggcaggcaactgttggctacgacaggctaaaaatggacggtgtcaggttctgtataaaactgagttgtctaaagaagaatgctgctccactgggcgcctgagtaccagctggaccgaggaagatgtgaacgataacaccctatttaagtggatgatctttaacggaggcgctcccaactgcatcccctgtaaagaaacctgcgaaaacgtcgattgcgggccaggaaagaaatgcagaatgaacaagaagaataaaccccggtgtgtgtgtgctccagactgttctaatatcacttggaagggccctgtgtgtggtttggacggcaaaacctatagaaacgagtgcgcgctactgaaggcccggtgcaaggaacaaccagaactagaagtgcagtatcaggggcgctgtaagaaaacctgccgtgatgtgttctgccctgggagctccacctgcgtggtcgaccagaccaacaacgcctactgtgtgacctgtaaccggatctgtccagaacccgcctcgtcagagcaatatctttgtggcaacgatggcgtcacctattcatcagcatgccatctgaggaaggcaacatgccttctgggaagaagcattgggctggcttatgaaggaaagtgtatcaaggcaaaatcatgcgaggatattcaatgtaccggtggtaagaagtgcctctgggacttcaaagtgggaagaggacggtgcagtctgtgtgatgaattgtgccccgactccaaatccgatgaaccggtgtgtgcctcagataacgctacctacgcatctgagtgtgcaatgaaagaggcggcatgcagctccggtgtgctgcttgaggtgaagcactcaggaagttgtaattccattagtgaggacaccgaggaagaagaagaagacgaagatcaggactatagttttcccataagttccatcctcgagtgg

SEQ ID NO: 250143 - DNA, 1032 bp, Artificial Sequence
  Description of Artificial Sequence: Synthetic coding sequence
atggtccgcgcacgccatcagccaggcggattgtgtctgctgctgcttctgctctgccaattcatggaggatcgctctgcacaagcgggaaactgttggctcaggcaagccaagaacggacgttgccaagtgttgtacaaaaccgagctctcaaaggaagagtgttgctcaaccggccggctgtcgactagctggaccgaggaagatgtgaatgataacactctctttaagtggatgattttcaacggcggagctccgaactgcatcccatgtaaagaaacctgcgaaaatgtcgactgtggcccgggtaagaaatgccggatgaacaagaagaataagccgcgctgtgtctgcgccccggactgttccaatatcacttggaaaggcccagtgtgcgggcttgacggaaagacctatcggaacgagtgtgccctgctcaaggcccgctgtaaagaacaaccggaactcgaagtgcagtaccaagggcgctgtaaaaagacgtgccgcgatgtgttttgccctggcagctcaacctgcgtggtcgaccagaccaataacgcatactgcgtgacctgcaacagaatctgcccagaacctgcttcaagcgagcagtacctgtgcggcaacgacggagtaacctattcgtcggcatgtcacctccgcaaagcgacgtgcctcctgggacgctcaatcggtctggcatacgagggaaagtgcatcaaggcaaaatcctgcgaagatattcagtgtactggaggtaagaagtgcctgtgggacttcaaggtgggacgcgggcgctgctcgctgtgcgacgagctttgcccagactcgaagtcagacgaaccagtttgcgcaagcgataatgcgacttacgcctctgagtgcgcgatgaaggaggccgcctgcagctcaggcgtgcttttggaggtgaagcactcgggatcgtgcaactcgatctcggaggataccgaggaggaagaagaagatgaggaccaggactactccttcccgatctcgtctatcctcgaatgg

SEQ ID NO: 250144 - DNA, 1032 bp, Artificial Sequence
  Description of Artificial Sequence: Synthetic coding sequence
atggtacgtgcgcgtcatcaaccgggtggtctatgtctactactactactactatgtcaatttatggaagatcgttcggcgcaagcgggtaattgttggttacgtcaagcgaaaaatggtcgttgtcaagtactatataaaacggaattatcgaaagaagaatgttgttcgacgggtcgactatcgacgtcgtggacggaagaagatgttaatgataatacgctatttaaatggatgatatttaatggtggtgcgccgaattgtataccgtgtaaagaaacgtgtgaaaatgttgattgtggtccgggtaaaaaatgtcgaatgaataaaaaaaataaaccgcgatgtgtatgtgcgccggattgttcgaatataacgtggaaaggtccggtatgtggtctagatggtaaaacgtatcgaaatgaatgtgcgctattaaaagcgcgttgtaaagaacaaccggaattagaagttcaatatcaaggtcgatgtaaaaaaacgtgtcgtgatgttttttgtccgggttcgtcgacgtgtgtagtagatcaaacgaataatgcgtattgtgttacgtgtaatcgaatatgtccggaaccggcgtcgtcggaacaatatctatgtggtaatgatggtgtaacgtattcgtcggcgtgtcatttacgaaaagcgacgtgtttattaggtcgatcgataggtctagcgtatgaaggtaaatgtataaaagcgaaatcgtgtgaagatatacaatgtacgggtggtaaaaaatgtttatgggattttaaagttggtcgtggtcgttgttcgttatgtgatgaattatgtccggattcgaaatcggatgaaccggtatgtgcgtcggataatgcgacgtatgcgtcggaatgtgcgatgaaagaagcggcgtgttcgtcgggtgtattactagaagtaaaacattcgggttcgtgtaattcgatatcggaagatacggaagaagaagaagaagatgaagatcaagattattcgtttccgatatcgtcgatattagaatgg

SEQ ID NO: 250145 - DNA, 1032 bp, Artificial Sequence
  Description of Artificial Sequence: Synthetic coding sequence
atggtgagagccagacatcagcccggaggtctttgcctcctgttgctcctgctttgccaattcatggaagatcgctccgcacaggctggcaactgttggctgcgccaagcaaaaaacggtcgctgccaggtcttgtataagactgaactttccaaagaagaatgttgcagcaccggtaggctctcaacctcctggaccgaggaagatgtgaatgataacactctgtttaagtggatgatattcaatggaggagcaccaaattgcatcccgtgcaaggaaacttgtgaaaatgtcgattgcggtccagggaagaagtgcagaatgaataagaagaacaagccccgctgtgtctgtgcacctgactgcagcaacattacctggaaaggtcccgtgtgtggactcgatggaaagacctatagaaatgaatgtgcacttctcaaggcgcggtgtaaggaacaacctgagcttgaagtccagtatcaaggcagatgcaagaaaacttgtcgggatgtgttttgtcccggttcttcgacctgcgtcgtggatcaaactaataacgcatattgtgtgacttgtaacagaatttgtccagaacccgccagctcggagcagtacctgtgcggcaacgatggagtgacttacagctccgcatgccacctgcggaaggcaacgtgcctgcttggtcgtagcatcggcctcgcatacgagggtaaatgcattaaggccaagtcatgtgaggacattcagtgtaccggggggaagaaatgcctttgggatttcaaagtcggcaggggtcggtgttcattgtgtgacgaactgtgtcccgatagcaagtcggatgagccagtgtgtgcgagcgacaacgctacgtacgcgtccgagtgtgccatgaaagaggcggcgtgcagctccggagttctgctggaagtgaagcattcgggaagctgtaactccatttcagaagatactgaagaagaagaggaggacgaggatcaagattactcgtttccaatatctagcattcttgaatgg

SEQ ID NO: 250146 - DNA, 1032 bp, Artificial Sequence
  Description of Artificial Sequence: Synthetic coding sequence
atggtgcgggccaggcaccagccgggaggactgtgcctcctgcttctccttctgtgccagtttatggaagatagatcggcgcaggctggcaactgttggctgcgccaggccaagaatggacggtgtcaagtcctgtacaaaaccgaactgtcgaaagaagaatgctgctccaccggaaggctgtcaaccagctggacggaagaggacgtgaacgacaatactctgttcaaatggatgatcttcaacggaggagccccaaactgcatcccgtgcaaagaaacttgcgaaaacgtggattgcggtccgggaaagaagtgccgaatgaataagaagaacaaacctcggtgcgtgtgcgcgcccgactgtagcaatatcacctggaaggggccagtttgcggccttgatggaaagacttatcgcaacgaatgtgcgctcttgaaggctcggtgtaaggagcaaccagaactcgaggtccagtaccagggccgttgcaaaaagacttgcagagatgtgttttgccccggatcgtcaacctgcgtggtggatcagactaataacgcctactgcgtgacttgtaacagaatctgccctgaaccggcgagctcggagcaatacctgtgcggcaatgacggagtgacctactcctctgcatgccacctgcgcaaggcaacctgtttgctcggtcgctccatcgggctggcatacgaaggcaagtgtattaaggcgaagagctgcgaggacattcaatgtacgggaggaaagaaatgcctgtgggacttcaaggtcggtcgggggcgctgctcgctctgcgacgaactctgcccagactcgaagtcggacgagccggtctgcgcctcagacaacgcaacttacgccagcgaatgtgccatgaaagaagccgcttgttcgtccggcgtgttgctggaagtcaagcattccggtagctgcaactccatctcagaggacaccgaggaagaggaggaggatgaggatcaggattactccttcccgatcagttcaatcctggagtgg

SEQ ID NO: 250147 - DNA, 1032 bp, Artificial Sequence
  Description of Artificial Sequence: Synthetic coding sequence
atggtgagggcacgacaccagcctgggggcctctgcctcctgctgctgttattgtgccagtttatggaagaccgcagcgctcaagctggcaactgctggctcagacaggcaaagaacggacgttgccaggtgctttacaaaacggaactgtctaaggaggagtgctgctcaactgggcggctgtccacgagctggaccgaggaagatgtaaatgataacacgttgtttaagtggatgatttttaatggaggagcccctaattgtatcccctgcaaggaaacgtgtgaaaacgtcgattgtggcccgggcaagaagtgtaggatgaacaagaagaacaagcctagatgcgtgtgcgcaccggactgtagcaacatcacctggaaaggcccggtttgcggactcgacggaaagacatatcggaacgagtgtgccctattaaaggcccgctgtaaagaacagcctgaacttgaagtccaatatcagggacgatgcaaaaaaacttgccgggatgtgttttgccccggaagcagcacgtgcgtcgtggaccagaccaataacgcctattgcgttacatgcaatcggatatgccccgagcccgccagttctgaacagtacctgtgcggtaatgacggagtgacctacagttcagcttgccacctcagaaaggccacttgtttactaggccgctccataggcctggcatacgaaggaaagtgcatcaaagccaagtcttgtgaggatatacagtgtacaggtgggaagaagtgcctgtgggacttcaaagtcggtcggggcaggtgtagcctctgtgacgaactctgtcctgactctaaatcggacgagcccgtatgtgcctctgacaacgcgacctacgccagcgagtgcgcgatgaaggaggccgcttgttcgtcgggcgtgctgttagaggtcaagcattccgggtcctgcaattcaatttctgaagacacagaggaagaggaggaggacgaggaccaagattatagtttcccgatctccagcatactggagtgg

SEQ ID NO: 250148 - DNA, 1032 bp, Artificial Sequence
  Description of Artificial Sequence: Synthetic coding sequence
atggtccgcgcgcgccaccagccagggggcctgtgtctactgctccttctgctctgccagtttatggaagaccgtagtgcacaggcaggcaattgctggctgcgccaggcaaaaaacggaaggtgtcaggtgctctataagaccgagctgagtaaggaggagtgctgttccacgggtaggctcagtaccagctggactgaagaagacgtgaatgataacaccctcttcaagtggatgatcttcaatggcggtgcaccaaactgcattccttgcaaagagacatgtgagaacgtggattgtgggcccggaaagaaatgccgcatgaataaaaagaacaagcctcggtgcgtgtgtgcaccagactgtagtaatatcacatggaaggggcccgtatgcggacttgatgggaagacctaccggaatgagtgcgctctattgaaggctcggtgcaaggaacagcccgagctggaggtccagtatcaaggacgctgcaagaagacttgcagggatgttttttgcccagggtcatctacttgcgtcgtagaccagaccaacaatgcatattgcgtcacttgtaacaggatctgccccgagcctgcttcttcagaacaatatctctgcggcaacgatggagtgacctatagctctgcttgtcatctccgcaaagcaacatgtcttctcggcagaagtattggactggcttatgagggaaagtgtatcaaggccaaatcatgcgaagatatccagtgcaccggaggcaagaaatgtctctgggatttcaaggtgggtcgtggccgctgtagcctttgcgacgagctttgcccagattcgaagtcagacgagcctgtctgtgcctctgataacgccacctatgcatcggagtgtgccatgaaggaggccgcttgttccagcggcgtacttctggaggtaaagcacagcggcagttgtaattctatctccgaggatacggaggaggaggaggaggatgaggaccaggattattcgtttcccattagttctattctggaatgg

SEQ ID NO: 250149 - DNA, 348 bp, Artificial Sequence
  Description of Artificial Sequence: Synthetic coding sequence
atgccagctccctggactatctgttccctcctgcttctgtcagtgctctgtatggaccttgccatggccggctcctcattcctgagcccagagcaccagaagttgcagcgtaaggaggccaagaaacctagcggaagactgaagccccgaacattggaggggcagtttgaccccgaggtgggatcccaggctgagggcgccgaggatgagctggagatccgctttaatgccccctttaacattgggattaagctggccggcgctcaatccttacaacacggccaaactctcggcaagtttctgcaagatattctgtgggaagaagcagaagagacccttgcaaatgag

SEQ ID NO: 250150 - DNA, 348 bp, Artificial Sequence
  Description of Artificial Sequence: Synthetic coding sequence
atgcccgcaccatggacgatttgctcgcttttgcttctgtcggtcctgtgcatggacctggcaatggccggctccagcttcctttccccagagcaccaaaaactgcagaggaaggaggccaagaaaccctctggccggttaaagccacgcacactagaggggcagttcgatcccgaggtgggatcacaggccgaaggtgcagaggatgagcttgaaatacggttcaatgcccccttcaatataggaatcaaactcgcaggggcccagtcgctccagcacggacaaaccctagggaaattcctgcaggacattctttgggaagaagcggaagaaaccctggcaaatgag

SEQ ID NO: 250151 - DNA, 348 bp, Artificial Sequence
  Description of Artificial Sequence: Synthetic coding sequence
atgcctgcgccctggacgatctgctcgttgctgctcctgtcggtgctgtgtatggatctcgcaatggccggttcatctttcctctcccccgagcaccagaaacttcaaagaaaagaagcgaagaagccttcgggccgcctgaagccgaggaccttggagggccaatttgacccagaggtcgggtcacaggcggaaggcgccgaggacgaactcgaaattcggttcaacgccccgttcaatatcggtatcaagctggctggagcacaatcccttcagcatggacaaacgcttgggaagtttctgcaagatattctctgggaagaagcagaggaaaccctggctaacgag

SEQ ID NO: 250152 - DNA, 348 bp, Artificial Sequence
  Description of Artificial Sequence: Synthetic coding sequence
atgccagctccatggactatttgttcattgttgttacttagtgttttatgtatggatcttgctatggcaggatcttcttttttatcaccagaacatcaaaaattacaaagaaaagaagctaaaaagccatcaggacgacttaagcctagaactttagaaggacaatttgatcctgaagttggttctcaagctgaaggagctgaagatgaacttgaaattagattcaatgcacctttcaatattggaatcaagcttgcaggagctcaatcattacaacatggacagactttaggaaaatttcttcaagatattctttgggaagaagctgaagaaacattagcaaatgaa

SEQ ID NO: 250153 - DNA, 348 bp, Artificial Sequence
  Description of Artificial Sequence: Synthetic coding sequence
atgcctgcgccatggactatctgttcccttctgttgctttcagtgctctgcatggatctcgctatggcggggtcatcctttctaagccccgaacaccagaagctgcagcgaaaagaggcaaagaagccttccgggagactcaagccgagaacgctggaggggcaattcgacccggaggtcggtagccaagcagagggcgcagaggacgagctggagatcaggtttaacgcaccctttaacatcggtataaaactggcaggagcacagagcttgcagcatgggcagactctagggaagttcctgcaggacattctctgggaagaggcagaggaaacactggctaatgaa

SEQ ID NO: 250154 - DNA, 348 bp, Artificial Sequence
  Description of Artificial Sequence: Synthetic coding sequence
atgcccgcgccttggactatttgttcactgctgttgctctcggttctttgcatggatctggcaatggccgggtcgtcatttctctccccagaacatcaaaagctccaacgtaaagaagcaaaaaagccaagcggccggctgaagccgcgcaccctggaaggccagttcgatcctgaagtgggaagccaagccgaaggtgcggaggacgaactggagattagattcaacgcaccctttaacataggcattaagctcgcaggggcgcagtccttgcagcacggtcaaactttggggaaatttctgcaagatatcctgtgggaggaggcagaagaaacgctggctaatgaa

SEQ ID NO: 250155 - DNA, 348 bp, Artificial Sequence
  Description of Artificial Sequence: Synthetic coding sequence
atgccggctccgtggaccatctgctcgcttctcctgctttccgtgctctgtatggacctggcaatggccggatcgtcgttcctgtcccctgagcatcagaagctgcagcgcaaagaagctaagaagccatcaggccggctgaaaccccggaccctggaaggacaatttgatcctgaagtgggaagccaggctgaaggcgctgaggacgaactggaaatcaggtttaatgcaccgttcaacatcggaattaagctggccggcgcacagagcttgcagcacgggcagaccctgggaaagttcctgcaagacatcctctgggaggaggcagaggaaaccctcgctaatgaa

SEQ ID NO: 250156 - DNA, 348 bp, Artificial Sequence
  Description of Artificial Sequence: Synthetic coding sequence
atgcctgcaccctggactatttgcagcctcttgttgctgtcggtgttgtgtatggatctcgcaatggctggttcctcatttctttcaccagagcatcaaaaacttcagcggaaggaagcgaaaaagccctcgggacgacttaaaccaagaaccctcgaagggcagtttgatccggaagtgggatcccaggcagagggagctgaagatgaactcgaaattaggttcaatgccccctttaacattggaatcaagttggcaggagcccaatccctccagcatgggcagacccttgggaaatttctgcaagacattctttgggaggaggccgaagaaaccctggccaacgaa

SEQ ID NO: 250157 - DNA, 348 bp, Artificial Sequence
  Description of Artificial Sequence: Synthetic coding sequence
atgccagctccgtggacgatatgctcactgctcttgctcagcgtcctctgtatggacctcgccatggctggctcctcatttctgtctcccgagcaccaaaagctccagagaaaggaagcgaagaaaccgagtggccgactgaagcctcgcactctggagggccagttcgatccggaagtgggcagccaagcggagggagcagaagatgagctggagatccggttcaacgctccgttcaacatcggaattaagctcgccggtgcccaatcgcttcagcatgggcagaccttggggaaattcctgcaggacatcctttgggaggaagccgaagaaaccctggcgaatgaa

SEQ ID NO: 250158 - DNA, 348 bp, Artificial Sequence
  Description of Artificial Sequence: Synthetic coding sequence
atgccagcgccgtggaccatttgctcccttctgcttctctccgttttgtgtatggatttagccatggccgggtcaagttttttatcccctgaacatcaaaaacttcagcgaaaggaggctaagaagccatcagggagactcaaaccaagaacgcttgaaggacaattcgatcctgaagtaggatcccaagcagagggtgccgaagatgagcttgagatcaggttcaacgcaccattcaatattggcattaaactcgccggtgctcaatcgctacaacatggacaaactcttggaaaattcttgcaagatattttgtgggaagaggctgaagaaactttagctaacgag

SEQ ID NO: 250159 - DNA, 348 bp, Artificial Sequence
  Description of Artificial Sequence: Synthetic coding sequence
atgcccgccccgtggaccatctgttccctgttgctgctgtccgtcttgtgcatggatctggccatggccggctcgtcatttctcagcccggagcatcagaagctccaacggaaggaggcaaagaagccatcaggccgccttaagccacgcaccctggagggccagttcgacccagaggtgggatcccaggcagaaggagcggaagatgagctcgaaatccgcttcaatgcgccattcaacattggaatcaaactggcgggtgcccaatcgctgcagcacggacagacgctgggcaaattcctgcaggacatactgtgggaggaggcagaggaaaccctggcaaatgag

SEQ ID NO: 250160 - DNA, 348 bp, Artificial Sequence
  Description of Artificial Sequence: Synthetic coding sequence
atgcctgctccttggactatttgttcgctgcttctcctttcagtgctctgcatggatctggcaatggcaggttcctcgtttttgtcaccggagcatcaaaaactccagagaaaggaggcaaagaagccatccgggagactcaagccccggaccctggagggacaatttgaccctgaagtcggaagccaagcagagggcgccgaagatgaactcgaaatccgattcaacgcaccattcaacattggaatcaaacttgcaggggcccaaagcctgcagcacgggcaaactcttggcaagtttctgcaggacatcctgtgggaagaagcggaagaaaccctcgcaaatgaa

SEQ ID NO: 250161 - DNA, 348 bp, Artificial Sequence
  Description of Artificial Sequence: Synthetic coding sequence
atgcctgctccatggaccatctgcagtctgttgctgcttagcgtcctgtgtatggatctggctatggccggctcgtctttcctatcgcctgagcatcaaaagctccagcgtaaggaggccaagaaaccctctggaaggcttaaacctcgcactctcgagggccaattcgatcccgaagttggatcacaggcagaaggcgccgaagatgaacttgaaattcggtttaatgctcccttcaacataggtattaaattagccggcgcccagagtctgcaacacgggcaaacactgggaaaatttctgcaagacatcctctgggaagaggccgaagagaccttggctaatgaa

SEQ ID NO: 250162 - DNA, 348 bp, Artificial Sequence
  Description of Artificial Sequence: Synthetic coding sequence
atgcctgccccctggaccatttgcagcttactgcttctctcagtactctgcatggaccttgctatggccggttcctcttttctatcccctgagcatcagaaactccaaagaaaggaggccaagaagccgtccggtcgactgaaaccccgaaccttggagggccaatttgatcctgaggtgggatcgcaggccgagggcgccgaggacgaactggaaatcagatttaacgcaccttttaacattggtattaaattggctggcgcccagtcactacaacacggacaaacccttggtaagttcttacaagacatcctttgggaggaggccgaggagacattggccaatgag

SEQ ID NO: 250163 - DNA, 348 bp, Artificial Sequence
  Description of Artificial Sequence: Synthetic coding sequence
atgcccgccccttggaccatctgctcattgctcctgcttagcgtcctgtgtatggacctggcaatggcaggaagctccttcctgtcaccagaacatcagaagctccaacggaaagaggctaagaaaccgtcgggccgcctcaagccaaggactctggagggacaattcgacccggaagtggggtcccaagccgagggagctgaagatgaactggaaatcagattcaacgcgccgttcaatatcggcatcaagctggcgggggcccagtcgctccagcacggacagactctgggtaagtttttgcaggatattctttgggaagaggccgaggaaaccctcgcgaacgag

SEQ ID NO: 250164 - DNA, 348 bp, Artificial Sequence
  Description of Artificial Sequence: Synthetic coding sequence
atgccagccccctggacaatctgctccctgcttctactgagtgttttatgtatggacctcgctatggccggatcctcgttcctgagtccagagcaccagaaattacagcgaaaagaagcgaaaaaacccagcggcaggctgaaacctcgaactctggaggggcaattcgatcctgaggtgggctcacaggccgaaggggccgaggatgagctcgaaatcagatttaacgcccccttcaatatcggcattaaacttgcaggagcacagtcgttgcagcacgggcagaccctgggaaaattcctccaggacatactgtgggaagaggcagaggaaactcttgctaatgaa

SEQ ID NO: 250165 - DNA, 348 bp, Artificial Sequence
  Description of Artificial Sequence: Synthetic coding sequence
atgccggcaccgtggaccatctgcagtctgctcctgttgagtgttctgtgcatggacttggcaatggccggttcaagctttctctctcctgaacaccaaaagctgcagagaaaggaagcaaagaagcctagcggtcgactgaagccccgcacgctggagggccagttcgaccctgaggttggttcgcaagcagagggtgccgaggatgagctggaaatccgtttcaatgcccctttcaatatagggattaaacttgccggggcgcagagtctccagcatgggcagaccctgggaaagttcctgcaggatatcctgtgggaagaggctgaagagaccctggccaacgaa

SEQ ID NO: 250166 - DNA, 348 bp, Artificial Sequence
  Description of Artificial Sequence: Synthetic coding sequence
atgcccgccccttggaccatatgttccctccttctcctgagcgtactttgcatggatctagctatggccggaagctcattcctcagccctgagcatcagaaattgcagcgaaaggaggccaagaagcctagcggccgcctgaagccacggaccctggagggtcagtttgatccggaagtgggctctcaagccgaaggcgccgaggatgagctggaaattaggttcaatgctcccttcaacattgggattaagcttgctggcgcacagagccttcagcatggacaaacattaggaaagttcctccaggacatattgtgggaggaggcagaggaaaccctcgcgaacgag

SEQ ID NO: 250167 - DNA, 348 bp, Artificial Sequence
  Description of Artificial Sequence: Synthetic coding sequence
atgcccgcaccttggacgatatgttcgcttctccttctctcggtcctgtgcatggatcttgccatggcgggtagctcatttctgtcgcccgagcaccaaaagttgcagagaaaggaagctaagaagcccagcggtaggctgaaacctcgaaccctggagggacagttcgatccggaggtcggatcccaggccgaaggcgccgaagatgagctggaaattcgttttaacgctccatttaacatcgggattaaacttgcaggtgcgcagtccctgcagcatggacaaaccctcggtaagtttcttcaagacatactctgggaggaggctgaagagactctcgcgaacgaa

SEQ ID NO: 250168 - DNA, 348 bp, Artificial Sequence
  Description of Artificial Sequence: Synthetic coding sequence
atgccagctccctggactatttgctccttactgctattatctgtcttgtgcatggatttggctatggccggttccagcttcctcagcccggaacatcagaagcttcaaagaaaggaggccaaaaaacccagcggtcgactgaaaccaaggacactagaagggcagtttgatcctgaagttggatcgcaggccgaaggggctgaggatgaactcgagattcgttttaacgcccctttcaatattggaataaagctcgctggcgctcagagtctgcagcacggccagaccctcggcaagtttcttcaagacattctgtgggaggaggctgaggagactctggcgaatgag

SEQ ID NO: 250169 - DNA, 348 bp, Artificial Sequence
  Description of Artificial Sequence: Synthetic coding sequence
atgccagctccatggacaatatgctcactactcctcctctcggttctctgtatggacctagccatggccgggtcttcttttttatcacctgaacatcagaaactgcagcggaaagaggcaaaaaaacctagtggaaggttaaaacccagaacattagaaggacagttcgatccagaggtggggtctcaggcagaaggggcggaagatgaactggaaataaggttcaatgctccattcaatataggaattaagctggcaggggctcaatctcttcagcatgggcagactctgggaaaatttctccaagatattctctgggaagaggctgaagaaacactagcgaatgag

SEQ ID NO: 250170 - DNA, 348 bp, Artificial Sequence
  Description of Artificial Sequence: Synthetic coding sequence
atgcctgccccttggacgatatgctccttattattgctctcggtactttgtatggacctggctatggcaggcagtagtttcctgagtccggaacatcagaagcttcagcgcaaggaggctaagaaaccgtctggccgactaaagcctcgtacgcttgagggtcagtttgacccagaggttgggagccaggcagaaggtgctgaggatgaattggagattagattcaatgctcctttcaacattgggataaagctcgcgggggcacagagtctgcagcatggccagactctcggcaaattcctgcaagacatcctttgggaggaagctgaagagacattggctaacgag

SEQ ID NO: 250171 - DNA, 348 bp, Artificial Sequence
  Description of Artificial Sequence: Synthetic coding sequence
atgccagctccttggacaatttgttctctcctcctgctttctgtattgtgcatggatctggcaatggcaggatcatcctttctgagccccgagcatcaaaaacttcagagaaaggaggcaaagaagccatctggccgcctgaagcctcgcaccctggagggccagttcgatcctgaagtgggatcccaggccgaaggcgctgaggacgagctcgagatcagatttaatgcgcctttcaacatcggcataaagctggccggcgcccagtcactgcagcacggacaaactctcggtaagtttctgcaggatatcctgtgggaagaggcagaagaaaccctggcgaatgaa

SEQ ID NO: 250172 - DNA, 348 bp, Artificial Sequence
  Description of Artificial Sequence: Synthetic coding sequence
atgcctgcgccctggaccatatgtagcctgctgctcctttctgtgctgtgcatggatctggccatggcaggatcatcctttctctcaccagaacaccagaagctgcagcggaaggaagctaagaagccctccggccggctgaagccacgaaccctggaagggcaattcgatcccgaggtcggcagccaggctgaaggcgcagaggacgaactagagattaggtttaatgccccttttaacatcgggatcaagctcgcgggggcccagtcattacaacacggtcaaacgcttggcaagttcctgcaggatatcttatgggaggaggccgaggaaaccctggctaacgag

SEQ ID NO: 250173 - DNA, 348 bp, Artificial Sequence
  Description of Artificial Sequence: Synthetic coding sequence
atgcctgccccctggactatttgctctttgctcctgttgagcgtgttgtgtatggatctggctatggcagggtcctctttcttgtcaccagaacaccagaagttgcaaaggaaagaggctaagaagccatctggcaggctgaaacccagaactctggagggtcagtttgacccagaagtcggatcccaagcggagggtgcggaggacgaactcgagatccgattcaacgcacccttcaacatcggcattaaattggccggtgcacagagtttgcagcacggccaaaccctcggaaagttcctccaagatatcctttgggaggaagccgaagaaacgttggcaaatgaa

SEQ ID NO: 250174 - DNA, 348 bp, Artificial Sequence
  Description of Artificial Sequence: Synthetic coding sequence
atgcctgccccatggactatttgttccctgcttcttctctccgtcctttgcatggacctcgcgatggccggctcctctttcttatcaccggagcaccagaagctgcaacgcaaagaggcaaagaagccgtccggaagactgaaaccccgcactctggaggggcagttcgaccccgaagtgggatcccaggccgaaggagctgaggacgaactggaaatccggttcaacgcaccgttcaatatcggcattaaactggctggagcacagagcctccagcatggacagactctgggtaaattcctccaggacatcctgtgggaggaagctgaagagaccctggccaatgag

SEQ ID NO: 250175 - DNA, 348 bp, Artificial Sequence
  Description of Artificial Sequence: Synthetic coding sequence
atgccggcgccgtggacgatatgttcgttactactattatcggtattatgtatggatctagcgatggcgggttcgtcgtttttatcgccggaacatcaaaaattacaacgaaaagaagcgaaaaaaccgtcgggtcgtttaaaaccgcgaacgctagaaggtcaatttgatccggaagtaggttcgcaagcggaaggtgcggaagatgaattagaaatacgatttaatgcgccgtttaatataggtataaaattagcgggtgcgcaatcgctacaacatggtcaaacgctaggtaaatttctacaagatatattatgggaagaagcggaagaaacgttagcgaatgaa

SEQ ID NO: 250176 - DNA, 348 bp, Artificial Sequence
  Description of Artificial Sequence: Synthetic coding sequence
atgcccgccccatggaccatctgttctcttctgttgctcagcgttctatgtatggatctcgcaatggctgggagttccttcctgtctcccgagcaccagaaactgcaacggaaggaggccaaaaagccatcaggacgcttgaaaccgaggaccttggagggccagtttgacccagaggtcgggtcacaggcagaaggagccgaggatgagctggaaatccgcttcaatgcacccttcaacattggcattaagcttgccggagctcagtccctgcagcatgggcagactctcggaaagtttctgcaggacatcctgtgggaagaggccgaagagactctcgctaacgaa

SEQ ID NO: 250177 - DNA, 348 bp, Artificial Sequence
  Description of Artificial Sequence: Synthetic coding sequence
atgccggccccatggacaatttgcagcctgttgctcctctccgtgctgtgtatggacctcgcgatggctggctctagttttttaagtcccgaacaccaaaagctgcagagaaaggaggcaaaaaagccttctggcagactcaagcctagaaccctggagggccagttcgatcctgaagtgggaagccaagccgaaggtgctgaagacgagctcgaaatccggtttaacgccccattcaacataggtataaagctggcaggtgctcagtctttgcagcacgggcaaaccctcggaaaattcctccaggatattctttgggaagaagctgaggagaccctggcaaatgaa

SEQ ID NO: 250178 - DNA, 348 bp, Artificial Sequence
  Description of Artificial Sequence: Synthetic coding sequence
atgcctgccccatggacgatctgctccctgctgctgttgtccgtgctctgcatggacctggcaatggcgggttcgtcgttcctgtctccagaacaccagaagctccaaaggaaggaggccaagaagccttcgggaaggctgaagccacgcaccctggagggccagtttgacccagaggtggggagccaggctgaaggagccgaggacgagcttgaaattcgcttcaacgcgccgttcaacatcggcatcaagctcgcgggagcccaaagcctccaacatggccagaccctgggaaagttcctgcaggacatcctctgggaagaggcagaagaaaccctcgcaaacgag

SEQ ID NO: 250179 - DNA, 348 bp, Artificial Sequence
  Description of Artificial Sequence: Synthetic coding sequence
atgccggcgccttggactatatgctcgctcctcctgctgtcagtgctctgcatggatctggcgatggccggctcgagcttcctgtccccagaacatcaaaaactgcaaagaaaggaggcgaagaaaccatcgggccgcttgaagcctagaactctcgagggacagttcgacccggaggtcggtagccaagcggaaggcgccgaggacgaactggaaatccggttcaatgctccgtttaacatcggaatcaagctggcgggggcgcagtccttgcagcatggacagactctcggaaagttccttcaggacatcctctgggaggaggcagaggaaaccttggccaacgag

SEQ ID NO: 250180 - DNA, 348 bp, Artificial Sequence
  Description of Artificial Sequence: Synthetic coding sequence
atgccggccccatggaccatatgtagtctgctcctcttgtctgtgctgtgcatggatttggccatggccggatcctcatttctgtcgcctgagcaccagaagctgcagagaaaggaagctaagaagccttccggacgtcttaagccgcgtacactggagggccaatttgaccccgaggtgggctcgcaggccgagggagcggaggatgagctagagattcgcttcaatgccccattcaatatcggcatcaaactggcgggagcgcagagccttcagcatggtcagaccctcggcaagtttctgcaggacattctgtgggaggaggctgaagagactttggcaaatgag

SEQ ID NO: 250181 - DNA, 348 bp, Artificial Sequence
  Description of Artificial Sequence: Synthetic coding sequence
atgccggctccgtggactatttgttccctactcctgctcagtgtgctgtgcatggatctagcaatggctggttcttcatttctgagccctgagcatcagaagctgcagcgaaaggaagcaaaaaaaccatctggacggctgaagccccgaaccctcgaaggtcaattcgacccagaggttggatctcaggctgaaggcgccgaggatgagttggaaattcgcttcaatgccccgttcaacatcggaataaagctggctggagcacagtccctgcagcacggacagaccttggggaaattcttacaagatatactctgggaggaggccgaggaaacactggctaacgag

SEQ ID NO: 250182 - DNA, 348 bp, Artificial Sequence
  Description of Artificial Sequence: Synthetic coding sequence
atgccagcgccctggactatttgttccctccttttgctgtccgtgctctgcatggatctggcgatggctggctctagtttcctatccccagagcatcagaaactgcaacgcaaggaagcaaaaaaacctagcggccgtctcaaacctaggaccctcgagggacaattcgatcccgaagtcggctctcaggcggaaggcgccgaggatgagctggaaatacgtttcaacgcacctttcaacattgggatcaaactagccggggcgcagagcttacagcacggccaaacccttgggaagtttctgcaggatattctctgggaggaggcagaggagaccctcgccaacgag

SEQ ID NO: 250183 - DNA, 348 bp, Artificial Sequence
  Description of Artificial Sequence: Synthetic coding sequence
atgcctgcaccttggaccatatgttcgctgttgctgctctcagtgctttgcatggatcttgctatggcaggatcctcgtttctcagccctgagcatcagaagctgcagagaaaggaggccaaaaaaccctcgggtcgacttaagcctagaaccttggaaggtcaattcgacccggaagtgggatcgcaagccgagggtgccgaagatgaacttgaaattcggttcaatgcgccgtttaacattggcattaaacttgctggcgcccaatcactgcaacatggacagacgctcggaaagtttttgcaggacattctgtgggaagaagccgaagaaaccttggcaaatgaa

SEQ ID NO: 250184 - DNA, 348 bp, Artificial Sequence
  Description of Artificial Sequence: Synthetic coding sequence
atgcctgcgccatggactatttgttcgctgttgctcttgagcgtgctgtgtatggatctggcaatggcgggatcgagctttctgtccccagaacaccaaaagctccaacggaaagaagcgaagaagccttcaggcagacttaaaccccgcactttggagggacaattcgatcccgaggtgggctcacaggcagaaggagcagaggatgaactggagatccgcttcaacgcgccatttaacataggcattaaactggcaggcgctcaatctctccagcatggacaaaccctcgggaagttcctgcaagatatcctctgggaggaggcagaagaaaccctggccaatgaa

SEQ ID NO: 250185 - DNA, 348 bp, Artificial Sequence
  Description of Artificial Sequence: Synthetic coding sequence
atgcctgccccgtggaccatctgcagcctcctgctgctgagcgtgctttgtatggacctggcgatggcggggagctccttcctgagcccagagcaccagaaactgcagaggaaggaggctaagaagccatccggacggctgaagcctcgcactcttgaagggcagttcgacccagaagtcgggtcacaagccgaaggagccgaggatgaacttgaaattagattcaatgccccgttcaacataggcatcaagctggcaggggcccaatcgctgcagcatggccagacgctgggtaagttcctgcaggatatcttgtgggaggaggccgaagagactctcgcgaacgaa

SEQ ID NO: 250186 - DNA, 348 bp, Artificial Sequence
  Description of Artificial Sequence: Synthetic coding sequence
atgcctgctccttggaccatctgcagcctcttgttgctctcagtcctttgcatggatctggccatggccggctccagcttcttaagcccagagcaccagaagctccaacgcaaggaagcgaagaaacccagtgggaggctgaagcctaggactctggagggccagtttgaccctgaggtgggcagccaagcagagggtgccgaggatgaattggagattcgctttaatgccccatttaacattggtataaaacttgccggcgctcagtctttgcagcacggacaaacactcggaaagtttctccaagatatcctgtgggaagaagctgaggagactcttgctaacgag

SEQ ID NO: 250187 - DNA, 348 bp, Artificial Sequence
  Description of Artificial Sequence: Synthetic coding sequence
atgccagcaccttggaccatttgctcactgttgcttttgtccgttctctgtatggacctcgccatggccgggtcttcattcctgagtccggaacaccaaaagctccaacggaaggaagccaagaagccttctggacggctcaagcccaggacactggaggggcagtttgaccccgaggtgggaagtcaagccgaaggggcagaggacgagttggagatcaggttcaacgcgccattcaatatcggtattaagctggcgggggcccagtccctccaacatggtcagacgttaggcaagttccttcaagacattctttgggaggaggcagaagagaccttggctaacgag

SEQ ID NO: 250188 - DNA, 348 bp, Artificial Sequence
  Description of Artificial Sequence: Synthetic coding sequence
atgcccgcaccttggacgatttgctcgctgctgctcctcagtgtgctctgcatggacttggccatggccggttcctccttcctgtcacccgagcatcagaaacttcagcgaaaagaagccaagaaaccatcggggagactaaaaccacgaactctagaaggacaatttgatccggaggtcggctcccaggcggaaggcgccgaagatgagctggagataaggtttaatgcccccttcaatatcggaataaaattggccggagcccagtcactacagcacggtcagactctgggtaaattcctgcaggatatcctgtgggaggaagccgaggaaactctggcaaacgaa

SEQ ID NO: 250189 - DNA, 348 bp, Artificial Sequence
  Description of Artificial Sequence: Synthetic coding sequence
atgcctgccccctggactatctgctcactgctgctgctctcggttctgtgcatggatttggcaatggccggatcgtcgttcctctccccggagcatcaaaaactccaacgcaaggaagctaagaagccgtcgggaaggctcaagccacggacccttgaaggacagttcgacccggaggtgggctcccaggccgagggggccgaagatgagctggaaatcaggttcaatgcgcctttcaatattggcatcaaactggccggggcccagtcgctccagcatggtcagacccttggcaaattcctgcaagatatcctgtgggaggaagccgaggagactctcgcgaacgaa

SEQ ID NO: 250190 - DNA, 348 bp, Artificial Sequence
  Description of Artificial Sequence: Synthetic coding sequence
atgcccgccccttggactatatgcagcctgctgctgctgtccgtgttgtgtatggatctcgcaatggcaggttcatcgttcctgtcacctgagcaccagaaattgcagcggaaggaggctaagaagccctccggtagactgaagccccgcacccttgagggtcagtttgacccagaagtgggtagtcaagccgaaggcgcggaagatgaactggaaatacgatttaacgcaccttttaacatcgggatcaagctggctggagcacaatccctgcaacatggtcagactctggggaaattcctgcaagatattctttgggaagaagcagaggaaacccttgcaaatgag

SEQ ID NO: 250191 - DNA, 348 bp, Artificial Sequence
  Description of Artificial Sequence: Synthetic coding sequence
atgccagccccttggacgatctgtagcctcctcttactgtccgtgttgtgcatggatttagctatggccggctcctccttcctctcgcccgaacaccagaaactccagcggaaggaggctaagaaaccttccggccgcctaaaacctcgcacgctggagggccagttcgatcctgaggtgggttctcaggccgaaggcgccgaggacgaactcgaaatccggtttaacgcccctttcaacatcggcatcaaactggctggagcccaatccttgcagcatggacagacccttggcaaattcttgcaggatatactgtgggaggaggctgaagagactttggctaatgaa

SEQ ID NO: 250192 - DNA, 348 bp, Artificial Sequence
  Description of Artificial Sequence: Synthetic coding sequence
atgccagctccatggacaatctgttcactcctgttgctttctgtactctgcatggatttagcgatggctggtagttcattcttgtcccctgaacatcagaaactacagcggaaggaggctaagaaaccaagtgggaggctgaaacctcgcactttggaagggcagttcgatccagaggtcggatcccaagcggagggcgcagaagacgagttagaaatcaggtttaacgcaccattcaacataggtattaagttggctggtgctcagagtctccaacatggccagacattaggtaagtttttgcaagatattttgtgggaggaggcagaagaaactttagctaatgaa

SEQ ID NO: 250193 - DNA, 348 bp, Artificial Sequence; identical to SEQ ID NO: 250164
  Description of Artificial Sequence: Synthetic coding sequence

SEQ ID NO: 250194 - DNA, 348 bp, Artificial Sequence
  Description of Artificial Sequence: Synthetic coding sequence
atgccagccccctggaccatttgctctctgctgctcttatctgtcctgtgtatggaccttgccatggctggttcgtcttttctctcccccgaacatcagaagctccagcgtaaagaggctaagaaaccttcgggccgactcaagccaaggacattggaaggccagtttgatcctgaggtgggttcacaggcagaaggggccgaggatgagcttgagatccgcttcaatgccccattcaacatcggtatcaagctggctggcgcgcagtcactccagcacggccagacgctgggtaagttcctgcaggatatcctatgggaagaggccgaggaaacgctggccaacgaa

SEQ ID NO: 250195 - DNA, 348 bp, Artificial Sequence
  Description of Artificial Sequence: Synthetic coding sequence
atgcctgcaccctggactatctgctccttgctgctcctgtcggtgttgtgtatggatctggcaatggcgggaagcagcttcctctcaccagaacaccaaaagttgcagaggaaggaagcgaaaaagccgtcgggaaggctgaagccaagaaccctcgaagggcaattcgaccctgaggtggggtcgcaggccgaaggagccgaggatgaactggagatccggttcaacgccccgttcaatattggcatcaagctcgccggggcacaatccctgcagcatggccagactcttgggaaatttctgcaagacatcttgtgggaggaggcggaagaaacccttgccaacgag

SEQ ID NO: 250196 - DNA, 348 bp, Artificial Sequence
  Description of Artificial Sequence: Synthetic coding sequence
atgcctgccccatggactatttgttcactgctcctgctcagcgtgctgtgtatggatcttgcaatggccggctcatcgttcctgtccccagaacatcagaaacttcaacggaaggaagccaagaagccaagcggacgccttaaacctcgcacgctggaaggacaatttgaccccgaggtgggtagccaagcagaaggggccgaagatgaactggaaatacggtttaacgcaccgtttaacattggaattaagctcgcaggtgcccaaagcctgcaacatggacagactctgggtaagtttctgcaggatattctttgggaggaagcggaagaaaccctcgccaacgag

SEQ ID NO: 250197 - DNA, 348 bp, Artificial Sequence
  Description of Artificial Sequence: Synthetic coding sequence
atgcctgcgccttggaccatctgtagtctcctgctcctgtcggtgctctgtatggatctcgcaatggcaggctcgtccttcctttccccagaacaccaaaaacttcagagaaaagaagcaaagaagcctagcggtaggctcaagcctcgcaccctggaggggcaatttgacccagaagtgggttcacaggcggaaggtgccgaggacgaacttgagatacgatttaacgcacctttcaacatcgggattaaacttgccggggcacagtcgcttcagcacggtcagactctgggaaagtttctgcaggatattctgtgggaggaagcggaggaaactcttgctaatgag

SEQ ID NO: 250198 - DNA, 348 bp, Artificial Sequence
  Description of Artificial Sequence: Synthetic coding sequence
atgcccgccccttggacaatttgttctctgctgctcctctctgtcctgtgcatggatcttgctatggccggatctagttttctgtcccccgagcaccagaagctgcagcggaaggaggccaagaaaccgtcgggacgcctgaagcctaggacccttgaaggccagtttgatcccgaggtgggatctcaggccgaaggagcagaagacgaactggaaatcagattcaacgcacctttcaacatcgggattaagctggcaggtgcccaatcgctgcaacacggtcaaacactgggaaagttcctacaggacattctttgggaggaggccgaggaaaccctggctaacgag

SEQ ID NO: 250199 - DNA, 348 bp, Artificial Sequence
  Description of Artificial Sequence: Synthetic coding sequence
atgccggctccttggaccatctgctctctgctcctgctgagcgtgctgtgtatggacctggcaatggccggatcttctttcctttcgcccgaacaccaaaaattgcagagaaaagaggccaaaaagcccagcggaagacttaaacctaggactctggagggtcagtttgacccagaagtgggttctcaagccgaaggtgctgaagacgaacttgaaattcggtttaatgctccattcaacatcggtatcaaactggccggggctcagagtcttcagcacggtcagactctgggaaagtttcttcaggacatcctctgggaggaggctgaggaaacactcgccaatgaa

SEQ ID NO: 250200 - DNA, 348 bp, Artificial Sequence
  Description of Artificial Sequence: Synthetic coding sequence
atgccggccccctggaccatctgctccctgctgctgcttagcgtgctgtgcatggatctcgcaatggcaggttcgtccttcctttcgcctgaacatcaaaagttgcaacgcaaggaagccaagaaaccatcgggtcgccttaagccacggactctggagggacaattcgatcccgaggttgggtcccaggcggaaggcgcggaggacgagcttgaaatccgatttaacgcacctttcaacattgggattaagttggcaggtgcgcaaagcctccagcacggccagactcttggcaagtttttgcaagatatcctttgggaggaagcagaggagacgcttgccaatgaa

SEQ ID NO: 250201 - DNA, 348 bp, Artificial Sequence
  Description of Artificial Sequence: Synthetic coding sequence
atgccggccccctggaccatatgcagcctactgctactctctgtattgtgcatggatctagccatggctggttcctcctttctgagccctgaacaccaaaagttgcaaaggaaggaggccaaaaaaccgtcgggccggctaaagccccgaaccttggagggtcaatttgacccagaggtcggcagtcaggctgagggtgctgaagacgagctcgaaatcagattcaatgcgcctttcaacatcggcatcaagctcgcgggtgcccagtccctccagcacggtcaaacactgggcaagttcttgcaagacatactatgggaggaggctgaggaaacgctggcaaatgaa

SEQ ID NO: 250202 - DNA, 348 bp, Artificial Sequence
  Description of Artificial Sequence: Synthetic coding sequence
atgccagcaccctggaccatttgctcccttctcctcctcagcgtgctttgtatggacctagcgatggcaggctctagcttcctctcccccgaacatcagaagttgcagcgcaaggaggccaaaaagccttcaggccggctgaaacctaggaccctggaaggacagttcgaccctgaggtgggatctcaagccgagggcgccgaagacgaactggaaatccgatttaatgcaccgtttaatatcggtataaagctagctggtgcgcagtcgctccagcacgggcagaccctagggaagttcctacaggatattttgtgggaagaggcggaggaaacgcttgcaaacgaa

SEQ ID NO: 250203 - DNA, 348 bp, Artificial Sequence
  Description of Artificial Sequence: Synthetic coding sequence
atgcccgctccatggacgatatgttcactgctgcttctgtccgtgctgtgtatggacctggcgatggcaggatcctcctttctttcgcctgaacatcagaagctgcaaagaaaagaagcaaagaagccctctggacgccttaagccgcgaactctcgaaggacaatttgaccccgaagtcggcagccaggcggaaggagccgaagatgagctggaaattaggtttaatgccccattcaatatcggtattaagttggctggggcgcagagcctgcagcatggtcaaacccttggtaagtttcttcaggatatcttgtgggaagaagcggaagagactcttgcaaacgaa

SEQ ID NO: 250204 - DNA, 348 bp, Artificial Sequence
  Description of Artificial Sequence: Synthetic coding sequence
atgcccgcaccttggaccatttgtagtttgctcctgttgagtgtcttgtgtatggatcttgccatggccggcagctcattcctttccccagaacaccagaagctgcaaaggaaagaggctaaaaaaccatctgggaggttgaagcccagaactctggaagggcaattcgaccccgaagtgggctcacaagctgaaggggccgaagatgagctggagatcagatttaacgcccctttcaatatcggaattaagcttgccggggcgcagagtctccagcacggtcaaactctcggtaaattcctgcaagatatactctgggaagaggctgaagagacactcgcaaacgaa

SEQ ID NO: 250205 - DNA, 348 bp, Artificial Sequence
  Description of Artificial Sequence: Synthetic coding sequence
atgcctgcgccttggacgatctgttctctgctgctgctgtcagtcctgtgtatggacctggctatggctggaagctcctttctcagtccggagcaccagaaacttcaacgcaaggaagctaaaaaacccagtggacgcctaaagcccagaaccttagaaggtcagttcgacccagaggttgggtctcaggcggaaggcgccgaggacgaacttgagatcaggttcaatgctccgttcaacatcggaattaagctggcaggagcacaaagcctccagcacggccagacccttgggaaatttctacaggacattttgtgggaggaggcggaagagaccctcgctaatgag

SEQ ID NO: 250206 - DNA, 348 bp, Artificial Sequence
  Description of Artificial Sequence: Synthetic coding sequence
atgcccgctccatggaccatttgcagcctgcttctgctgtccgtgttgtgtatggatctggcaatggcgggaagttcgttcctgtcaccggaacaccagaagctccaacggaaggaagcgaaaaaaccatccggacgtctgaagccaaggaccctggagggccagttcgaccctgaagtgggaagccaggccgaaggagccgaagatgaattggagatcagattcaacgcgccgttcaatattggcatcaagttggccggtgctcaatctctgcaacatggacagactctgggcaagtttctccaggacatattgtgggaggaagcagaggagactctcgccaacgaa

SEQ ID NO: 250207 - DNA, 348 bp, Artificial Sequence
  Description of Artificial Sequence: Synthetic coding sequence
atgcctgcaccttggactatatgctcccttcttctcctttcagtcctgtgtatggaccttgcaatggcaggctcatcgttcctcagccccgagcaccaaaagctgcaacgcaaagaggcaaagaagccgtccggccgtcttaaacctagaactctcgagggacaatttgatcccgaagtgggatcacaagccgagggagcagaggacgagctggagatccgctttaatgcacccttcaatattggtatcaaactcgcaggtgcacagagcttgcagcatggtcagacccttggtaagtttctccaagatatcctgtgggaggaagcagaagaaacgcttgctaacgag

SEQ ID NO: 250208 - DNA, 348 bp, Artificial Sequence
  Description of Artificial Sequence: Synthetic coding sequence
atgcccgctccatggaccatttgctccctgctactccttagcgtactgtgtatggacctcgcaatggctgggtcaagctttctctcaccagagcaccagaagctgcagagaaaggaggccaagaagcctagcgggagattgaagccgagaactctggaaggtcagttcgatccagaggtcggttcccaggccgaaggagccgaggacgagttagagataagattcaatgcaccatttaatattgggattaaactggccggggcacaatcactccagcacggacaaacgctcggtaagtttttgcaggacatcctgtgggaggaagccgaagaaacgctggccaatgag

SEQ ID NO: 250209 - DNA, 348 bp, Artificial Sequence
  Description of Artificial Sequence: Synthetic coding sequence
atgccggcgccgtggactatctgttcacttctgctgctctcagtgctctgcatggacctggcgatggccggaagctcgttcctttcaccggaacaccaaaagctgcagcggaaagaagccaaaaaaccatcgggccggctgaagccgcgcacgctggaaggccaattcgacccggaggtcggaagccaggctgaaggagcagaggatgaactggaaatccggttcaatgctcccttcaatatcggaatcaagctggccggagcgcagtcgctgcaacacggacagaccctggggaagttcttgcaagacatcctgtgggaggaggccgaggaaactctcgcgaacgag

SEQ ID NO: 250210 - DNA, 348 bp, Artificial Sequence
  Description of Artificial Sequence: Synthetic coding sequence
atgcctgcaccctggaccatctgttcattgcttctgctctcggttctttgtatggacttggcaatggcaggatcgtcctttctgagcccagaacatcagaagctccaaaggaaagaagcaaagaaaccttcgggacgccttaagcctagaacccttgaaggtcagttcgatccagaggtgggttcccaagctgaaggggcagaagatgaactcgaaattaggtttaacgcacctttcaatattgggattaagctcgcgggagcccagtcactgcaacacggtcagacccttggaaagtttctgcaagacattctctgggaggaggcggaagaaaccctggcgaatgaa

SEQ ID NO: 250211 - DNA, 348 bp, Artificial Sequence
  Description of Artificial Sequence: Synthetic coding sequence
atgccagcgccctggacgatctgcagtttactactcctaagtgtactatgtatggatctcgccatggccggaagttcttttctctctcctgaacatcagaaactgcagcggaaagaggctaaaaaaccctccggacgcctaaaaccaaggacactcgaagggcagtttgatccagaagttgggtctcaggccgagggagccgaagatgaactggaaattcggtttaatgcaccatttaacatagggataaaactagcaggagctcagtctctgcagcacgggcagacactcgggaaatttctgcaggatatactatgggaagaagctgaagaaactctggccaatgaa

SEQ ID NO: 250212 - DNA, 348 bp, Artificial Sequence
  Description of Artificial Sequence: Synthetic coding sequence
atgcctgcgccgtggaccatttgctcactgttgttgctgtcggtgctttgtatggaccttgcaatggcagggtcgtcctttctgtctcctgaacaccagaaattgcagagaaaggaagcaaagaaaccgtccggtcggctcaaacctcgaacgctggaaggtcaatttgaccccgaggtcggatctcaagcagaaggggctgaggatgaactggagattcgcttcaatgcgccattcaacattggcatcaagctggccggtgctcagtcgcttcaacatggacaaactttgggcaagtttttgcaagatatcctctgggaagaagccgaagagactcttgcaaacgag

SEQ ID NO: 250213 - DNA, 348 bp, Artificial Sequence
  Description of Artificial Sequence: Synthetic coding sequence
atgcctgcaccctggactatctgcagcctcctgctgctgagtgttttgtgtatggatctggccatggccgggagttcctttctctctcctgagcaccagaagctgcaaaggaaggaggcaaagaagccatcaggccgactgaaacctagaacactcgaggggcaatttgatcccgaagtgggttctcaagcagaaggtgctgaggacgagctggagatcagattcaacgccccattcaacatcggcattaagctggcaggtgctcagagcctccagcacggtcagacccttggcaagttcctgcaggatatactctgggaggaggctgaggagaccctggccaatgag

SEQ ID NO: 250214 - DNA, 348 bp, Artificial Sequence
  Description of Artificial Sequence: Synthetic coding sequence
atgcccgccccatggaccatatgttctttgctgctcctgtctgtcctctgtatggatttggccatggctggatcttcatttttgtcacccgagcatcagaagctccagcgcaaagaggctaaaaaacccagcggccgtctgaaaccccgcactctggagggacagttcgatcctgaggtgggctctcaggccgagggcgctgaagacgagctggagataaggtttaatgccccttttaacatcggaatcaagttggctggcgcacagtcactgcaacacggccagactttgggaaagtttttgcaggacatcctctgggaagaagctgaagagaccttggccaacgag

SEQ ID NO: 250215 - DNA, 348 bp, Artificial Sequence
  Description of Artificial Sequence: Synthetic coding sequence
atgcctgccccgtggactatctgttccctgctgttgctgagcgtgttgtgcatggatttggcgatggctggctcctccttcctgtccccggagcatcagaagttgcaacgcaaggaagccaagaaaccttcaggacggttgaagccgcggacgctggaaggacagttcgacccggaggtggggtcgcaggctgaaggggccgaggatgaactggagatcagattcaacgcaccattcaacatcggcatcaagctcgccggagctcaatcactgcagcacggccagaccctggggaagttcctgcaggacatcctgtgggaagaagcagaagagactctggcaaacgag

SEQ ID NO: 250216 - DNA, 348 bp, Artificial Sequence
  Description of Artificial Sequence: Synthetic coding sequence
atgcctgcaccttggaccatctgctcactgcttcttctttcggtgctgtgcatggaccttgccatggcaggatcgtcctttctttctcctgaacatcaaaagctccaacggaaggaagcaaagaagcctagcggacgtctcaagcctagaactctggaaggccagtttgatccggaggtcggttcccaggcagaaggagcagaggatgaactggagatcagattcaatgctccattcaacatcgggattaagctcgcaggggcacaatccctgcagcatggccaaacccttggaaagtttcttcaggatatcctttgggaggaagcagaagaaactctggcgaacgaa

SEQ ID NO: 250217 - DNA, 348 bp, Artificial Sequence
  Description of Artificial Sequence: Synthetic coding sequence
atgccagcgccctggactatctgttcactgctcctgctcagcgtcctctgcatggaccttgccatggccggatcgtcgttcctgagccctgaacatcagaagctccagagaaaggaagcgaagaagccgtccggtcgccttaagccaagaaccctcgagggacaattcgatccggaagtgggatcgcaggctgagggagctgaggacgaacttgagatcagattcaacgcgccgttcaatattggcatcaagctcgcgggggcccagtcccttcagcacggacagactctcggcaagttccttcaggacattctctgggaagaggccgaagaaaccttggccaacgaa

SEQ ID NO: 250218 - DNA, 348 bp, Artificial Sequence
  Description of Artificial Sequence: Synthetic coding sequence
atgccggcaccatggacgatttgctcactcctgttgctgtcagtgctttgtatggatcttgccatggccgggagttcttttttaagcccggaacatcagaaattgcaacggaaagaagccaaaaaaccttctgggagactgaaaccgagaacacttgagggtcagtttgatccggaagttggctcacaagcagaaggcgcagaagatgagctcgagattagatttaacgctccctttaatatcgggattaagctcgcgggcgctcaatccttgcaacacggacaaactttagggaagtttcttcaagatatactttgggaagaagcggaagaaacgctcgctaacgaa

SEQ ID NO: 250219 - DNA, 348 bp, Artificial Sequence
  Description of Artificial Sequence: Synthetic coding sequence
atgccagcaccttggacgatctgttcactgctgctgctctcggtgctctgcatggacctggccatggcagggtcctcgttcttgagccccgagcatcaaaaactccagcgcaaagaagccaagaagccctcgggccggctgaaacctcggactctggaggggcaattcgacccggaagtcggatcacaggccgaaggagccgaggatgaattggaaatcagatttaacgctcctttcaatatcggaatcaagttggccggcgcccagtccctgcaacatggacagacgctcggtaaattcctccaagacatcctctgggaggaagcggaagagacgctggccaacgaa

SEQ ID NO: 250220 - DNA, 348 bp, Artificial Sequence
  Description of Artificial Sequence: Synthetic coding sequence
atgccagccccttggaccatttgcagtctgctactgctgagcgttttatgtatggatctggccatggcgggctcgtcttttctgtcccccgagcatcagaagctgcagcgtaaagaggcaaagaagccatccggtagacttaagccacgcactctcgaaggccagttcgatcccgaagtgggcagccaagccgaaggcgccgaagatgagctggagattagattcaatgcgcccttcaacatagggatcaaactggccggcgctcaatccttgcaacacggacagacactgggaaaatttttgcaggacattctttgggaggaggcagaggaaactttggccaacgaa

SEQ ID NO: 250221 - DNA, 348 bp, Artificial Sequence
  Description of Artificial Sequence: Synthetic coding sequence
atgccggccccgtggactatctgcagcctgctcctgctgtctgtcctgtgtatggacttggccatggcaggatccagcttcctgtccccagagcatcaaaaacttcaacgcaaggaagccaaaaaacctagcggacggctgaagccgagaacccttgagggtcagttcgatccggaggttggatcacaagctgagggagcggaggacgagcttgagatccggttcaatgctccgtttaacatcggaatcaaactcgccggagcacagtccttgcagcacggacagaccctggggaagtttctgcaagatattctgtgggaggaggctgaagaaacgttggcgaacgaa

SEQ ID NO: 250222 - DNA, 348 bp, Artificial Sequence
  Description of Artificial Sequence: Synthetic coding sequence
atgcccgcgccgtggacaatttgctctctgctgttgctttcagtcctttgtatggacttagccatggctgggtcctctttccttagcccagaacatcagaagctgcagcggaaagaggctaagaagccctcaggacggctgaaacctcggacactggaaggccagtttgaccccgaggtggggtcacaggccgagggagccgaggacgagctggagatcaggtttaatgccccgttcaacatcggtatcaaactagccggcgcacagagtctgcagcacggtcaaaccctgggtaaatttcttcaggatattctgtgggaggaagctgaggagacgctggccaacgag

SEQ ID NO: 250223 - DNA, 348 bp, Artificial Sequence
  Description of Artificial Sequence: Synthetic coding sequence
atgcctgcaccatggaccatctgtagtttgctcttgttgtccgtgctgtgtatggatctggctatggccgggtccagcttcttgagtccggagcatcaaaaattgcagagaaaggaggccaagaaaccaagcggtcgactgaagcctaggaccttagaaggccagttcgatccagaggtgggaagccaggccgaaggggctgaagacgagctggagatacgtttcaatgccccgtttaatatagggatcaaacttgctggtgcgcagtccctgcaacatggacagactcttggcaaattcctccaggatatactatgggaagaggccgaagagactcttgctaatgag

SEQ ID NO: 250224 - DNA, 348 bp, Artificial Sequence
  Description of Artificial Sequence: Synthetic coding sequence
atgcctgcaccatggaccatctgctctctgctgctcctctcggtgctgtgcatggatcttgccatggcgggcagcagcttcctctcacctgaacaccagaagctgcagagaaaagaagccaagaaaccgagcggacgcttgaagccaagaactttggaaggccagttcgatccagaagtcggttcacaagctgaaggagccgaggacgaactggagattcgcttcaatgctcctttcaatatcgggatcaagctggccggagcgcagtcgcttcagcatgggcagaccttgggcaaattcctgcaagacatcctctgggaggaagctgaggaaaccctggcaaatgaa

SEQ ID NO: 250225 - DNA, 348 bp, Artificial Sequence
  Description of Artificial Sequence: Synthetic coding sequence
atgccagccccatggacaatctgctcactgctgctgttgtctgtgttatgcatggacctcgctatggctgggagtagttttctctcgcctgaacatcaaaaattgcagaggaaagaggctaaaaagccatctggcaggctcaagcccaggactctcgagggccaattcgatccagaggtgggttcccaggccgagggggctgaggatgaattggagattaggtttaacgcccctttcaacatcggtatcaagctagcgggcgcccagtctttacagcatggccaaaccctcggcaaattcctacaagacatcctatgggaagaagcggaggaaacacttgccaatgag

SEQ ID NO: 250226 - DNA, 348 bp, Artificial Sequence
  Description of Artificial Sequence: Synthetic coding sequence
atgccggcgccttggaccatctgctccctgctcctgttgtcagtcctgtgcatggatctcgcaatggccggatcgagctttctctccccggagcaccaaaagttgcagcggaaggaagcaaagaagccatctggtcgattgaaaccgcggactctcgaaggacagttcgaccccgaggtgggatcgcaggcagagggcgccgaagatgagctcgagatccggtttaatgctccgttcaacatcggtattaaactcgccggagcccagtccttgcaacatgggcagacccttggaaagtttctgcaagatattctttgggaggaagccgaagaaaccctggctaacgag

SEQ ID NO: 250227 - DNA, 348 bp, Artificial Sequence
  Description of Artificial Sequence: Synthetic coding sequence
atgccagcaccctggaccatctgcagccttctgttgctttcagtgttgtgcatggaccttgcaatggccggcagtagctttctctcccccgagcaccaaaaactgcagaggaaggaagcaaagaagccatccggtcgcctgaagcctagaaccttggagggtcagtttgatccagaagtgggttcgcaagcggaaggagcggaggatgaacttgaaattcgttttaacgcaccatttaacattgggataaaactggccggggctcaatccctgcagcatggacaaaccctcgggaaatttctccaggacatactctgggaggaagccgaggaaactctggcaaatgaa

SEQ ID NO: 250228 - DNA, 348 bp, Artificial Sequence
  Description of Artificial Sequence: Synthetic coding sequence
atgccagctccttggactatttgctccctattattgctgagtgttctctgcatggatctggcaatggcaggctcttcatttctctctcccgaacatcagaaactacagcggaaggaagccaaaaaaccttctggcagactgaaacctcgcaccttggagggacagttcgacccagaggtaggctcccaggccgaaggcgcggaagatgaattggagatccggttcaatgccccctttaatatcggtattaagctcgccggtgcccagtccttgcagcacggacagacccttggcaagttcctccaagacattctatgggaagaggccgaagaaactttggccaatgaa

SEQ ID NO: 250229 - DNA, 348 bp, Artificial Sequence
  Description of Artificial Sequence: Synthetic coding sequence
atgcctgcaccatggacaatttgctcactactgctgctgagtgttttatgcatggatttggcaatggctggctcctccttcctctctccagagcatcagaagcttcagcggaaagaggcgaaaaagccctctggacgcttaaaacctaggactctggagggccagttcgatcctgaggttggtagccaagctgagggcgcagaagacgagctcgagattcggttcaacgcaccctttaatatcggtattaagttggcaggtgcacagtctctgcagcacggccaaacactcggtaagtttctgcaggacatcttgtgggaggaggctgaggaaactctggcaaatgaa

SEQ ID NO: 250230 - DNA, 348 bp, Artificial Sequence
  Description of Artificial Sequence: Synthetic coding sequence
atgccggcaccatggacgatttgctctctgttactcctgagtgtgctgtgtatggatcttgccatggcaggctcaagcttcctgtcaccagagcatcagaagctccagcgaaaagaagctaaaaagcctagcggcagacttaaaccccgcaccctcgagggccagtttgatccggaggtcggatctcaggccgagggggcagaggatgaactggagatccgctttaatgcaccttttaacattggtataaagttggccggggcacagtcactgcagcacggacaaacgctgggcaagttcctccaggatatcctatgggaggaggctgaagaaacactggctaacgag

SEQ ID NO: 250231 - DNA, 348 bp, Artificial Sequence
  Description of Artificial Sequence: Synthetic coding sequence
atgcccgcaccctggaccatttgctcactgctgctgctgagcgttctctgtatggatttggcaatggctggatcctcttttctgagccctgagcatcagaagcttcagaggaaggaagctaagaagcctagtggcaggctgaagccacggacactggaaggacagttcgatcccgaagtgggctcccaggccgagggcgccgaagatgagcttgaaattaggtttaatgcaccatttaacattggtattaaacttgctggtgcgcaatcactgcagcacggccaaactctgggaaaatttctccaggatattttgtgggaggaggcagaagaaaccctggctaacgag

SEQ ID NO: 250232 - DNA, 348 bp, Artificial Sequence
  Description of Artificial Sequence: Synthetic coding sequence
atgcccgcgccatggactatttgttccctgctgcttctgtccgtcctgtgcatggatctggcaatggccggttcgtcatttctgagccctgaacatcagaagcttcagcgcaaagaggcaaagaaacccagtgggcggcttaaaccccgaaccctggagggacagttcgatccagaagtcgggagccaggccgaaggggccgaggatgagctcgagatccgctttaacgcaccctttaatatcggaataaagttggccggtgcccaaagcttgcagcacggacagacccttgggaaattcctgcaagacatcctctgggaggaagctgaggagacactagcaaatgag

SEQ ID NO: 250233 - DNA, 348 bp, Artificial Sequence
  Description of Artificial Sequence: Synthetic coding sequence
atgccggcaccttggactatctgttccttgctcctcctgtctgtgctgtgcatggaccttgcaatggctggatcgagcttcttgagtccggaacatcagaagctgcaaagaaaggaagcaaagaagccctcaggacggctgaaaccgcgaaccctcgaagggcaattcgaccctgaagtgggaagccaggctgagggtgcggaggatgagctggagattcggtttaacgcccctttcaatatcggcatcaaactggccggggcacagtcactccaacatggccaaactctgggaaagtttctccaggacattttgtgggaggaagccgaagaaaccctggccaacgag

SEQ ID NO: 250234 - DNA, 348 bp, Artificial Sequence
  Description of Artificial Sequence: Synthetic coding sequence
atgcctgcaccctggaccatttgctcgctgcttctgctttcggtcctctgtatggacctggcaatggccggatctagcttcctctcacccgaacatcagaaactccaaagaaaagaggcaaagaagcctagcggtcggctgaagccaaggactctcgaaggacaatttgatcccgaagtggggtcccaggcagaaggtgcagaagatgaacttgaaattaggtttaacgctccattcaatattggtatcaaacttgcgggagcacagtcgctgcagcacggacagactctgggcaaatttctccaagacatcctttgggaggaagctgaagaaactctggccaacgag

SEQ ID NO: 250235 - DNA, 348 bp, Artificial Sequence
  Description of Artificial Sequence: Synthetic coding sequence
atgcctgcgccttggaccatctgctcattgttgcttctcagcgtcctgtgtatggatcttgctatggctggtagttcatttctaagtcctgaacaccagaagctccagcgcaaggaagctaagaagccttccggccgtttgaagccacgtaccttggagggtcagtttgaccctgaagtgggttcccaagcagaaggtgccgaggacgagctcgaaattcgctttaacgcccccttcaacatcgggatcaagcttgccggtgcccagtcgctccagcacggtcagaccttgggcaagttcctccaagacatcttgtgggaggaggccgaggagacgctggctaacgaa

SEQ ID NO: 250236 - DNA, 348 bp, Artificial Sequence
  Description of Artificial Sequence: Synthetic coding sequence
atgcctgcaccttggactatatgtagcctgttactcttgtccgtgttatgtatggacctcgctatggccggaagcagcttcctttcccccgaacaccagaaacttcagcgcaaggaagccaagaagccatcagggaggttgaagccgcgcacgctggaaggtcagttcgatccggaggtcggaagccaggctgaaggcgctgaagatgagctggaaattcgcttcaacgccccctttaatattggaatcaagctagctggcgctcagtcattacaacacgggcagacactgggtaaatttttacaagatattctgtgggaagaggcagaggagaccttagctaatgaa

SEQ ID NO: 250237 - DNA, 348 bp, Artificial Sequence
  Description of Artificial Sequence: Synthetic coding sequence
atgccagcaccgtggaccatctgttctctgctgctcctgagcgtgctctgcatggatttggcaatggcaggttctagctttctaagccctgaacaccagaaactgcagcgcaaggaggccaagaagcctagcgggcgtttgaaaccaagaactctggagggccaattcgatccggaggtagggtcacaggcagagggcgccgaagacgagttagaaatcagattcaatgcccccttcaatatcgggataaagctggccggggcacaatccctgcagcacggccagacccttggaaaattcctgcaggacatcctgtgggaggaggcagaagaaacacttgctaacgag

SEQ ID NO: 250238 - DNA, 348 bp, Artificial Sequence
  Description of Artificial Sequence: Synthetic coding sequence
atgccagcaccctggaccatttgttccctactgttactgtccgttctgtgcatggatcttgcaatggcagggtcttcttttctcagccccgaacatcagaagttgcaacggaaggaagccaagaagccaagtggcagactcaaaccacggaccctggaagggcagttcgacccagaagttggatctcaggccgagggggctgaggacgaactggaaattcggtttaatgctccttttaacatcggcattaagttagctggcgcccagtccttgcagcacggccaaactctgggtaagttccttcaggatatcctgtgggaggaggccgaagagactcttgctaatgag

SEQ ID NO: 250239 - DNA, 348 bp, Artificial Sequence
  Description of Artificial Sequence: Synthetic coding sequence
atgcccgccccatggactatttgttctttgcttctcttatccgtgctctgtatggaccttgctatggctggatcctcgtttcttagtccagagcaccagaagctgcagcgtaaagaagccaagaaacctagcggaaggctaaagcctcgcactttagagggtcaatttgaccccgaggtggggtcgcaagcagagggcgccgaagacgagttggaaattagatttaacgctcccttcaacatcggaattaagcttgccggagcccagtcactccagcatggccaaacactcggcaaattcctgcaagatatcctgtgggaggaagcagaggagacgttagcaaatgag

SEQ ID NO: 250240 - DNA, 348 bp, Artificial Sequence
  Description of Artificial Sequence: Synthetic coding sequence
atgcctgcgccctggactatttgttccttgctcctgctgtccgtgctgtgtatggatcttgcaatggcaggtagctccttcctgagccccgagcatcagaaacttcagaggaaggaggccaagaagcccagcgggagactcaagccccgcacgctcgaaggccagttcgacccagaggtagggtcccaggccgaaggcgcggaagatgagctggagattcggttcaacgcaccatttaatatcggcattaagctggcgggtgcacaatcactgcaacatggccagactctcgggaaatttttgcaggacatcctctgggaggaggccgaggagacgctcgccaacgag

SEQ ID NO: 250241 - DNA, 348 bp, Artificial Sequence
  Description of Artificial Sequence: Synthetic coding sequence
atgccggccccgtggaccatctgctcactgttgctcttatcagtgttgtgtatggatttggccatggctggatcttccttcttatcaccagagcaccaaaaactgcagcggaaagaagcgaagaaaccaagcggccgccttaaaccgaggacgcttgaaggccaatttgatcccgaagtaggtagccaggcagaaggcgcggaagacgagctggagattcgctttaatgctccttttaatatcgggattaaactcgcgggggctcaatccttgcaacacggtcaaactctcggcaaattcctacaggatattctgtgggaagaagcggaggaaactctggcgaatgaa

SEQ ID NO: 250242 - DNA, 348 bp, Artificial Sequence
  Description of Artificial Sequence: Synthetic coding sequence
atgccagctccctggactatttgcagtctcctcttgttgtccgtgctctgtatggacctcgccatggccggctcctctttcctgagccctgagcaccaaaagcttcaaagaaaggaagctaagaaaccctctggccgcttgaagccacgaacactcgaagggcaattcgacccagaggtcgggtcacaagctgaaggggctgaagacgagttggagatccgatttaatgccccttttaacattggtatcaagcttgctggagcgcagagcctccagcacgggcagaccctgggtaagttcctgcaggacatcctctgggaagaagccgaggagactctcgcgaacgag

SEQ ID NO: 250243 - DNA, 348 bp, Artificial Sequence
  Description of Artificial Sequence: Synthetic coding sequence
atgcctgcaccatggacgatttgttcattgttattattgagcgttttgtgtatggatttggctatggctggaagttcttttctttcacctgaacatcaaaaattacaaagaaaggaggctaaaaaaccatcaggaagattaaagcctagaactttagaaggacaatttgatccagaagttggaagtcaagcagaaggagctgaagatgaacttgaaattcgttttaatgcaccatttaatattggtattaaattggcaggtgcccaatctttacaacatggacaaactttgggaaaatttcttcaagatatactatgggaagaagccgaagagactttagcaaatgag

SEQ ID NO: 250244 - DNA, 348 bp, Artificial Sequence
  Description of Artificial Sequence: Synthetic coding sequence
atgccagcaccctggactatatgctcactgctcctgctgagtgtactgtgcatggatctggcaatggcaggctcctctttcctttctcctgagcaccagaagctgcagaggaaggaggcaaagaaaccctctggtaggcttaagccacgcacgctggaaggtcagttcgatccagaagtgggcagtcaagccgaaggggcagaggatgagctggagattcggtttaacgctccgtttaatatcggcatcaaactggctggtgctcaaagtctgcagcacgggcagacactgggcaagtttcttcaggatatcctctgggaagaagctgaggaaactttggcgaatgag

SEQ ID NO: 250245 - DNA, 348 bp, Artificial Sequence
  Description of Artificial Sequence: Synthetic coding sequence
atgcccgcaccctggaccatctgcagcctgctgctcttgtccgtgctgtgcatggatctggcgatggccggttcttcatttttatcccccgagcatcaaaagttgcagcgtaaagaggccaaaaagccctccggtcgcctgaagccgagaaccctggagggacagtttgaccctgaagttggcagtcaggcagagggcgcagaggacgagttggaaattagatttaatgctccttttaacatcggaatcaagctggccggcgcccagagtcttcagcatggtcagaccctgggcaaattcctgcaagacatcctgtgggaggaggcggaagagacattggccaacgaa

SEQ ID NO: 250246 - DNA, 348 bp, Artificial Sequence
  Description of Artificial Sequence: Synthetic coding sequence
atgccagcaccatggactatctgctccttgttgctgctgtcagtactgtgtatggatctggcaatggctggatctagttttttatctcccgaacaccagaagctccaacggaaggaggctaaaaagccctcgggaagactgaagccaaggaccctggagggacagttcgatcctgaagtaggtagccaggccgagggagccgaggacgaactcgagatcagatttaatgcaccattcaatattgggattaagctggctggagcacaatcactgcagcacggccagacgctaggaaagttcctccaagatattctctgggaggaggcggaggaaaccctcgcaaacgaa

SEQ ID NO: 250247 - DNA, 348 bp, Artificial Sequence
  Description of Artificial Sequence: Synthetic coding sequence
atgcctgcaccgtggaccatatgctctctgttactgctcagcgtgctctgcatggatctggctatggcaggttccagttttctatcacctgagcatcagaaactgcaaagaaaggaggccaagaaacccagtggaaggctgaagccccgcactctcgagggccagtttgaccccgaggtggggagccaggcagaaggagccgaggacgagctggagatccggttcaatgctccctttaatatagggatcaaactggcaggagcccagagtcttcagcatgggcaaacattgggtaagttcctacaggacattttatgggaggaggcagaagagacgttagccaacgag

SEQ ID NO: 250248 - DNA, 348 bp, Artificial Sequence
  Description of Artificial Sequence: Synthetic coding sequence
atgcccgctccatggacaatttgctcactcctcctgttatcagtgctgtgtatggaccttgcgatggccgggtcttccttcctgtcacctgagcaccagaagctacagagaaaggaggcgaaaaagccctcaggacgactgaagccacgcaccctggaaggccagtttgaccccgaagtcggctcgcaagctgaaggcgccgaagacgaactcgaaattcgcttcaatgcccccttcaacatcggcataaaacttgcgggcgcccagtcacttcagcacgggcaaacacttggtaagttcttacaggacatcttgtgggaagaggcggaggaaacgctggccaatgaa

SEQ ID NO: 250249 - DNA, 348 bp, Artificial Sequence
  Description of Artificial Sequence: Synthetic coding sequence
atgcctgccccatggactatttgctccctcctgcttctgtccgtcttatgcatggatctggcaatggccggcagcagctttctaagccctgagcaccagaagctgcagaggaaagaagccaagaagccaagcggaaggctaaaacccaggactctggagggtcagtttgaccccgaggttgggagccaggcagagggcgccgaggacgaactggagattcggtttaacgccccattcaatattggtattaagctggcaggcgcccagagcctgcagcacggccagaccctcggcaagttcctgcaggatatactctgggaagaggccgaggagactctggccaacgaa

SEQ ID NO: 250250 - DNA, 348 bp, Artificial Sequence
  Description of Artificial Sequence: Synthetic coding sequence
atgccggccccttggacaatttgttcgcttctgctgctgagtgtattgtgcatggacttggctatggcaggaagctcgtttttgtcgcctgagcatcagaaactgcagcggaaggaggcaaagaaaccatccggcagacttaagccacgaactctcgagggtcaatttgaccctgaggtcggatcccaggccgagggcgctgaggatgagctagaaattcggttcaacgcccctttcaatatcggtataaagctcgcaggtgcccagtccctgcagcacggacaaacactgggcaagttcctccaggacattctgtgggaagaggcagaagagactcttgccaacgag

SEQ ID NO: 250251 - DNA, 348 bp, Artificial Sequence
  Description of Artificial Sequence: Synthetic coding sequence
atgcctgccccctggacaatttgttctctgcttctgctgagcgtgttatgtatggatttggcgatggccggtagctccttcttgtcccccgagcatcaaaagctccaacgtaaagaggccaaaaagccttcgggtaggttgaagcctcgaacactggaggggcagttcgatccagaagtcggctcccaggcagaaggagccgaagacgagctcgaaatccgatttaatgctccatttaatatcgggattaagttggccggtgcccagtccctacagcatggacagaccttgggcaagttcctgcaagatattttgtgggaggaggccgaggagactctggccaacgaa

SEQ ID NO: 250252 - DNA, 348 bp, Artificial Sequence
  Description of Artificial Sequence: Synthetic coding sequence
atgccagccccatggacaatctgttccctgcttctgctgagtgtgctgtgtatggatctggccatggccggcagttccttcctgagcccagaacatcagaaacttcagagaaaggaggccaaaaagccctctggccgcctgaagcccagaaccctggagggccagttcgaccccgaggtcgggtcccaggccgagggtgccgaggatgagctcgaaatacgctttaatgcaccttttaacatcggcatcaagcttgcgggggcccagtctctgcagcacgggcagacgttggggaagtttctgcaagacatcctctgggaagaggcagaggagaccctggctaacgaa

SEQ ID NO: 250253 - DNA, 348 bp, Artificial Sequence
  Description of Artificial Sequence: Synthetic coding sequence
atgccggctccctggactatctgttccctgttgttgctcagtgtgctttgcatggacctggctatggcaggaagtagttttctctccccagagcatcaaaaactgcagcgtaaagaagccaaaaagcccagcggaaggctgaagcccagaaccctggaggggcagtttgaccctgaggtgggcagtcaggccgaaggcgccgaagacgagctggagattcgatttaatgcccctttcaatattgggattaaactagcgggtgctcagtcgctgcaacatgggcaaactctgggcaaattccttcaggacatcttgtgggaagaggccgaggaaacgctcgctaatgag

SEQ ID NO: 250254 - DNA, 348 bp, Artificial Sequence
  Description of Artificial Sequence: Synthetic coding sequence
atgcccgccccttggactatttgctcactgttgctcctctcggttctgtgcatggatctggcaatggctgggtcgtccttcctgtcaccagagcatcaaaaacttcagcgaaaagaggccaagaagccatcaggaaggctgaagcctaggaccctggagggacaattcgatcccgaggtcgggtctcaggctgagggagcggaggatgagctcgagatccggttcaatgcgccatttaatatcggtattaagctcgcgggagcccagtcacttcagcacgggcagacactgggcaaattcctgcaggatattctttgggaagaggcagaggagaccctggcaaacgag

SEQ ID NO: 250255 - DNA, 348 bp, Artificial Sequence
  Description of Artificial Sequence: Synthetic coding sequence
atgcccgctccgtggaccatttgctccctgctgcttctgagtgttctgtgtatggatctggcaatggccggatcttcattcttgagccccgagcatcaaaaactgcagcgaaaggaggctaagaagccaagtgggaggctgaaacccaggacgctggaaggacaattcgatcctgaagtcggctcacaggcggagggagctgaggatgagctcgagattaggtttaacgcgccgttcaatatcgggatcaagttggcaggggctcagtctctgcagcacgggcaaactctcggaaaattccttcaagatatcctgtgggaggaggcggaggagacattggcgaacgag

SEQ ID NO: 250256 - DNA, 348 bp, Artificial Sequence
  Description of Artificial Sequence: Synthetic coding sequence
atgcccgccccctggaccatatgcagcctgctccttctctcagtcctgtgtatggacttggcaatggccggctctagtttcctgtcacctgagcatcagaagttgcagcggaaggaggccaagaagcccagcgggcggctgaagcctagaacactggaaggtcagttcgaccccgaggtggggtcccaggccgagggtgctgaggacgagcttgagattaggtttaacgctcccttcaacattgggatcaaactcgcgggggcccagagcttgcagcacggacagacactcggtaaattcctccaggacatcttgtgggaggaagcagaggagaccctcgccaatgag

SEQ ID NO: 250257 - DNA, 348 bp, Artificial Sequence
  Description of Artificial Sequence: Synthetic coding sequence
atgcctgcaccatggacaatctgctcccttctgctgctgtcagttctttgtatggatctggccatggctggtagcagtttcctcagccctgagcaccagaagttgcagcgaaaggaagccaagaaaccctctgggagactcaaacccagaacactggaggggcagtttgaccccgaggtgggctctcaggctgagggcgccgaggacgagttggaaatccggttcaacgcaccattcaacatcggtatcaaactagccggcgcacagagtttacagcatggacagaccttggggaaattcctgcaagacattctgtgggaggaggccgaggagaccttggcgaatgag

SEQ ID NO: 250258 - DNA, 348 bp, Artificial Sequence
  Description of Artificial Sequence: Synthetic coding sequence
atgcctgcaccttggaccatttgttctttgctcttgctgtctgtgctgtgcatggacctcgctatggctggatcatctttcctgagcccagagcatcagaaactccaaagaaaggaggccaagaagccatccggcaggttgaagcctcgtaccctcgagggccagttcgaccctgaagtcggctctcaggccgaaggtgccgaagatgagcttgagattcgtttcaacgctcccttcaatattggcattaagctggctggcgctcagtccctccagcacggacaaaccttgggtaaatttctgcaagacattctctgggaagaggctgaggaaacacttgctaacgaa

SEQ ID NO: 250259 - DNA, 348 bp, Artificial Sequence
  Description of Artificial Sequence: Synthetic coding sequence
atgccggcgccttggaccatctgtagcttgctgctccttagcgtgctgtgtatggatctggccatggcggggtccagctttcttagccctgaacaccagaagctgcagcggaaagaggccaaaaagcccagcggtagactgaaacctcgaacactcgagggccagtttgatcctgaagtcggctcccaggccgaaggcgcagaagatgagttggagatccgatttaacgcgccattcaacatcgggatcaaacttgctggcgcccaatcactacagcatggtcagactctggggaagttcttgcaagacattctgtgggaggaggccgaggaaactctagccaacgag

SEQ ID NO: 250260 - DNA, 348 bp, Artificial Sequence
  Description of Artificial Sequence: Synthetic coding sequence
atgccggcaccctggacaatttgctctctcctcttgctgtccgtgttgtgcatggatctggcaatggccggcagcagtttcctctcccctgaacaccagaaactgcaacggaaagaagcgaagaagccctcaggtcgtctcaaaccccgcactctagaagggcagtttgaccccgaggtgggttcacaggccgagggagcggaggacgagttggaaatacgctttaatgctcccttcaacatcgggatcaagctggctggcgcccagtcccttcagcatggacagacgctggggaaatttctccaagacatactctgggaagaggccgaggagaccctggctaacgag

SEQ ID NO: 250261 - DNA, 348 bp, Artificial Sequence
  Description of Artificial Sequence: Synthetic coding sequence
atgcccgctccctggacaatatgctcacttctcctgcttagcgtgctgtgtatggatctggccatggctgggagttcattcctaagccctgaacaccagaaactgcagaggaaagaagcgaagaaaccctcgggccgcctcaagccgagaacattagagggccagttcgatccagaggtgggttcacaggccgagggggcggaagacgaactggaaattagatttaacgcccccttcaacatcggtattaaactagcgggggcgcagtcgcttcagcacgggcagacattgggcaaattcctgcaggacatcttatgggaggaggcggaggagaccttagctaacgaa

SEQ ID NO: 250262 - DNA, 348 bp, Artificial Sequence
  Description of Artificial Sequence: Synthetic coding sequence
atgccggccccctggaccatctgttcacttctgctcctctccgttctgtgtatggacctcgccatggccggctcctccttcctctccccagagcaccagaagttgcagagaaaagaggcgaagaaaccatcaggaagacttaagccaaggacactggagggacagttcgaccccgaagttggtagccaggcagaaggcgccgaggacgagcttgagatcaggttcaatgctccttttaacatcggtataaagctcgccggagcccaatctctgcagcacggtcagactctcggaaaatttctccaggacatcctctgggaagaggcagaggagactctcgcaaacgag

SEQ ID NO: 250263 - DNA, 348 bp, Artificial Sequence
  Description of Artificial Sequence: Synthetic coding sequence
atgccagccccgtggaccatttgtagcctcctgcttttgtctgtcctgtgcatggacctagccatggctggttcgtccttcctctctcccgaacaccagaagcttcagcgaaaggaagctaaaaagccatcagggcgcctgaaaccccgcactctggaggggcagttcgatccggaggttggctctcaagcagagggagctgaggacgagctggaaattaggttcaacgccccattcaacatcggcatcaaactggcaggggcacagagcttacagcacggacagacactgggcaaattcctgcaggatatcctctgggaagaggccgaggaaacactcgctaatgaa

SEQ ID NO: 250264 - DNA, 348 bp, Artificial Sequence
  Description of Artificial Sequence: Synthetic coding sequence
atgcctgccccctggaccatctgttccctgctgctgttgtccgttctctgcatggacttagccatggccggcagttctttcctctcccccgaacaccaaaagctgcaacgcaaggaggcgaagaagccgagtggccgactgaagcctagaacattggaaggccaattcgaccccgaggtgggcagtcaggctgagggcgcggaggatgagctcgagatcagattcaacgcccctttcaatatcggtatcaagcttgccggcgcgcagtctttgcaacacggtcagaccctcggtaagttcctgcaggacatcctttgggaggaggctgaggagacccttgctaacgag

SEQ ID NO: 250265 - DNA, 348 bp, Artificial Sequence
  Description of Artificial Sequence: Synthetic coding sequence
atgccggccccttggaccatttgtagcctgctgttgctctctgtcctctgtatggatttggccatggccggctcatcttttctcagcccggaacaccaaaagctgcagcgcaaagaagcaaagaaaccttcaggccgcttgaagccccgtaccctcgagggccaattcgatcctgaggtcggctcccaggctgagggggcagaggatgagctggaaatcagattcaacgccccatttaatatcggaattaagcttgcgggcgcacagtccctgcaacacgggcagactctggggaaatttctgcaggacatcttatgggaggaggccgaggagacccttgccaacgaa

SEQ ID NO: 250266 - DNA, 348 bp, Artificial Sequence; identical to SEQ ID NO: 250246
  Description of Artificial Sequence: Synthetic coding sequence

SEQ ID NO: 250267 - DNA, 348 bp, Artificial Sequence
  Description of Artificial Sequence: Synthetic coding sequence
atgcccgcaccatggacaatctgctcactcctgctattgtctgtgctctgtatggatctggcgatggcaggatctagtttcttaagtcctgaacatcaaaaactgcagcgcaaagaagcaaaaaaaccatccgggaggctcaagcctcgcactcttgaagggcagttcgatccggaggtaggatctcaggccgagggggccgaagacgaactagaaatacgatttaacgcacctttcaacatcggaattaaacttgccggggctcagagtctccagcatggacagacactcgggaaattccttcaggatatactttgggaagaggcggaggaaacacttgctaacgaa

SEQ ID NO: 250268 - DNA, 348 bp, Artificial Sequence
  Description of Artificial Sequence: Synthetic coding sequence
atgcctgccccctggaccatttgtagtctgctcctccttagcgtactctgcatggatttggctatggccggcagttcattcctgtcccccgaacatcagaagctccagaggaaagaagctaaaaaaccatccggaaggctcaagcctcgtactcttgagggccagtttgacccagaggtgggctcccaagccgagggggctgaggacgaactggagattaggttcaatgctccattcaacataggaataaaactcgctggagcacagtcactgcagcacggccagaccttaggcaagtttctgcaggacatcctgtgggaagaagccgaagaaacgctcgcgaacgag

SEQ ID NO: 250269 - DNA, 348 bp, Artificial Sequence
  Description of Artificial Sequence: Synthetic coding sequence
atgccggccccgtggactatctgcagtttgctcctactgtctgtattatgcatggacctggccatggctgggagcagctttttgagtccagagcaccagaagctgcaacgcaaagaagccaagaaaccctccgggcggctgaaacctcggaccttggagggccagtttgacccagaagttgggtctcaagcagaaggggcagaggatgagcttgagatacggtttaacgcacccttcaacatcggtatcaaactagctggagcccagtcgctgcagcatgggcaaactctcggtaagttcctccaggatattctctgggaggaggctgaggaaactcttgctaatgag

SEQ ID NO: 250270 - DNA, 348 bp, Artificial Sequence
  Description of Artificial Sequence: Synthetic coding sequence
atgccggccccttggacaatttgctccctcctactcctgagcgtgctgtgtatggacctggctatggctggaagcagcttcctgagcccggagcatcaaaagctccagaggaaggaggccaagaaaccctccggtcgcttgaagccgcgaacccttgagggccagtttgacccggaggtcggttctcaggcggagggtgcggaggatgagttggagattcgctttaatgccccctttaacatcggcataaagctcgcgggagcccagagcctgcagcatggacagacccttggtaagttcctgcaggatattctgtgggaggaagctgaggagacgctagccaacgag

SEQ ID NO: 250271 - DNA, 348 bp, Artificial Sequence
  Description of Artificial Sequence: Synthetic coding sequence
atgcctgctccgtggacaatctgcagccttttacttttatcagttctttgtatggatttagctatggctggttcttcttttttgtcgccagaacaccaaaagttgcagcgtaaggaggctaaaaagccatctggccgattgaagcccagaacccttgaaggacagttcgatccggaagttggatcacaagcagaaggtgcagaggatgaattagaaataaggtttaacgcgccttttaacattggtattaagctagctggcgctcaatcgttgcaacacggacaaactttgggtaaattcttacaggacattctgtgggaggaagctgaagagacacttgcaaacgaa

SEQ ID NO: 250272 - DNA, 348 bp, Artificial Sequence
  Description of Artificial Sequence: Synthetic coding sequence
atgcccgctccgtggaccatctgttccctgctgctgctgtcagtgttgtgcatggatcttgcaatggcggggagctcgtttctgtcgcctgagcaccagaaactgcagagaaaggaagccaagaagccgtcaggacgcctgaaaccaaggactctcgagggacagttcgacccggaagtcggcagccaagccgagggggccgaggacgaactcgaaattcggttcaacgcgccattcaatatcggtatcaagctcgcgggagcccagtcccttcaacatggacagactttgggcaagttcctgcaagatatcctctgggaggaggcagaagaaaccctcgctaacgaa

SEQ ID NO: 250273 - DNA, 348 bp, Artificial Sequence
  Description of Artificial Sequence: Synthetic coding sequence
atgcctgcaccatggacgatctgttctcttctcctcctgtccgtactttgtatggatctagccatggctggatccagtttcctgtcacctgaacaccagaaacttcagagaaaagaagctaaaaaaccttctgggagactaaagccaaggacactggaaggacagttcgatcctgaggtgggaagtcaagcggagggggcagaagatgaattggaaataagatttaatgcaccatttaacatagggattaaactggcaggagcacagtctctacagcatgggcagactctaggaaaattcttacaggacatactttgggaagaagcggaggaaacactcgcgaatgaa

SEQ ID NO: 250274 - DNA, 348 bp, Artificial Sequence
  Description of Artificial Sequence: Synthetic coding sequence
atgcctgccccctggactatatgctctctgctgctacttagtgtcctgtgcatggaccttgctatggccggctccagtttcctgagccctgaacaccagaagctgcaaagaaaggaggccaaaaagccctctggacgccttaagccgcgaacgctggaaggacaattcgaccccgaggtgggatcccaggcggaaggcgcagaagacgagctggaaatccggttcaatgctccctttaatattggcattaagctggcaggagcgcagagcctgcagcatggacagacactcggcaaattcctccaggacattctgtgggaggaagccgaagagacgctcgcaaacgag

SEQ ID NO: 250275 - DNA, 348 bp, Artificial Sequence
  Description of Artificial Sequence: Synthetic coding sequence
atgcctgccccatggactatttgtagccttcttctcttaagcgttctatgcatggacctcgccatggccggatcatcattcctttcaccagaacatcaaaagttgcaacggaaggaggcgaaaaaaccctcgggtcgcttaaagccaagaacacttgagggccaattcgatccagaagtcggatcgcaagctgaaggagcggaagacgaattggaaatacggttcaatgctccattcaatatcggaataaagcttgcgggagctcagtcgctccaacatggacagactctgggaaaattccttcaagatattctatgggaggaagctgaagaaactctcgcaaatgaa

SEQ ID NO: 250276 - DNA, 348 bp, Artificial Sequence
  Description of Artificial Sequence: Synthetic coding sequence
atgccggcgccgtggacgatatgttcgttattactattatcggtattatgtatggatttagcgatggcgggttcgtcgtttctatcgccggaacatcaaaaattacaacgaaaagaagcgaaaaaaccgtcgggtcgactaaaaccgcgtacgctagaaggtcaatttgatccggaagtaggttcgcaagcggaaggtgcggaagatgaactagaaatacgatttaatgcgccgtttaatataggtataaaactagcgggtgcgcaatcgctacaacatggtcaaacgttaggtaaatttttacaagatatactatgggaagaagcggaagaaacgttagcgaatgaa

SEQ ID NO: 250277 - DNA, 348 bp, Artificial Sequence
  Description of Artificial Sequence: Synthetic coding sequence
atgcctgctccttggaccatttgtagcctgctcttgctgtccgtactgtgcatggatctcgcaatggcaggttcatcattcctgtcgcctgagcatcaaaaacttcagcgcaaggaagccaagaaaccttctggccgtcttaagcctaggactctggaggggcaattcgatccggaagtgggatctcaggcagagggggcagaggatgaactcgagatccgtttcaacgcgccattcaatatcggcattaagctcgcaggggcccagtctttacagcatggtcagaccttggggaagttcctccaggacatcctgtgggaggaggcagaggaaacactcgccaatgag

SEQ ID NO: 250278 - DNA, 348 bp, Artificial Sequence
  Description of Artificial Sequence: Synthetic coding sequence
atgccggcgccgtggaccatctgtagcctgctgttgctgtcagtgctgtgtatggatctggctatggctggatctagctttctaagccccgagcatcagaagctgcagcgtaaagaggctaaaaaacccagcggtaggcttaaacccagaaccttggaaggccaattcgaccctgaggtggggagccaggctgaaggagctgaagatgagcttgagatacgatttaatgccccttttaacatcggcataaagctcgccggagctcagtccctccagcacggacaaacactcggtaagttcctccaagatatcctgtgggaggaggctgaggaaaccctggccaatgag

SEQ ID NO: 250279 - DNA, 348 bp, Artificial Sequence
  Description of Artificial Sequence: Synthetic coding sequence
atgcctgccccttggacaatctgttccctcctgcttctttcagtgctctgtatggacctggccatggccgggtccagttttctcagcccagagcaccagaaactgcagaggaaagaagccaagaaaccatcagggagactgaaacctcgcaccctcgagggacagtttgatcccgaagtggggagccaggccgagggagcagaagacgagttggaaatcagatttaacgcgccttttaacattggtatcaaattggccggtgcccagagcttacaacatggtcaaacactgggtaaattcttgcaggatattttgtgggaggaagcggaggagactctggccaatgaa

SEQ ID NO: 250280 - DNA, 348 bp, Artificial Sequence
  Description of Artificial Sequence: Synthetic coding sequence
atgcctgcgccttggaccatttgttccctgctgctattgagcgtgctgtgtatggacctggctatggcaggcagcagctttctaagccccgaacaccaaaaactgcagcgcaaggaagcgaagaaaccctccggacggctcaagccacgcacactagagggccaattcgaccctgaagtaggctcgcaagctgaaggggcagaagacgaactcgaaatccgcttcaacgcccccttcaacatcggcatcaagcttgctggggctcagtctctgcagcatggtcagacactgggcaagtttctgcaagatatcctgtgggaagaggctgaagaaacactcgcaaatgaa

SEQ ID NO: 250281 - DNA, 348 bp, Artificial Sequence
  Description of Artificial Sequence: Synthetic coding sequence
atgccggccccttggacaatctgctcacttctgctgctgtccgttctgtgcatggacctcgccatggccggcagtagcttcctatctcctgaacaccagaaactccagcgcaaagaagcgaagaagcccagcgggcgtcttaagccaaggacgctggagggccagttcgatcccgaagtcggctcccaggctgagggcgctgaggatgagcttgagattcgctttaatgccccattcaatatcggcatcaaactcgctggcgcccaaagcctgcaacacggccaaaccctgggtaagtttctgcaagacattctttgggaagaagccgaggaaacgctcgctaatgag

SEQ ID NO: 250282 - DNA, 348 bp, Artificial Sequence
  Description of Artificial Sequence: Synthetic coding sequence
atgcccgcaccatggactatatgcagcttgctcttgctttctgtcttatgtatggacctggcaatggccggatcttcattcctatctcctgaacatcagaagctgcagcgtaaggaggccaagaagccatctggccggctgaagcctagaacattggaaggacagttcgacccggaagtgggttcccaagccgagggtgctgaagacgaactcgaaattcggttcaacgcacctttcaacataggaattaagctagctggcgcccagagtttacaacacgggcagacattgggcaagtttttgcaggacattctctgggaagaagcagaggaaaccttggccaacgaa

SEQ ID NO: 250283 - DNA, 348 bp, Artificial Sequence
  Description of Artificial Sequence: Synthetic coding sequence
atgccagccccatggaccatctgtagcttgctgttgctgtctgtgctgtgtatggatcttgccatggctgggagttcttttctaagtcccgagcaccagaagctgcaacggaaagaggccaagaaaccgtctggcaggctgaaaccccgtaccctggaaggtcaattcgatcctgaggtaggttcgcaggcggaaggtgcagaggacgagctggagattagattcaacgccccttttaatatcggaattaagctcgcaggcgcccagtccctacaacatggtcaaacactgggaaaatttctgcaggatatactgtgggaagaagcggaagaaaccttggccaatgag

SEQ ID NO: 250284 - DNA, 348 bp, Artificial Sequence
  Description of Artificial Sequence: Synthetic coding sequence
atgcctgctccctggacaatttgctcccttctattgctgtccgtgctgtgcatggatttggccatggcgggcagctctttcctgagtcccgaacaccagaaactccaaaggaaggaagcaaaaaaaccatccggaagactgaaaccaagaaccctggagggacagtttgacccagaagtgggcagccaagcagaaggtgcagaagatgaattggaaatacgcttcaatgccccgtttaatatcggcatcaaactcgctggcgcacaaagcctccagcatggacagactcttggcaaattcttgcaagacatcctctgggaggaggcagaagaaacactcgcaaatgaa

SEQ ID NO: 250285 - DNA, 348 bp, Artificial Sequence
  Description of Artificial Sequence: Synthetic coding sequence
atgccagcgccatggaccatctgctcactgttgctcctgtccgtgctttgcatggaccttgccatggccgggtcatcctttctgtccccagaacaccagaagctccaacgcaaagaggcaaaaaaacccagtggtagacttaagcccaggacactggagggccaatttgatcccgaggtcgggagtcaggcggagggtgccgaggacgagctggagatacggttcaatgccccatttaacattggcatcaaactggcaggagctcagtctttgcagcacggccagactctagggaaatttcttcaggacattttgtgggaggaggccgaagagacattagctaatgaa

SEQ ID NO: 250286 - DNA, 348 bp, Artificial Sequence
  Description of Artificial Sequence: Synthetic coding sequence
atgcctgcaccatggacgatctgctctctgctcctgctgtccgtgctctgcatggatttagcgatggctggaagtagcttcctttcaccagaacaccagaagctccaacgcaaggaggctaaaaaacctagtggccgccttaagcctagaacactcgagggacagttcgatcccgaagttggttcgcaggccgaaggtgccgaagatgaattagagatacggtttaatgccccgttcaatattgggatcaagctggctggggctcagtcccttcagcacggtcagactctcggtaagtttttgcaggacatattgtgggaagaagccgaggaaactctagctaacgaa

SEQ ID NO: 250287 - DNA, 348 bp, Artificial Sequence
  Description of Artificial Sequence: Synthetic coding sequence
atgccggccccttggaccatttgttccctgctactgctgtctgtgctgtgcatggatctggcgatggccggttctagctttctgagcccggaacaccagaaacttcagcgaaaggaagcgaagaaaccgagcggtcgcctgaaaccacgcactctcgagggacaattcgacccggaagtcggcagccaagcagaaggcgctgaggacgagctggagattcgctttaacgccccctttaacatcggcattaagttggcaggcgcacaaagcctgcaacacggccaaaccctgggcaagttccttcaggacatcttgtgggaggaggcggaagagaccctggcaaatgag

SEQ ID NO: 250288 - DNA, 1503 bp, Artificial Sequence
  Description of Artificial Sequence: Synthetic coding sequence
atgaggctgcccaaattgctgaccttcctgctctggtacctcgcatggctggacctggagtttatctgtactgtgctgggggcccccgaccttggacagcgccctcaaggcacaaggccagggctcgctaaagccgaggccaaagagcgccctccccttgcgcggaatgtttttcgccctggtgggcactcctacggcggcggggcgactaatgccaacgcccgggccaagggaggcactggtcagaccggcggacttacgcagccaaaaaaagatgaacccaagaaacttccgcctagacctgggggacctgagcctaagccagggcaccctcctcagacgaggcaggcaacagcccggaccgtcactccgaagggtcagttgccgggcggaaaggcacctccaaaggccggttctgtgccctcatcgttcctgctgaaaaaagccagagaacctggcccgcctagagaaccgaaagagcctttcaggccccctccgataaccccacatgagtacatgctgtccctgtataggacactgtccgacgccgaccgcaagggcggtaacagctccgtcaagctagaggccggactggccaacacgattacatcattcatcgacaagggacaggacgatagaggccctgtagtgcgaaagcagcgatatgtatttgatattagtgccctggagaaagatggcttgctcggtgccgagcttcgcatccttcgcaagaaaccatccgatactgctaaacctgcggcccccggtggcggacgggccgcccagctaaaattgtcctcatgtccctccgggcggcagccagcaagtcttctcgacgtccggtcggttcctggcctggatggtagtggttgggaggtgtttgatatctggaagctcttccgcaactttaagaacagcgctcagctgtgcttggaactggaggcatgggagaggggcagagctgttgatctccggggccttggcttcgatcgggccgcgagacaggtccacgagaaagctctgtttctggtttttggacgcacaaaaaagcgcgatcttttcttcaacgaaatcaaggcgaggtccggtcaggacgacaagaccgtttacgaatacctgtttagccagaggcggaagagacgggcacccctggccacccgccaagggaagcggccctccaagaatctaaaggcccggtgctctcgtaaagctctgcacgtgaacttcaaggacatgggatgggatgactggataatcgcgcctttggagtacgaagcttttcattgcgaaggactatgtgagttccccctccggtctcacctggaacccacgaaccacgctgtgattcagaccttgatgaactctatggaccctgagtcaactcctcctacgtgctgcgtgcccacacgactgtcccccattagtatcctgtttatcgatagtgctaacaatgtcgtgtataagcaatacgaagatatggttgtcgagtcttgcggttgcaga

SEQ ID NO: 250289 - DNA, 1503 bp, Artificial Sequence
  Description of Artificial Sequence: Synthetic coding sequence
atgaggcttcccaaattgctcacttttctcctgtggtaccttgcttggcttgacttggagtttatctgcacagtattgggagcccccgatcttgggcaaagaccccaaggaacccgcccgggccttgcaaaggcagaggcaaaggaacgcccgcctttagcgcgcaacgtttttaggcccggaggccactcttacggagggggagccacaaacgcaaacgccagggccaaaggaggcacggggcagactggagggttgacccaaccaaagaaagacgaacccaagaaactgcctccccggcctggcggtcctgagcctaagcctgggcaccctccccaaaccaggcaggctaccgcaagaaccgtcacccctaagggtcaacttcccgggggcaaagctcctccgaaagctggcagcgtccctagctcctttttgttaaagaaagctagagagcctggcccacctcgcgagcccaaggaaccctttcggccaccgcctatcaccccacatgagtacatgctcagtctttatcggaccttatccgacgccgacaggaaaggagggaactcttcagtcaaattagaggcaggcttagctaacactatcacctctttcatagacaaaggtcaagatgatagaggccccgtggttaggaagcaaagatacgttttcgatatatcagcgctggagaaagacggcctcttgggggccgaactcaggatccttcgtaaaaagcctagcgacactgccaaaccagcagctccaggcggaggacgggctgctcagcttaaactgtccagctgtccctccggcagacagcccgcctctctcctggatgtgaggagtgtgccaggccttgatgggtctgggtgggaagtgtttgacatctggaaattgttccgcaattttaagaactctgcgcagctgtgcctggaactggaagcttgggagagaggcagagccgtagacctaagaggcttgggattcgatcgtgctgcaagacaagttcacgaaaaggctctgttcctggtcttcggcagaacgaagaagcgtgatctttttttcaacgaaatcaaggcaaggtctggccaggacgataagactgtctatgagtatctgttctcacaaagaaggaaaaggcgtgcaccactggccaccagacagggcaagagacctagtaagaacctgaaagccagatgcagtcgcaaggcattgcacgtgaacttcaaagatatgggctgggatgactggattatcgctccattggaatatgaggcctttcattgcgaaggattgtgcgagttccccctcagatctcacttggaacctacaaatcatgcagttattcaaaccctcatgaacagcatggaccctgagagcaccccaccaacctgctgtgtgccgaccaggctctccccaattagcatcctgtttattgacagcgcgaataatgtggtctacaaacagtacgaggatatggtggtggaaagttgcggatgccgg

SEQ ID NO: 250290 - DNA, 1503 bp, Artificial Sequence
  Description of Artificial Sequence: Synthetic coding sequence
atgagactgccgaaactgctgacctttctgctgtggtatctggcctggctcgatctggagttcatctgtaccgttctgggagctccggatcttgggcagcgccctcaagggacacggccgggactggctaaagctgaagctaaggaaaggcctccgctggctcggaatgtgtttagaccgggcggacattcttacggaggcggagcgacaaacgcgaacgcccgagccaagggcggtaccggccagaccggggggttaacacaacctaaaaaggacgaacctaagaagctccctccaagacctgggggccccgagccgaagcctggccaccctcctcagactcgacaggcgaccgccagaaccgtaactcctaaaggtcagctgcctggtggcaaggcaccacccaaagcagggtcagtcccctcctccttccttctgaaaaaagcgcgggaaccgggcccaccccgagagccaaaagagcccttccgacccccccccatcacccctcacgagtacatgctatccctctacaggacactgagcgacgctgacaggaagggcggtaattcctccgtcaaattggaggcgggtttggctaacaccatcacttcgttcattgataaaggtcaggacgatcgcggcccagtcgtcaggaaacagagatacgtcttcgacatttctgcgctcgagaaggatggcctgctgggagccgagctgaggatccttagaaaaaagccaagcgacaccgccaaaccagccgcgccaggcggcggccgtgccgctcagcttaaactgtcttcttgtccctcaggtcggcaaccagctagcctcctagacgtgcgcagtgtgcccgggttggatgggtccggttgggaggtatttgacatctggaaactattcaggaatttcaaaaatagcgctcagctctgcttggagcttgaagcctgggaaaggggaagggccgtcgatctcagagggctgggctttgatcgagcagcacgccaggtgcacgagaaggcactgtttctggtattcgggcggaccaaaaaacgcgacttgttttttaacgagatcaaagccagatccggacaggatgataagaccgtatatgagtatctgttttcacaaagacggaaacggcgggcccctctcgctactagacagggcaaaagaccatccaagaacctcaaggcccggtgttcacgaaaggcactgcatgtgaattttaaagatatgggatgggacgactggatcatcgccccgctggaatacgaggcatttcactgcgaaggactctgtgaattccccctgcgctcccatctggagcccaccaatcacgctgtcatccaaacactgatgaattctatggatcccgagtcaacccctccgacatgctgcgttcccacccggctcagtccaatctcaatcctgtttatagactcagcgaacaatgtggtgtacaagcagtacgaggatatggtcgtggaatcctgcgggtgcaga

SEQ ID NO: 250291 - DNA, 1503 bp, Artificial Sequence
  Description of Artificial Sequence: Synthetic coding sequence
atgagattgccaaagcttctcaccttcctcttgtggtacctggcatggctggatctggagttcatatgtaccgtactcggagctccggacctgggccagcgacctcaggggacacggcctgggctggccaaggcggaggcaaaggagcgaccacctctggcaagaaacgtgttccggcctgggggtcacagctatggcggaggagccaccaacgcaaacgcaagggccaagggggggactggccagacagggggacttacacaacctaagaaggacgaacccaaaaaactgcctcccaggccaggaggtccagagccaaagccgggccaccctccacagactaggcaagccacagcgagaacggttactccaaaagggcaactgccaggcgggaaagccccgcctaaggccggttctgtgccatccagcttcttactcaaaaaagctagggagcctggacctcccagggaacctaaagagccgttcaggcccccaccaatcaccccccatgaatatatgctgagtttgtatcgcacgctgtctgacgcggatagaaaagggggcaattcctcagtgaagctggaggctggattggccaataccatcacctcctttatcgacaaggggcaggatgaccgcggccccgtcgtaaggaagcagcgctacgtgttcgacatttccgctctcgaaaaggatggcctgctcggcgctgaacttaggattttgcgcaagaaaccctcagacactgccaagcctgccgcgccagggggtggccgggcggctcagctcaagctgtcttcttgtccctcagggaggcagccagcaagcttactggacgtgcgaagtgtgcccggactcgacgggagcgggtgggaagtcttcgacatttggaaactcttcagaaatttcaaaaactcggcacagctgtgcctggagcttgaggcttgggaacgcggcagggctgtcgacctacgaggtctcggttttgatcgggccgccagacaggtgcacgaaaaagcactgttccttgtgtttggtaggacaaagaaacgggatctctttttcaacgaaatcaaggcacgaagcggccaggacgacaagacagtttacgagtatttgttctctcagcggcgaaagcggcgagctccccttgccacaagacaaggcaaacggccttccaagaatctcaaggctcggtgcagcagaaaagcccttcatgtgaattttaaggacatgggatgggacgattggatcattgctcccctggagtatgaggcgttccattgtgaaggtctatgcgagttcccactacggtcccacttggaaccaacaaaccacgcagttatccagaccctcatgaactctatggatccagagagcaccccccccacctgctgcgtgcctacgaggctcagcccgattagcatcttgtttatcgacagcgccaataacgtggtgtacaagcagtatgaggacatggtggtggagtcctgcggctgtagg

SEQ ID NO: 250292 - DNA, 1503 bp, Artificial Sequence
  Description of Artificial Sequence: Synthetic coding sequence
atgagattacctaaacttttgaccttccttctctggtatctggcctggctggacttggagttcatatgtacagtcttaggggcgcccgacctggggcagcgtccgcagggcacccgccctgggctggctaaggctgaggcgaaagaacgccccccgctggcacggaacgtatttaggcctggaggccactcttatggaggaggcgccacgaatgcaaacgctcgggccaagggaggaactggacagactggcggcctgacgcagcccaaaaaagatgaacctaagaagctgccaccgaggcctggggggcccgaacctaaaccaggacaccctccacagaccagacaggcaactgctaggactgttacaccaaagggccagttgcccggcggcaaggcccctccaaaggccggctctgtcccaagctccttcctcctgaagaaggccagggagccaggcccaccccgggaaccaaaggagccattcagacctcccccaattactccgcacgagtacatgctctccttataccggactctcagtgatgccgaccgtaaaggtggtaacagctccgtgaaactcgaagcaggcctggccaataccattacgtcctttatagacaagggccaggatgataggggtcctgtcgttagaaaacagcgatatgtgtttgacattagtgcgctggaaaaagatggcctactgggtgccgaactcagaatactgagaaaaaagccgagcgacactgccaagcctgccgcgcctggcggtggcagagcagcccaactgaagctgtctagctgccccagtgggcgtcagccagcttctttactcgacgtcagatccgtgcccgggcttgatggctcaggttgggaggtgttcgatatttggaaactcttcagaaactttaagaactccgcccagctgtgtctggagcttgaagcctgggagcgtggcagggctgttgacctgagaggactcgggtttgacagggctgcccggcaggttcacgagaaggctctctttctcgtctttggcagaactaaaaagagggacctcttttttaatgagataaaagcacgcagtggccaggacgataagactgtgtacgagtacctgttctcccagcggcggaagcgccgtgctcctctcgcaacgagacaggggaaacggcccagcaaaaatttaaaggccagatgctcccgaaaagctctgcatgttaatttcaaagacatgggttgggatgactggatcatcgcaccactcgagtacgaggcattccactgcgagggcttatgtgagtttccactccggagtcacttggagcctaccaaccacgccgtgatccaaaccttgatgaatagcatggacccagaatcaactcctccaacatgctgtgtgccgacgaggttgtcacccatctcaattctgtttatagactccgccaacaacgtggtgtataaacagtatgaggatatggtagtcgagagctgcgggtgccgc

SEQ ID NO: 250293 - DNA, 1503 bp, Artificial Sequence
  Description of Artificial Sequence: Synthetic coding sequence
atgcgcctgcccaagctgctgaccttcctcctgtggtatctcgcctggctggatcttgagtttatatgcacggtactcggagccccagatttgggacagcggccccagggcacaaggcccggactggcaaaggccgaagccaaggaacggcctcccctcgcccgaaatgtgtttcggcctggaggccactcgtatgggggcggtgctactaatgcaaacgccagagccaaaggcggcacaggccagacagggggcctaacgcagccaaagaaagatgagcccaagaaactaccacctaggcccggtgggccagagccaaagccagggcaccccccacagacacggcaagctacagcccgtaccgtgacacctaaggggcagctcccaggtggcaaggccccacctaaagccggctcagtgcccagtagctttctcctgaagaaagcaagagagccaggaccccccagagaacctaaggaaccattcagaccaccccctattaccccccacgagtacatgttgtccctttaccgcactttgagcgacgccgacagaaagggggggaatagtagcgttaagctggaagctggactggctaacactattacgagttttatagacaagggtcaggacgaccggggccccgtggtcaggaagcagcgctacgttttcgacatctcggcactggaaaaggatgggttgctcggcgccgaactgcggattctgaggaaaaaaccctcagataccgctaaacccgcggctcctggtgggggccgggccgcacagctgaaactgagcagctgcccctccggcagacagccggcaagcctcctggatgtacgcagtgtccctggactggatggatcaggttgggaggtcttcgacatatggaagctatttcggaacttcaagaactctgcacagctgtgcctggagcttgaggcttgggagagaggcagggccgtagatctgagaggtctcggattcgaccgcgctgctagacaagttcatgaaaaggctctctttctggtgttcggcaggacaaagaagcgggatctgtttttcaacgagatcaaagctcggagtggtcaagacgataagaccgtgtacgagtatctgttctctcagcggagaaagcggcgggcccctctggcaacacggcaaggaaaaaggccatctaagaatctgaaagctcggtgttctagaaaagcccttcatgtgaactttaaggacatggggtgggatgactggattattgcaccgcttgagtacgaagcctttcattgtgaaggactgtgtgagttccctctaaggtcgcatttggagccgacaaaccatgccgtgatccagacattgatgaattccatggatccagaatcaaccccacctacctgctgcgttcctaccagacttagccccatctccatacttttcattgactccgctaacaacgtagtatacaagcagtacgaggacatggtcgtagaatcatgcgggtgtcga

SEQ ID NO: 250294 - DNA, 1503 bp, Artificial Sequence
  Description of Artificial Sequence: Synthetic coding sequence
atgcgactgcctaaattattaacatttctcctgtggtatctagcctggcttgacctggagttcatatgtaccgtcctgggggcgccagatcttgggcagcgcccccagggcacaagacctggattggctaaagctgaggccaaagaacgtcctcctcttgctcgcaacgtgttcaggccaggtggccactcctatgggggtggcgccaccaatgcaaacgcccgggccaaggggggaactggacagacaggaggattaactcagcccaaaaaagatgaacctaaaaagctgccacctagaccgggggggccagaaccgaagccaggccaccccccacagacaaggcaggcgactgccagaactgtaactcccaaaggtcaactgcctggaggaaaggccccacccaaggcgggctcagtaccatcctcttttctgctcaagaaggccagggagcccggtcctccgagggaaccgaaagaaccattccggccccctccaataaccccacacgagtatatgctcagtctctatcgtaccctgagcgacgccgatcgaaaaggcggtaacagctctgtgaagctggaagccggactggccaacaccatcacgtcgtttattgataagggacaggacgatcgagggcccgtcgtcagaaagcaacgctacgttttcgacatcagcgctcttgagaaggacggattgctcggggccgaactgcgcatcctcaggaaaaagccaagtgataccgccaagccagccgcaccaggcggagggcgtgccgcccagctgaagctctcttcttgtccctccggcagacaacccgctagcctgctggacgtacggagtgtgccagggcttgacggctctggctgggaggtctttgacatatggaagctgttccgtaacttcaaaaacagcgcccagctgtgtctcgagttggaggcatgggagagggggagagcagtggacttgaggggcctgggcttcgacagggccgcgcgacaggtgcacgaaaaggcgctgttcctggtgtttgggcgcactaaaaagcgtgatctgtttttcaacgagatcaaggcccggagcggtcaggatgacaagaccgtctacgagtacctgttttcccagcgccgcaagcgtagagctccgctggccacacgacagggcaaacggccatcgaaaaatttaaaggccagatgcagtaggaaagcgctccatgtcaattttaaggatatggggtgggatgattggattattgctcctttggagtatgaggctttccactgtgaggggctgtgtgagttcccactgcggagtcacctcgagcccaccaatcacgctgtgatccaaaccctgatgaatagcatggatcccgagtcgactccacccacctgttgcgtcccgacaagactttcccctatcagcatactgttcatcgacagcgcaaacaatgtagtgtacaagcagtacgaggatatggtggtcgaatcctgcggatgtagg

SEQ ID NO: 250295 - DNA, 1503 bp, Artificial Sequence
  Description of Artificial Sequence: Synthetic coding sequence
atgagactcccaaaactcctgacttttctgctctggtaccttgcgtggctcgacctggaattcatttgcactgtgctgggtgctccagaccttggccaacgcccccaaggtactcgcccaggccttgcaaaagcggaggcaaaggagcgcccgccgctggcccgaaacgtgttccggccggggggtcactcatacggcggtggggcaactaatgcaaatgcgcgggccaaagggggaaccggtcagactggcggcctcacccaacctaaaaaggatgagcctaagaaactgccaccccgcccaggcggccccgagccgaagcccggacatccgccacaaaccagacaggcaacggctcgaaccgtcacgccgaagggtcaactgccaggaggaaaggcccctccgaaagctggatctgtgcctagctcgttcttgctcaagaaggctcgggaaccaggtcctcctagggaacctaaggagccctttagacctccccctataacccctcacgaatacatgctttcactttatcgcaccctgtcagatgctgatcggaagggcggtaactcatccgtgaaacttgaagcagggctggccaacactatcacgtcgtttatcgacaaaggtcaggatgacagaggacccgtagtgaggaagcagagatacgtgtttgacatctccgcactggagaaggatgggcttctcggagccgaactccggattctccgtaagaagccttccgatactgcaaagccagccgcacctggaggcggaagagcagcgcagttgaagctgagctcctgtcccagtgggcgtcaacctgcatcgcttcttgacgtgcgttccgtgcctggtttggatggttcggggtgggaagtttttgatatatggaagttgtttcgtaactttaagaattcggcacagctttgtctggaacttgaagcgtgggaacgaggaagagcggtggacctcagaggtttggggtttgatcgcgccgcacggcaggttcacgagaaggcgctcttcctggtgttcggcaggaccaagaaacgtgacctgttctttaatgaaatcaaagcaaggtcgggacaagatgacaagaccgtgtacgaatacctgttttcccaaagacggaaaaggcgagcaccacttgcaactcgacaggggaaacgcccttccaagaatctcaaggcacgatgctcccgtaaagctcttcatgtcaacttcaaggatatgggatgggatgactggatcatcgcgccactggaatacgaggcctttcattgtgaagggctgtgcgaatttcctcttaggagccacctggagcccaccaaccatgcagttatccaaacgctcatgaactcaatggatcccgaaagtacccctccgacctgttgcgtcccgactcgtctcagcccgatctccattctcttcattgactcggcaaacaatgtcgtgtacaaacaatacgaggatatggtggtggagtcttgtggatgtcgg

SEQ ID NO: 250296 - DNA, 1503 bp, Artificial Sequence
  Description of Artificial Sequence: Synthetic coding sequence
atgaggcttccaaaactgctgacgttcctgttgtggtacttggcctggctggacctggagttcatttgtaccgtgctgggagcccctgacctggggcagcggcctcaggggacgagacctgggcttgcaaaagcggaggcgaaagaacggcctcctctggcccggaacgtttttcggccagggggacacagctatggcggtggcgccacaaacgcaaacgcccgggccaaggggggaaccgggcagactggcgggctcactcagccgaagaaggacgagcccaagaaactacctccacgccctggcgggcccgagcccaaacccggacatccgccccagaccagacaggccactgcccgaactgtgacacccaagggacagctccctgggggaaaggcacctcccaaagccggcagcgtgccaagttcttttctcctgaagaaggctagggagcctggaccacctagagaacctaaggaaccgtttagacctcctccaatcacgccgcacgagtacatgctgtcactttatagaactctctccgatgcagaccgcaaggggggcaattcttccgttaagctcgaggcgggcttggcaaatacaattacgtctttcattgacaaaggacaagatgacagagggccggtggtgaggaaacagaggtacgttttcgacatctctgccttagaaaaagatgggttgctcggtgcagagctacgcatacttagaaaaaaacctagcgacacagctaagccagccgcccctggaggaggacgtgcagcacagctcaaactctccagctgtccatccggccggcagcctgcatctctgcttgatgtcagatctgtgccgggtctcgatgggtctgggtgggaggtatttgatatctggaaactgttccggaatttcaaaaactccgcccagctatgtctggagctagaagcctgggaaagaggccgggccgtggatctgcgggggctgggcttcgaccgggcagcacgccaagtccacgagaaagctctgtttctggtgttcggccggaccaaaaagagagacctgttcttcaacgaaattaaggcccgctctggccaggacgacaagaccgtctacgagtacctgttctctcagaggagaaagcgtcgagcgcctttagctacccggcaggggaaacgccctagtaaaaaccttaaggccagatgttcgcggaaggcacttcacgtaaatttcaaggacatggggtgggatgattggatcatagcgcccctcgaatacgaagcctttcattgtgagggcctttgcgagttccccctgcgctcccacctggagccaacaaatcacgctgtcattcagacgcttatgaattcgatggaccccgaatctacgcctcccacatgctgtgtgcctactcgtttgtcaccaatctccatcctctttatcgattctgccaacaacgtagtctacaaacaatacgaagatatggtggtcgagagttgtggttgtaga

SEQ ID NO: 250297 - DNA, 1503 bp, Artificial Sequence
  Description of Artificial Sequence: Synthetic coding sequence
atgcgccttccaaaacttctcaccttcctcctctggtacctcgcatggctggacttggagtttatctgcaccgtcctgggggcacccgatctcggtcagcgaccccaaggaacgaggcctggtcttgcaaaggcagaagccaaggaaaggcctccgctggcacggaatgttttccgtcccggaggtcattcctacggtggaggagccaccaacgcgaacgcacgagctaaaggaggaacgggccaaacggggggccttactcaaccaaagaaggatgaacctaagaagctgcctcctcgccccggcggaccagaacctaaacctggtcatccgcctcaaaccagacaagcgactgcacgtactgtgactcccaagggccagcttcctggtggtaaggcacctccaaaggccggttcggtccctagctccttcctgctgaaaaaagcgcgtgaacctgggcccccaagagaacctaaggaaccatttagaccccctcccattactccacatgaatacatgctgtccctttacagaactctctcagacgcggatagaaaagggggtaattcgtccgtgaaacttgaagcgggacttgcaaataccattacctctttcattgataaagggcaagatgatcgaggacctgtggtgcgaaagcaaaggtacgtgtttgacatttccgcactcgagaaggatggacttttgggggccgagcttcgtatcctcagaaagaaaccttccgatactgcaaagcccgcggcgcctggcggaggaagagcagcacaactgaagttgtcctcgtgtccatcggggaggcaaccagcgtcgctcctcgacgtgcgctccgtgccgggactggacggctcgggatgggaagtgtttgatatctggaagctctttcggaacttcaaaaactcagcacagctttgtcttgagcttgaggcatgggaacgcgggcgagcagtggatcttcgtgggctgggatttgatagggcagcccgccaagtgcatgaaaaagcactgtttcttgtctttggtagaacgaaaaagagagatctgtttttcaacgaaatcaaggcgagaagcgggcaggacgacaagaccgtgtacgaatacctctttagccaacgtagaaagcgcagggcccctctcgccacgcgccagggcaagcgacccagcaaaaatctgaaggcacgatgtagccgcaaggccctgcatgttaactttaaagatatggggtgggatgactggatcatagcacctctggagtacgaggcctttcactgcgaggggttgtgtgagtttccactgaggtcccacctcgaacctactaaccacgcagtgatccagaccctgatgaacagcatggatcctgaatccacgccacctacttgttgtgtgccaacccgcctctcacctataagcattctgtttatcgacagcgccaacaacgtggtgtataaacaatacgaagatatggtggtggagtcatgtggttgcaga

SEQ ID NO: 250298 - DNA, 1503 bp, Artificial Sequence
  Description of Artificial Sequence: Synthetic coding sequence
atgcgactgccgaagctgctcactttcctcctgtggtacctcgcatggctcgacctggagttcatctgcactgtgttgggtgctccggacctgggacagcggccccaagggacccgccccggtttggccaaggccgaagcaaaggaacgcccgccgctggcccgcaatgtgtttcgccccggcggtcactcgtacggcggaggggcgaccaacgcaaacgcgcgggccaaaggaggtactggacagaccggaggcctcacccagcctaagaaagacgagcctaagaagctgcccccacggccgggcggtcctgaaccgaagcctggacacccgcctcagactaggcaggccactgcgcggaccgtgactccaaagggccagcttcctggtggcaaggcacctccaaaggcgggatcagtcccgtcatctttcctgctgaagaaagcccgagagcccggaccacctcgggaaccgaaagagccgtttcgccctccaccgatcaccccacacgaatacatgcttagcctttatcggactctgtcggacgctgaccgaaaagggggaaattcttccgtcaagctggaagcaggactggccaacaccatcacctcgttcatcgacaagggccaagatgaccgtggaccggtggtgagaaaacagagatacgtgtttgacatcagcgctctggagaaagatggactgctgggcgcggagctgcgcattttgcgcaagaagccgtccgatactgcaaagcctgcggcgcccggcggaggcagggcggcccagttgaagctctcgtcgtgcccgtcaggaaggcagccagcatccctgctcgacgtgcggtccgtgccggggctcgacgggtcgggctgggaggtgtttgatatatggaaattgttccgaaatttcaagaacagcgcccaactttgtctggagctcgaggcttgggagagaggcagagccgtcgatctgaggggcctgggtttcgacagagctgctcggcaggtgcatgagaaggccctttttctcgtgttcggtcggaccaagaagcgagacttgttcttcaacgaaatcaaggcaaggtccggccaagatgataagactgtgtacgaatacctcttttcgcagaggaggaagcgccgggccccgctggcgacgaggcaggggaaacggccgtcaaagaacctgaaggctcggtgctcgcggaaggcgttgcacgtcaacttcaaggatatgggctgggacgattggattatcgccccactggagtatgaggccttccactgcgagggcttgtgcgaattcccgcttcggagccatctggagcctacgaatcacgcagtgattcagaccctgatgaactccatggacccagagtccactccacccacctgctgtgtgccgactcggctgagcccgatcagtatcctgttcatcgatagcgcaaacaatgtggtgtacaaacagtacgaagatatggtggtggaatcctgcggatgcagg

SEQ ID NO: 250299 - DNA, 1503 bp, Artificial Sequence
  Description of Artificial Sequence: Synthetic coding sequence
atgaggctgcctaagttgctgacattcctcctgtggtatcttgcatggctcgatctggaattcatctgtaccgtcttgggcgcacccgacctgggtcagagaccccaaggtacacgccctggtctcgcaaaggcagaagctaaggaacgtccccctttggccagaaatgtgttccgcccaggtggccactcctacggaggcggagccaccaacgctaacgcaagggcaaaaggtggcaccggtcagactggtggactcactcaacctaaaaaagatgaaccaaagaaactcccccctaggcccggtggtccagaacccaagcccggtcaccctccacaaactagacaagccaccgccaggaccgtcacaccaaagggtcagttgcctggcggtaaggctcctcccaaagctggcagtgtcccttcttcttttttgctgaagaaggcccgcgagcctggccccccacgtgagcctaaggaaccctttagaccaccccctattacaccccatgaatacatgctttccctgtacagaactctctccgacgcagaccgcaagggtggcaactccagcgtcaaactcgaagccggcctcgcaaatactattaccagcttcatcgacaaaggccaagacgatcgtggccctgtcgtcagaaaacagaggtacgtctttgacatctctgccctggagaaagacggactcctgggtgccgagcttcgtatcctgcgtaagaaacctagtgataccgccaaacctgctgcacctggtggcggacgtgcagcacaactcaaactctcctcttgtccctcaggcagacagcctgcctccttgctcgatgtgagatccgtacccggactcgacggttccggttgggaggtctttgatatctggaagttgttcaggaacttcaagaactctgcccagctctgcctcgagctcgaggcatgggagagaggaagggctgtggacctgcgtggtcttggcttcgacagggcagcaaggcaggtgcatgaaaaggcactgttcctggtcttcggcagaactaagaagagagatctctttttcaacgagatcaaggccaggtccggacaggacgacaagaccgtatacgagtacctgttttctcagagaaggaagcgtagggcccctctggccacacgtcagggcaagcgcccatctaagaacctcaaggcccgttgctctcgcaaggccttgcatgtcaacttcaaagatatgggttgggacgactggatcatcgccccattggaatacgaagctttccactgcgagggcctgtgcgagttcccactgcgtagtcacctggagcctactaaccacgccgtcattcagaccttgatgaactctatggatcctgagtccacacctcctacctgttgtgtcccaactcgcctgtcacccatctccatactgttcatcgactccgccaataacgtggtgtacaagcagtatgaggacatggtggtagaatcctgcggctgcagg

SEQ ID NO: 250300 - DNA, 1503 bp, Artificial Sequence
  Description of Artificial Sequence: Synthetic coding sequence
atgcgactgcctaagttgctgacctttctgctgtggtaccttgcctggctggacctcgaatttatctgcactgtactgggagccccagatttagggcagaggccacagggaactcgacctggcctggcaaaggccgaagccaaagaacgacctcccctcgctcgcaatgtgtttcgacctggcggccattcgtatgggggcggtgctacgaacgcaaatgctcgagcaaaaggcggaaccgggcagaccggtggcctaacccagccaaaaaaggatgaacccaagaaattgcctcctagacccggtggcccagaacctaagcccggccacccacctcagaccaggcaggccacagcacgaaccgtgaccccaaagggtcagctcccaggcgggaaagcgcctcccaaggctggctccgtgccctcctctttcctcctgaagaaagcccgagaaccgggaccaccaagagaaccgaaggagccctttcggcctcctcccatcaccccccacgaatacatgctctctctgtatcgtacgctctcagacgccgacaggaaggggggcaacagctcggttaaactggaagccggcctcgccaatactatcacttcattcattgacaaaggacaagatgatcgaggcccagttgtgaggaagcaaagatatgtgttcgacatcagtgcgctcgagaaagatggcttattgggagcggaactgcggattctgaggaaaaagccctcagacacagctaagcctgcagccccgggagggggccgggccgcccagcttaaactgagcagttgtccctccgggcgacagccagcgagcttacttgatgtccggtctgtgcccggcctcgatggcagcgggtgggaagtcttcgacatatggaaattgttccgtaattttaaaaattctgcgcaattgtgtttggagctggaggcatgggaaagaggccgtgcagttgacctgagagggctgggctttgaccgagccgctagacaggttcacgaaaaggcgctctttctggtgttcggccggaccaaaaaacgcgacttgtttttcaacgagattaaggctagaagcggacaggatgacaaaacagtgtatgagtatctgtttagccagcgcagaaagaggcgagctcccctagccaccagacagggaaagaggccttccaagaacctgaaggctcgatgttcacgcaaggcgctccatgtcaatttcaaagatatgggctgggatgactggataattgcacctttggaatacgaagcctttcattgcgaaggcctatgtgaattccccttgcgtagtcacttagaacccaccaatcacgccgtgattcagacgctaatgaattcgatggacccagaaagcaccccaccgacgtgctgtgtcccaacgaggctctctcccatctctatcctgtttattgactctgccaacaatgtcgtctacaagcagtatgaagatatggttgttgagtcatgtggctgtcga

SEQ ID NO: 250301 - DNA, 1503 bp, Artificial Sequence
  Description of Artificial Sequence: Synthetic coding sequence
atgagattgcccaaacttctaacatttctcctttggtacctcgcctggctagatcttgaattcatatgtacggttctgggcgcacccgatctgggtcagcggccccagggcacacggcccggtctggcaaaagcagaagcaaaagaacggccccccctcgcacggaatgtgtttaggcccgggggccactcatatgggggcggcgctaccaatgctaacgccagagccaaggggggtactgggcagacgggtggtctcacccagccaaagaaagacgaaccgaagaaactgccaccgagacccggcggtcctgagccaaagccaggacatcccccgcagactcgccaggctacggccaggacggtgaccccgaaagggcagctgcccggcgggaaagcaccacctaaggcaggctctgtgccgagctcatttctcctcaaaaaggccagagagcctggtcctcctcgggagcctaaggagcctttcagaccgccacctattacccctcacgaatatatgctgtcgctctacaggaccctgtctgatgctgacaggaagggcggcaacagtagcgttaagctggaggcaggactggctaacaccattacctctttcattgataaggggcaagacgacagagggccagtcgtacgaaaacagcgttacgtgtttgacatcagcgccttggagaaagatgggctgttgggggccgagcttcgtatcttaaggaagaagccctccgataccgcaaaacctgctgcacctgggggaggcagggcagcccaactgaagcttagttcatgcccttcagggagacagccagcaagccttttggacgtgcgcagtgttccaggcctggacggatccggatgggaggtttttgatatctggaagttattccgaaacttcaaaaactccgcgcagctgtgtctagaattagaagcatgggaaagggggagggccgtcgacctccgcgggttgggcttcgacagggccgcgaggcaggtacatgaaaaggccctcttcctggtatttggtcgaacaaagaaaagagatttgttttttaatgaaataaaagcccgctcgggacaggatgataagactgtgtacgaatacctgttttcacagcgccgtaaacggcgagcccctctggccacacgacaaggcaaacggccgagcaagaacctcaaggcccggtgttcaagaaaggctttgcacgtgaacttcaaggacatgggctgggacgattggattatagcgcctctggaatacgaagcattccattgtgagggactctgtgaattcccactgaggagtcacctcgagccgacgaaccacgctgtgatacagaccctgatgaacagcatggatcctgagtccaccccacctacttgttgtgtcccaaccagactctctccgatctcaatcttattcattgattctgccaacaatgtagtttataagcaatacgaagacatggtggtagagtcctgtggctgtcgc

SEQ ID NO: 250302 - DNA, 1503 bp, Artificial Sequence
  Description of Artificial Sequence: Synthetic coding sequence
atgcgactgcctaagctcttgaccttccttctctggtatctcgcctggttggacctggagtttatatgcactgtgctgggagcacctgacctcgggcagaggcctcagggaacaaggcccggcctggccaaggctgaagctaaggagaggccccctctcgcacggaatgtatttcgacctgggggccacagctatgggggtggcgccaccaacgcgaatgccagggccaaagggggcaccggacagacagggggcctgacccaaccaaagaaggacgaacctaagaagctgccgcccagaccggggggacccgagcctaagccaggacatccccctcagactagacaggctaccgcgagaactgtcactccaaaaggacagttgccaggaggcaaggccccaccaaaggccggctccgtgcccagtagctttctgctgaagaaggctcgagagcctggcccgccacgggaacccaaagaaccatttagaccgccacccatcactccacatgaatatatgttgagcctgtatcgaacactgtctgacgccgaccggaaaggcggtaacagctctgtgaaactcgaggcaggcctggctaataccatcacgagtttcattgacaaagggcaggatgatcgggggccagtggtgagaaagcaacgctacgtctttgatatctcagcattggaaaaagacggactgttgggcgccgagctcaggatcctcagaaagaaaccttccgatacagccaagcccgctgcgcctggtgggggccgggctgcccagcttaagctgagtagttgtcctagcggtcggcagccggcatctctgttggatgttcgctccgtaccagggctggacgggagcggctgggaggtgttcgatatttggaaactgttcaggaactttaaaaactctgcccaactgtgcctcgaattggaggcctgggaaaggggtcgggcagtggacctccggggactgggttttgatagagccgcccgccaggtgcacgaaaaagctttgtttttggtctttggtcggacaaaaaaaagagatctcttttttaacgaaattaaagcccgcagcggtcaggacgacaaaaccgtgtatgagtatctgtttagccaacgccggaagcggcgagcaccattggccactcggcagggaaaaagaccctctaagaacctcaaagctagatgttctcgcaaggccctccatgtgaattttaaggacatggggtgggacgactggatcatcgccccattggagtatgaggctttccactgcgaagggctgtgtgagtttcctctcaggagtcatttggaacctaccaaccacgccgtgatccaaaccctgatgaacagtatggatccggaatccacacctccaacttgttgtgtgccaacaaggctgagccctatctccatccttttcattgactcagccaacaatgtggtatacaaacagtacgaggatatggtggtggaatcctgtggctgccgg

SEQ ID NO: 250303 - DNA, 1503 bp, Artificial Sequence
  Description of Artificial Sequence: Synthetic coding sequence
atgcgcctgccgaagctgctcacgttcctgctctggtatctggcctggctggatctggagttcatttgtacggttctgggtgctccggacttgggccagcgccctcaaggaacgcgaccgggtctagcaaaggcggaggctaaggaacggccgccgctcgcgcgaaatgttttccgccccggtggccacagctacggtggcggcgccactaacgcgaatgcccgtgcaaaggggggtaccggtcaaacgggaggtttgacccaaccaaaaaaggatgagcctaagaaattgccaccacgtcctggcggtccagagcctaaaccagggcatccgccacagacccgccaagccacggcgcgaactgtcacccctaaaggtcagctgccgggtgggaaggcaccaccgaaagccggctccgtgccttcatcatttttgctgaagaaagcgcgcgagccagggccgccacgcgagcctaaggagccgttcagaccgccaccaatcactccgcacgaatatatgctgagcctgtaccgcacactgtcagacgccgatcgcaaaggtgggaatagctcagttaagctggaggccggcctggccaacacgatcaccagcttcattgacaagggccaggacgataggggtccggtggttagaaaacaacgttacgtgtttgacatctccgctttagagaaagacggattactgggagcggaactccgaattttgaggaagaagcctagcgacaccgccaagcccgccgctccaggcgggggccgtgctgcacaactgaagctgagcagctgcccgtccggcagacagccggcgtctctgctggatgtccgctccgtcccagggctggatggaagcgggtgggaggtatttgatatctggaagctgtttagaaacttcaaaaattctgcccaactgtgcctggagctggaggcctgggaacgcggtcgcgctgtcgatttgcgcggcttgggtttcgaccgtgcggcacgccaggtgcacgagaaggcgctgttcctcgtgtttgggcgaacaaaaaagcgcgacctgttcttcaacgagattaaagcccgcagcggccaagatgataagacggtgtacgaatatctgtttagccagcgtcggaagcgacgagcgccgctggcgacccgccagggaaagagaccatccaaaaacctcaaagcccgctgcagccggaaagccctgcacgttaacttcaaagacatgggctgggatgattggatcattgctccactagaatacgaggctttccactgcgagggcttgtgcgaattcccattaaggtcccacctggagcctacaaatcatgcggtgatccagacacttatgaacagcatggacccggagagcacgcctccaacctgttgtgtgccaacccggctgagcccaatcagcattctgttcatcgactcagctaacaacgttgtctataaacaatacgaagacatggtggtggaaagctgcggttgtcgc

SEQ ID NO: 250304 - DNA, 1503 bp, Artificial Sequence
  Description of Artificial Sequence: Synthetic coding sequence
atgcgactgccgaagctgctcacgtttctcctgtggtaccttgcctggctggatctcgagtttatctgtaccgtgcttggtgcaccagatctgggacaacgcccccagggtactcggcccggtctggccaaggccgaagcaaaagagcgcccgccccttgccagaaacgtctttaggcctggaggtcattcgtatggcggtggcgccacgaatgctaacgcaagagcaaagggcggaaccggacagactggtggacttactcaaccaaagaaagatgaacccaagaagttgccccctagacctggaggtcccgagccaaaacctggtcatcctccccagactcgccaagcgactgcaaggactgtgactcctaagggacaacttcccggcggcaaggcacctccaaaggcaggttcggtgcccagctcattccttcttaagaaagcgagggaaccaggaccaccaagggaacccaaggaaccattccggcctcccccaataaccccccatgaatacatgctcagcctgtaccgtactctgagcgatgccgatagaaagggtggaaactcctcggtgaaactggaagctggcctggcgaacaccattacgtcgttcattgacaaaggacaggatgacagagggccggtggtccgcaagcagcgatatgtctttgatatttcggcactcgagaaggatgggctcctgggtgcagaactgcggatccttcgaaaaaagccatcggacaccgcaaagcctgccgcccctggagggggccgggcagcgcaactgaaactttcgtcgtgtccttcgggccggcaacccgcttccctgcttgatgtgcggtccgtcccaggtcttgatggatccggatgggaggtgtttgatatctggaagctgtttagaaacttcaagaacagcgctcagctttgtcttgaacttgaagcatgggagcgcggtcgtgccgtggacctgcgcgggctgggtttcgatagagccgcaagacaagtgcatgagaaggccctgttcctggtgtttggaaggaccaagaagagagatctgtttttcaacgagattaaagcacgctcgggacaagatgataagactgtgtacgaatatctgtttagccagcgccgaaagcggcgagcccctcttgcaacgagacaggggaagaggccttctaagaatttgaaagcacgctgttcaaggaaggcgctccatgtcaactttaaagatatggggtgggacgattggataatcgcgcccctcgaatacgaggccttccactgtgaagggctctgtgagtttccgcttcgatcgcatcttgagcctacgaatcatgccgtgatccagaccctcatgaattcgatggatcctgaaagcacccctccaacgtgttgtgtccctactcgcttgtcaccaatctctatcctgttcattgattcagcaaacaatgtggtgtacaagcagtacgaggacatggtcgttgaatcgtgcggatgtcgg

SEQ ID NO: 250305 - DNA, 1503 bp, Artificial Sequence
  Description of Artificial Sequence: Synthetic coding sequence
atgagactgcctaagctgctaacattccttctatggtacctagcgtggctggacctggagtttatctgcactgtcctgggagctccagatctcgggcaacgccctcagggaacccggcccggcttggctaaggccgaagccaaggagcgtcctccactggcgcgaaacgtgttccggcctggcgggcacagctacgggggcggagccacgaacgccaacgcccgagctaaaggcggtaccggtcagaccgggggactaacacagcctaaaaaggatgagcccaagaagctgcctcctcgacccggagggccagaaccgaaaccaggccatccccctcagaccagacaggctactgcaaggaccgtcaccccaaagggccagctgccgggcggaaaagcccctcctaaagccgggtccgtgccgagttcctttctcctgaagaaggctagggagcctgggccaccccgagaaccaaaagaaccctttcgccctcctccgattactcctcacgaatacatgttaagcctctatcgaaccttgagcgacgcagacagaaaaggtgggaattcaagcgtaaagctcgaggcgggtctggctaatacaattacttcgtttatcgataagggacaggacgaccggggtcccgtcgtgcgtaagcagcgctatgtgtttgatatttcagccctggagaaagacgggttgttgggcgccgagctgcggattctcaggaagaagccaagtgacacggcaaagcctgccgcaccaggcggtgggagagccgctcagctgaagctttccagctgccctagtgggcggcagcccgcaagcttgttagacgtaagaagcgttcccggcctagacggtagcgggtgggaagtgtttgatatttggaaactgtttaggaactttaaaaatagtgcacagttgtgtttagagctggaggcatgggaaagaggcagggccgtggatctgcgtggtctgggctttgaccgggccgccaggcaggttcatgaaaaggcgctgtttcttgtcttcgggcggactaagaaaagagacctgtttttcaacgaaattaaagcgcgatccgggcaggacgataagactgtgtatgagtatcttttcagccaaagacggaagcggcgcgcccccctggccaccagacagggaaagcgaccatcaaaaaacctcaaagcacgctgttctaggaaggctttacatgtaaacttcaaagatatgggctgggacgattggatcatcgccccacttgagtacgaggccttccattgcgagggtttatgtgagttccctctccggagccacctggagccgaccaatcatgcggtgattcagaccttgatgaacagcatggatccggaatccacacccccgacgtgttgtgtccctacccggctatccccgatttctatacttttcattgacagcgccaacaacgtagtgtataagcagtacgaagatatggtggtcgagtcatgcggatgtcgc

SEQ ID NO: 250306 - DNA, 1503 bp, Artificial Sequence
  Description of Artificial Sequence: Synthetic coding sequence
atgaggcttcccaagctgctcacctttttgctgtggtacctcgcctggctggatctggaattcatttgtactgtgctgggtgcgccagatcttgggcaacgcccgcaggggacccggcctggactggcgaaagcagaggcaaaggaacgacccccattggcccggaacgttttcagacctggaggtcatagctacggaggaggtgccaccaacgctaacgctagggcaaaaggtggtaccggacaaactggaggcctgacccaacctaaaaaggatgaaccaaaaaagttgccgccacgtccaggaggccctgagcctaagcctggtcatccccctcagactagacaagcaactgcaagaactgtgactcctaagggacagctgcctggagggaaagccccgcctaaagcaggatcggtgccttcctcgtttttgctcaagaaggcacgtgagcctgggccgcctcgtgagcctaaggaaccttttcgacctcctcctattaccccgcatgaatacatgctctcactctacagaactttgtcggatgcggatagaaagggaggcaattcatcagtcaagctcgaggctggccttgcaaataccatcacctcattcattgacaaaggacaagatgatagaggtccagtggtgaggaagcagcggtacgtgtttgatatcagtgctcttgagaaggacggtctgctcggtgcagagcttcggattctccgcaagaagcctagcgacactgccaagcctgccgcgccaggaggaggacgggcggcgcagcttaagttgtcctcatgtccctccggacgccaacctgcgagcctgctggatgtccggtccgttcctggacttgatggctccggttgggaggtgttcgacatttggaagctgttcagaaactttaagaactcagcccaactctgtttggaactcgaggcgtgggaacgtgggcgggcagtggatctgcgcggtcttggctttgaccgtgcagcacgccaggtccatgagaaggcacttttccttgtgtttggcagaaccaaaaaacgagatcttttctttaatgaaatcaaggcaaggtcgggacaggatgataaaaccgtctacgagtatttgttttcccagaggagaaagaggcgtgcccctctcgccaccagacaaggaaagcgtccgtcgaagaaccttaaggcaagatgctcgcgaaaggccctccacgtcaatttcaaagatatgggatgggatgactggattatcgctccgctcgaatacgaggcgttccattgtgagggactgtgtgaattccctctgaggagccaccttgagccaaccaatcacgcagttatccagactttgatgaactctatggaccctgaatcgacgccccccacctgttgcgtcccaacgagactttctccaatatcgatccttttcattgactcggccaacaatgtggtgtacaaacaatacgaagatatggtggtggagtcctgcggatgtagg

SEQ ID NO: 250307 - DNA, 1503 bp, Artificial Sequence
  Description of Artificial Sequence: Synthetic coding sequence
atgagacttcctaagctgctcacctttttgttgtggtaccttgcctggcttgatcttgagtttatctgcacggtgctgggagcaccagatttgggtcagcggccacagggcactcgccctggtctggcaaaagcagaagcaaaggaaagaccccctctcgcaagaaacgtctttcgaccgggaggacactcatacggtggaggtgccaccaacgccaatgcaagggcaaaagggggaactggacaaaccggggggctgactcaaccgaaaaaggacgagccaaagaaactcccacccaggcccggcggtccagaacctaagccaggtcatcctcctcaaactagacaggctactgcaagaaccgtcactcccaagggacaactgcctggcggaaaggcaccccctaaagctggatccgtgccgtcctcatttcttttgaagaaggcaagagaacccggccctccacgcgaacctaaggaacctttcagacctccaccaattacgccccatgaatacatgctgagcctttatcgaactctgtccgatgcggaccgcaaagggggaaactcaagcgtgaagttggaagcggggcttgcgaacaccattacctcctttatcgataaggggcaggatgatagaggtcccgtcgtccgcaagcaacgatacgtgtttgacattagcgcactcgaaaaggatggacttctcggagctgaactccgtattctgagaaaaaagccgagcgacactgcaaagccagcagccccaggtggaggtcgggcggcacagctgaaactttcctcctgtccatcgggccgacaaccggcctctcttctcgatgtgcgtagcgttccgggccttgacggaagcggttgggaagtgtttgatatttggaagttgttccgaaacttcaagaattctgcacaactttgtctggagctggaggcatgggaaaggggcagggctgtggacttgcgtggcctgggttttgaccgtgcagcaagacaggtgcacgagaaagcactgttcctggtgtttggtcggactaagaaacgcgatctcttcttcaacgagattaaagcccgctccggacaggacgataagactgtctacgagtacctgttctcacagaggagaaagcgaagggctcctctggcaactcgtcagggaaagcgcccatccaagaaccttaaggcccgctgctcaaggaaggcgcttcacgtcaactttaaggatatgggttgggatgactggataatcgcacccttggagtacgaggcattccattgcgaaggactgtgcgaatttcctctgcggtcgcatctggaaccaactaaccatgccgtgatccaaactcttatgaacagcatggatccggaatccacccctcctacttgctgtgtccctaccagactttcaccaattagcattctgtttatagatagcgccaacaatgttgtgtacaagcagtacgaggacatggtggtggaatcctgcggctgtcgc

SEQ ID NO: 250308 - DNA, 1503 bp, Artificial Sequence
  Description of Artificial Sequence: Synthetic coding sequence
atgcgcctgccaaagctcctcactttcctgctgtggtacctcgcatggctcgacctcgaattcatttgtactgtgctcggtgctcccgatctgggacagcggccgcaaggaaccagaccgggtctggcaaaagctgaagcaaaggaacggccgcctctggcccggaacgtgttcaggcccggcggacattcatacggagggggcgcgaccaatgccaacgcacgggccaagggcggcaccggtcagaccggtggtctgactcagccgaagaaggatgagccaaagaaacttccgccccgccccggcggacccgagccaaagccgggccacccgcctcaaactagacaggctaccgcgcgcactgtcactccgaagggccagctgccgggcgggaaggctcccccgaaagcgggatcggtcccttcatcatttctgctcaagaaagcgcgagaacccggcccaccaagggaacctaaagaaccgttccggccgccgccaatcaccccacacgaatacatgctctcactgtacagaactctgagcgatgcggaccgaaaaggaggaaattcgagcgtgaagctggaagcgggactggccaacaccatcacctcgttcattgacaaggggcaagatgatcggggtccagtggttcggaagcagcggtacgtgttcgatatttccgcactggaaaaagacgggctcctgggagccgagctgcggattttgcggaagaagccttcggacactgccaagcctgcggccccgggaggcggccgcgcggctcagttgaaactgtcctcgtgcccgtcaggtcgccaaccagcctcactcctggacgtgaggtcagtgccaggcctggatggatcgggatgggaagttttcgatatttggaaacttttccggaactttaagaatagcgctcagctctgccttgagctcgaggcctgggaacgcggcagagccgtggatctgcgcggactgggcttcgaccgggccgccagacaagtccatgagaaggcgctgttcctcgttttcggacgcaccaagaaacgcgaccttttcttcaacgagatcaaggctagatctggccaggatgataagactgtctatgaatacctttttagccagcggaggaagcgcagagcgccgctggccactcggcaaggaaagcgcccttcgaagaacctcaaggcccgctgctcacgcaaagccctccacgtgaacttcaaagacatggggtgggacgactggatcatcgcgcctctggaatacgaagccttccattgcgaggggctgtgtgagtttcccctccggtcccatctcgagcctaccaatcatgcagtcatccaaaccctgatgaactccatggacccagagtcaaccccgcccacttgctgcgtgccgacccggctgagccccatctccatcttgtttatcgactcagctaacaacgtggtgtacaagcaatacgaggatatggtggtggagtcctgcggctgtcgc

SEQ ID NO: 250309 - DNA, 1503 bp, Artificial Sequence
  Description of Artificial Sequence: Synthetic coding sequence
atgagactccccaagctactgactttcctattatggtatctagcttggctggatttagaatttatatgcactgtcttaggagcccctgacctcgggcagagaccccaggggactaggcccggattagccaaagccgaagctaaagaaaggcctcctcttgctcggaatgtttttcggcctggaggacattcgtatggggggggagcaactaacgctaacgcccgagccaagggggggacaggacagactgggggactgacacagcccaaaaaagatgagccaaaaaaattacctccaaggcctggagggcccgaacccaagccagggcacccccctcagacaaggcaggctactgctaggacggtaactcccaaagggcagctacccggagggaaagcaccacccaaagccgggtctgttccctcttctttcctccttaaaaaagctagagaaccaggaccacctcgggaaccgaaagagccctttagaccccctccaataacacctcacgaatatatgctaagtctttatagaacactatctgatgccgatcgcaaaggaggaaattcatctgtcaaattagaagccgggttagcaaatactatcacttcttttatagataaagggcaggacgaccgagggcctgtggttcgcaaacagagatatgtcttcgacatctctgcattggaaaaagatggactactaggagcagaacttcgaatccttaggaaaaagccatctgatacggctaaacctgccgctccaggaggagggcgcgccgcgcagcttaaactctcatcatgccccagtggaagacagcccgcctctcttctggatgtccgatctgtcccaggactagatggaagtggatgggaggtgttcgatatttggaaactatttcggaatttcaagaactctgcacagctttgtctcgaattggaagcctgggaaaggggacgcgccgtagatttacgcgggctggggttcgaccgggccgctcgccaggtgcatgagaaggccttattcctcgtctttggacgcactaaaaaaagggatttgttcttcaatgaaataaaggctcgatcggggcaggatgataaaacagtatacgagtatctgttttctcagaggcggaaaaggcgggctccactggccactcggcagggaaaaaggccatctaaaaacctcaaagctcgatgttctcggaaggccttacatgtaaatttcaaagatatggggtgggatgattggatcattgcccctctcgaatacgaagcctttcattgtgaaggactgtgtgaattcccactgcgctctcaccttgagccaacaaaccacgccgtgattcagacactgatgaattccatggatcccgaatccacacctcctacatgttgcgtgccaacacggctttccccaatatcgatccttttcattgatagtgccaataatgtagtgtataaacagtatgaagatatggtggtggaatcttgtggatgcagg

SEQ ID NO: 250310 - DNA, 1503 bp, Artificial Sequence
  Description of Artificial Sequence: Synthetic coding sequence
atgcggttacccaaacttctgacttttttattgtggtatttggcctggctcgatttggaattcatttgtacggttctcggagccccggatttaggacagcgtccacaaggaacgaggcctggtcttgctaaggctgaagctaaagaaaggccaccattggcccgtaacgtctttaggccgggtggacattcatatggtgggggggctactaatgccaatgctcgggcaaaggggggtacaggtcagacgggcggtcttactcagccaaaaaaggacgagcccaagaaattgcctccaagacccggaggccccgagcccaagcccggacatccgcctcagacacgacaagctactgcgcgaacagttactcctaaaggtcaattgccaggcggcaaagctcccccaaaggctggatccgtcccaagttcatttttgcttaagaaagctcgggaacccggtcctcctagggagccgaaggagccattcagaccaccacccatcactcctcatgaatatatgctctccctctataggacattgtccgatgctgatcgcaagggtgggaattcaagtgtaaaacttgaagctggacttgctaacactattaccagctttatagataagggccaagatgaccgcggtccagttgttcgaaaacaaagatatgttttcgatatctcagctctcgagaaagacggtcttcttggtgccgagcttagaatccttaggaagaagccatctgatacagccaagcctgccgccccaggtggtggaagggcggctcagttaaagctctcgtcatgcccctccggtaggcagcctgctagtctcctcgatgtccgatcagtacccggacttgatggttcagggtgggaggtgttcgacatctggaaactctttagaaatttcaagaatagtgctcaactttgcctggaactcgaagcctgggagcgaggacgtgcagtagatttgcgtggtcttggcttcgatagggctgcgcgccaggtgcacgagaaggcactgttcttagttttcggtagaactaaaaagcgtgatcttttctttaacgagataaaggctcgttccggacaagatgataagaccgtttatgaatatcttttctcacaaaggaggaagcggcgagcaccattggctacacgccaaggaaaacgtccatctaagaaccttaaagcacgttgctcgaggaaggccttgcatgtaaatttcaaagatatgggatgggacgactggataatcgccccgttagaatatgaggcatttcattgtgagggtttgtgcgagtttcctctccggtcccaccttgaaccaactaaccacgctgttattcagactcttatgaactctatggatccagagtcaacaccgccaacgtgctgtgtacctactaggctgtctcctatctccatcctatttattgacagtgctaacaacgttgtatacaaacaatatgaggacatggttgttgagtcttgcggttgccgt

SEQ ID NO: 250311 - DNA, 1503 bp, Artificial Sequence
  Description of Artificial Sequence: Synthetic coding sequence
atgcgcctcccaaagctgcttaccttcctgctgtggtacctcgcgtggttagatctcgaattcatctgcacagtgctgggagccccagacttaggtcagaggccccaaggtacaagacctggactagcgaaggcggaggccaaggagcggccccccctcgccagaaacgtctttcgacccggtggacactcatacggcggaggggctaccaacgcaaacgcaagggctaaaggcggaacaggtcagactgggggccttactcaacctaaaaaggacgagcccaagaagctccctcccaggcctggcggccccgagcccaaacctgggcacccccctcagacacgtcaggccacagcaagaacagtgacgcccaaaggccagctgccagggggaaaggcaccccctaaggccggctcagttccatcctcttttctcctgaaaaaggcccgtgaaccaggccctcctcgagagcctaaggaacccttccgcccccctccaatcactcctcacgagtacatgctttctctgtatcggaccttgagcgacgccgaccgtaaaggcgggaattctagcgtcaaattggaagcaggcctggctaacactattacctcctttattgacaagggtcaggatgaccgaggcccggtagtcagaaaacaaaggtacgtgttcgatatcagtgctctcgagaaggacggtttactgggagccgagctcaggattctgcgcaaaaagccctccgacactgccaagcccgccgcccccggcggagggagggcagctcagttgaagctgagttcttgcccatctggccgtcagcccgcgtccttgctggacgttaggtcagtgcctggtctcgacggatctgggtgggaggtattcgatatctggaaactatttcggaactttaagaattccgcgcagttgtgcctggaactggaagcctgggaacggggcagagctgttgacctgcgggggttgggattcgacagagccgcccgccaggttcacgagaaagcactctttctggtgtttggacgcactaaaaaaagagatctcttttttaatgagatcaaggcccgatctggacaggacgacaagactgtctatgaatatctgttttcacagcggcgaaagagacgggcgccgctcgcaacacggcagggcaagagacctagcaagaatcttaaagcccgttgctctcggaaggccctgcatgtgaactttaaagatatgggctgggatgactggattatagctcctctggagtacgaggcgttccactgcgagggcttgtgtgaatttccactaaggagccatctggaacccactaaccatgccgtgatacagacgctaatgaacagcatggatcctgagtctacaccccccacttgctgtgttcccactcgcttaagtcccatctccatactcttcatagattctgccaataacgtcgtctataaacaatacgaggacatggtggtcgaaagctgtggctgtcgt

SEQ ID NO: 250312 - DNA, 1503 bp, Artificial Sequence
  Description of Artificial Sequence: Synthetic coding sequence
atgcgcctcccaaaattgttgacttttctgctctggtacctggcgtggttggacctggaatttatctgcaccgttcttggagctccagatttaggccaaagaccacagggaaccaggcctggcctcgccaaggccgaggccaaggagcgtccgcctctggcgagaaacgtgtttaggcccggcggtcattcctacggcggcggcgctaccaatgctaacgcccgcgcaaaaggcggaacagggcagacaggcgggctaactcagcccaagaaagatgagcctaaaaagcttccccccagacctggagggcctgagccaaagcccggacatccaccccaaactcgccaggccaccgccaggaccgttacgcctaaaggacagttaccgggtggaaaggccccgcccaaagccggttctgttccatcgtcctttctactgaagaaggcccgagaacctgggccccccagagaacccaaagagccattcagaccccctcctattactcctcacgaatatatgttatcactgtatcgcacactctccgatgccgacagaaagggggggaacagttcagtcaaactggaggcaggactggcaaatactataacttcttttattgataaaggccaggacgatcgcggccccgtggtaagaaagcagagatatgtttttgacatcagcgccctggagaaagacggcctcctcggggccgaattaaggatccttaggaagaaaccctccgataccgccaagccggcagctcccgggggtggccgagctgctcagttgaagctcagtagctgtccttctggacgtcagcccgcgtccttgttggacgtccgatctgtgcccggactggacgggtcaggctgggaagtttttgatatctggaaactgtttaggaatttcaaaaactcagcccagctgtgcctggagctcgaagcctgggagcgggggagagccgtggatctgcgaggcctgggatttgatcgggctgcgcgacaagtgcatgaaaaagccctgtttctcgtctttggtcgaacgaaaaagcgagatctgtttttcaacgaaatcaaagcgcgttccggccaggacgataagaccgtctacgagtacctgttctctcagcgccgcaaaaggcgagctcctctggccactcgtcagggcaaaaggccttctaaaaatcttaaggcccggtgttcaagaaaggccctccacgtgaactttaaagatatggggtgggacgattggattattgcccccctggaatatgaggccttccactgtgaaggcttgtgtgaattcccccttcggagccacttggagccaacaaatcacgccgtgattcagacactgatgaactcgatggaccccgaatcaacaccaccaacctgctgtgtgcccacacgtctgagccctatttctatactgtttatcgactctgcaaataatgtggtctacaaacagtatgaagacatggttgttgaatcctgcggatgccga

SEQ ID NO: 250313 - DNA, 1503 bp, Artificial Sequence
  Description of Artificial Sequence: Synthetic coding sequence
atgcggctgccaaagctcctgacctttctcctctggtacctggcctggctcgatttggaattcatttgcactgtgttgggcgctccagacctcggccaaagaccgcagggcacgcgcccgggcctggccaaggccgaggctaaggagcgccctccgctggcgcggaacgtctttcgcccaggcggacactcatacggtggcggagccactaatgccaacgccagagccaagggaggcactgggcaaaccggaggtctgacccagcccaagaaggacgagccaaagaagctgcccccacgcccgggcggtccagaacctaaaccaggacacccaccgcagactcgccaggctaccgctagaactgtgaccccgaaaggacagctgcccggtggtaaggccccaccgaaggctgggtccgtccctagctccttcctcctcaagaaggcgcgggagcccggtccgcccagggagccgaaggaacctttccgcccacccccaatcaccccgcatgaatacatgctgtcactttaccgaactctgtcggatgctgaccgcaagggagggaactccagcgtcaagctggaagctgggctcgcgaacaccatcacttcattcatcgacaaagggcaggatgatagaggccccgtggtccggaagcaacgctatgtgtttgacatcagcgctctggagaaggatggactgctgggagccgagctgaggattctccggaagaagccgtccgatacggcaaaaccggctgcaccaggtggaggacgcgcagcccaactgaaactctcctcatgcccttcgggacggcaaccagcatccctgctggacgtgagaagcgtgccgggcctggacggctcgggatgggaggtgttcgatatttggaaactgttccgcaactttaagaattccgcgcagctctgcctcgaactggaggcgtgggagcgcggcagagcagtggacttgcgcggactggggtttgatcgggccgcccgtcaggtgcatgaaaaggcgcttttccttgtattcgggcggaccaagaaacgggatctcttcttcaacgaaatcaaagcccgctccggtcaggacgacaagactgtctacgagtatctcttctcccaacgccgcaaaagacgcgcgccgctggccacccggcagggaaagcggccgtcgaaaaaccttaaagcccgctgctcacggaaggcgctgcatgttaacttcaaggacatgggctgggacgactggatcatcgctcctctggaatacgaagcgtttcattgtgagggcctctgcgaattcccgctgcgaagtcacctcgagcctaccaaccatgccgtgatccagacgctcatgaattccatggatcctgagtcaactccaccgacctgttgcgtaccgacgcgcctgagccctatatcgatcctgttcatcgattcggccaataatgtggtgtacaagcaatacgaagatatggtggtggaaagctgtggctgcaga

SEQ ID NO: 250314 - DNA, 1503 bp, Artificial Sequence
  Description of Artificial Sequence: Synthetic coding sequence
atgcggctgcccaaactcttaacgttcctcctgtggtaccttgcctggctggaccttgagtttatctgtacagtcttgggcgccccagacctcggccagcggccacagggcactagacccggcctggccaaggccgaggctaaagaaagacctcccctcgctcggaatgtattccgccccggcggacacagttatggcgggggtgctacaaacgctaatgcgcgtgcaaaggggggtacgggacagaccggtgggctgacccagccaaagaaggacgagcccaagaaactgcctcctcgcccgggcggccccgaacccaagccaggccatccaccccagacgcgtcaggcgacggcccgtactgttacacccaaaggtcagctgcccggagggaaagcgcctcccaaggcaggttcggtgcccagttcattcctcttgaaaaaggccagagaacctgggccacccagagagcctaaggagccttttaggccgccacccatcacaccacacgaatacatgttgtcactataccggaccttgagtgacgccgaccgaaagggcggcaattctagcgtgaagcttgaagctgggttggcaaataccatcaccagctttattgataaaggacaagatgaccgaggtccagtagtgcggaagcagagatatgtgttcgacatatctgccctggaaaaggatggcctgcttggggctgaactgcgaattctcaggaaaaagccttcagacaccgctaagcctgctgcgccgggaggaggccgggcggcacagctcaaactcagctcttgtccaagtggcagacagcccgcttctctgttggatgtgcgatctgtccccgggctggacggcagcggctgggaagtcttcgacatctggaagctttttaggaattttaagaattctgctcaactttgtctggaactggaagcctgggagaggggcagggcggtcgacctgaggggactgggcttcgatagagcagctaggcaagtccacgaaaaagcactgtttctggtctttggtcgcactaagaagagagacctgttctttaacgagatcaaggccaggagcggccaggatgacaaaacagtctacgagtacctgttctcccagcggagaaagaggcgggccccactggcaacacgacagggaaaaagacccagtaagaatcttaaggccagatgcagtcggaaagcccttcatgtgaatttcaaggacatgggctgggacgattggatcatagcccctttggaatacgaggcgttccactgcgagggcttatgcgaattcccgctccggagtcatctggaacccaccaatcacgctgtcatacagaccttaatgaattccatggaccccgaatcaacacccccgacatgctgtgtgcctacaagactgtcacctatatctatactttttattgactccgcaaacaacgtcgtgtacaagcaatatgaggatatggtcgttgagagctgcggatgtaga

SEQ ID NO: 250315 - DNA, 1503 bp, Artificial Sequence
  Description of Artificial Sequence: Synthetic coding sequence
atgcgcctccccaaactcctcacctttcttctctggtacctggcatggttagatctggagtttatctgcacggtcctcggtgcgcctgacctcgggcagcggcctcaaggtacacgacccggtctggcgaaagctgaggcgaaagagcgacctcctttggctcgcaacgtgtttcgcccgggcggccatagctacgggggtggggcaacgaacgctaatgcccgggctaagggcggtacgggacagacaggcggcttaacacagcctaaaaaagacgagcccaagaagttgcctccaagacccggggggccagaacccaaaccaggacatcctccccaaactcgtcaggctacagctaggaccgtcactcccaaagggcagctgccaggtggaaaggctccccccaaggccgggtctgtcccgtcatcgttcctgctaaaaaaggccagggaacctggcccgcccagggagcccaaagaacccttccggccacccccaattacaccgcacgaatatatgttatccctctatcggaccctgtccgatgcggacaggaagggtgggaactcatccgtcaagttagaggccggcctcgccaatactattacatcctttattgacaaaggccaggatgaccgcggccctgtcgtacgaaagcagcgttacgtgttcgatatcagcgccctggaaaaggatgggctcctcggggccgagctacggatcctgagaaaaaaaccaagcgataccgctaaacccgcagctcctggcgggggcagagccgcgcaactgaaactaagctcctgcccatcaggtcggcaacccgcctctttgctggacgtgcgctccgtgcctggccttgatggctcggggtgggaagtgtttgacatttggaaactgttcagaaatttcaagaatagcgcacaactctgccttgagctggaggcatgggaaagaggaagggcagtggaccttcgcggccttggcttcgacagggctgcccggcaggtgcatgagaaagccctgttcctggtatttgggcgcaccaaaaagagggatctgttctttaatgaaattaaggcccggtctggtcaggatgacaaaacagtatacgagtacttgttctcacagaggaggaagagacgggcccctctcgccacgcggcaggggaagaggccatcaaagaacctcaaggccagatgcagccgcaaggctctacatgtgaattttaaagacatggggtgggacgactggataatcgctcccttagagtatgaagctttccattgcgaagggctatgtgaattccccttacggtcacacctcgaaccaacaaatcacgctgtaatccagacactgatgaatagtatggacccagaatccacgcccccgacctgttgtgtccctacaaggctcagcccaatcagcatcctgttcattgatagcgctaataatgtagtatataaacagtatgaggacatggtagtagaaagttgcggatgcagg

SEQ ID NO: 250316 - DNA, 1503 bp, Artificial Sequence
  Description of Artificial Sequence: Synthetic coding sequence
atgaggctgccaaagctgttgacttttctcctgtggtacctcgcctggctggatctggaatttatttgtacagttctgggcgctcctgatcttgggcagaggccccagggcacacgaccagggcttgccaaagctgaggcgaaagaacggccaccactcgcgaggaatgtgttcagacccggcggacactcttatggcggcggcgccacaaacgctaatgcacgggctaaagggggtactgggcaaacaggcggcctcactcagcccaagaaggacgagccaaagaagcttccccctcgcccaggcgggcccgaaccaaagcctggacacccaccacagaccagacaggccactgctcggacagtgacacccaagggccaactgccgggcgggaaggcaccgccaaaggcagggtcagtaccctccagcttccttctgaaaaaggcccgggaacctggtccaccccgggagcccaaggaaccattcaggccccctccgattaccccccatgagtacatgctctctctgtacaggactttgtccgacgccgacagaaaaggtgggaattcttccgttaaactcgaggccggcttggccaacacgatcaccagtttcattgacaaggggcaggatgaccggggacccgtggtcagaaaacaaagatatgtgttcgacatttctgccctcgagaaggatgggctgcttggcgcagaactcagaattctccgcaagaagcccagcgatacggcaaaaccagctgcacccgggggcggtcgggccgctcagttgaagctgagttcttgcccctccggacgccagccagcttctctccttgacgtgagatctgtgccaggcctcgacggaagcggatgggaggtcttcgacatctggaaactgtttaggaactttaagaattccgcccaactgtgtctcgagcttgaggcttgggaaaggggcagggcggtggacttgcgagggctcgggtttgatagggccgctagacaggtgcacgagaaagctctctttttggtgtttggacggaccaagaaaagggatttgttcttcaatgagatcaaggcacgatctggccaggatgacaagacggtctacgagtaccttttttctcagcggcgcaagcgccgggctcctttggctacccggcagggtaagcgcccttccaagaatctgaaggctagatgtagcagaaaagctctgcatgtgaatttcaaggacatgggttgggacgactggatcatagctcccctggaatatgaggccttccactgtgaggggttgtgtgaattccccctgagaagtcaccttgaaccaacaaatcatgctgtaatacagaccttgatgaattccatggaccccgagagtacgccacctacttgctgcgtgcctactcggctgagtccaatctccatcctctttatcgattccgctaacaatgtggtgtacaaacagtacgaggacatggtggtggagtcctgtggttgtaga

SEQ ID NO: 250317 - DNA, 1503 bp, Artificial Sequence
  Description of Artificial Sequence: Synthetic coding sequence
atgcgcctgccgaaacttctgactttcttgctgtggtatctcgcgtggctcgacctcgaattcatctgtactgtcctgggcgcaccggacctgggccaacggccgcagggtaccagacccggtctggcaaaggcggaggcaaaagaaaggcctccgctggcgcggaacgtgtttcgcccaggagggcattcgtacgggggaggagcaaccaatgctaacgcgagagcaaagggagggaccggacaaacgggagggctcacccagcctaagaaggacgagccgaagaagctgccacctcgccccggcggaccggagccgaagccggggcacccaccacagacccgccaggccaccgcccgcactgtgaccccgaagggacaacttccgggcggaaaggcgcctccgaaggccggctcggtgccgagctcattcctgctgaaaaaagcccgggagccagggcctcctcgagaaccgaaggaaccatttcggccgccgcctatcactccccacgagtacatgctctccctctaccgcactctgtcggacgcagaccggaagggcggtaattcaagcgtcaagttggaggcagggctcgccaataccatcacttccttcatcgataaagggcaagacgaccgggggcctgtggtgagaaagcagcgctacgttttcgatatctcggccttggagaaggatggtctgcttggagccgaattgaggatacttcggaagaaaccctcggataccgccaaaccggctgcgcccggcggcggccgggccgcacagctgaagctgagctcctgcccgagcgggagacaaccggcctcgctcctggacgtccgttccgtgccgggcctggacgggtcaggatgggaggtgtttgacatctggaaactgttccgcaatttcaaaaactcagctcagctttgcctggagctggaagcatgggaacgcggccgagcagtggatctgcggggactcggattcgaccgcgctgctcggcaggtgcacgagaaggccctgttccttgttttcggacgaactaagaagagggatttgttctttaacgagatcaaggcccgcagcgggcaggatgataagaccgtctacgaatacttgttttcacaacggagaaaacggcgggcaccactcgcaacgcgccagggcaagcgcccgtcaaaaaacttgaaggcgaggtgctcccgcaaagcattgcatgtgaacttcaaggacatgggatgggatgattggattatcgcccctctcgaatacgaggcgttccactgcgaaggtctgtgtgaattcccgctgcgctcacatctcgaaccaactaaccacgctgtgattcagacgctgatgaattcgatggacccagaatcgacgccgcctacctgctgcgtcccgacccggctgtcgccaatctcaatcctgttcatcgacagcgcaaacaacgtggtgtacaagcaatacgaagatatggtggtcgagtcctgtggctgccgc

SEQ ID NO: 250318 - DNA, 1503 bp, Artificial Sequence
  Description of Artificial Sequence: Synthetic coding sequence
atgaggctgccaaaactccttacatttctcttgtggtacctcgcttggctggacttggagttcatctgcacagtgctgggagccccggacctgggccagagaccgcaaggcacaaggcccggtctggctaaggccgaagctaaagaaaggccacctctcgccaggaacgtcttccgcccagggggtcactcttatgggggcggggctacaaatgccaacgctcgggccaaaggaggaaccggtcaaactggcggactcacacagccgaagaaggacgagccaaagaagctgcctccgcgaccaggaggccctgaacctaaacctggccaccctcctcagacccgccaggccacagcccgcactgtgaccccgaaggggcagctgccgggcggtaaggcgcccccaaaggcaggctcagtgccttcttcgttcctgcttaaaaaggccagagagcctggcccaccaagggagccgaaggagccattcagaccccccccaatcacacctcacgagtatatgctgtccttgtacaggacactgtcagatgccgaccggaagggggggaatagctcagtgaaattagaggcaggcctggcaaacactatcacgagtttcatcgacaagggtcaggacgatcgaggaccagtggtgcgcaagcagaggtatgtcttcgacatcagcgctctggagaaggatggccttctgggtgccgaattgagaattctgagaaaaaagccctccgacacggccaaaccggccgcacccggaggggggcgggcagcacagctgaaactctcttcatgtccctccggacgtcagcctgcaagcctcctggacgtcaggagcgtaccagggcttgacggctccggctgggaggttttcgatatttggaaactatttagaaacttcaaaaattcagcgcagctttgcctagagttggaggcatgggagagaggacgagccgttgacctccgcggacttggcttcgatcgggcagctcgccaggtgcacgaaaaagccctctttctggtcttcggcagaacaaagaaacgtgatctgttctttaatgagatcaaagcgcgaagcggacaagacgataaaactgtctacgagtatttgtttagccaacgccgaaagcggcgtgctccactggccacccgacagggcaaacgacctagtaagaaccttaaagcccgctgtagccgcaaggcgctgcatgtaaactttaaggacatggggtgggatgattggattattgcacccctcgaatacgaagccttccactgcgagggtctgtgcgagttccctctgagatcacatttagagccaacaaatcacgccgttattcaaacgctgatgaattctatggacccggaatctaccccccccacatgctgcgttcccacacggctatccccaattagtattctattcatcgattcagctaacaacgtggtttataaacaatacgaggacatggtggtggaatcttgtgggtgtagg

SEQ ID NO: 250319 - DNA, 1503 bp, Artificial Sequence
  Description of Artificial Sequence: Synthetic coding sequence
atgagattgccaaagctgctgacattcctgttatggtatctagcttggctggaccttgagttcatctgcaccgtcctgggcgcccccgacttagggcagcgtccccagggaacccgtcccgggctggcgaaggccgaggcaaaggagcgccctcccctggcgcgcaacgtatttaggccagggggacactcatacggtggcggtgcgactaacgcaaatgcaagagcaaagggtgggacaggtcagacgggaggactaacccagcccaaaaaggacgagccaaaaaaacttcctccacgcccaggggggccggagccaaaacccggtcatccgccacagactcggcaagctactgcgaggacagtcacccccaaaggacagcttccgggcggaaaagccccccctaaggctgggtcggttccttcatctttcctgctgaagaaagctcgagagcctggtccacctagggagcccaaagaaccctttcggcctccccccatcacaccccatgagtacatgctgtctctctaccgcacgttgtcagatgctgaccgcaaggggggcaacagttcagttaaactcgaagccggtctggccaatacgatcacttccttcatagataaagggcaggacgaccgcgggcccgtggtgagaaaacagcggtatgtgttcgacattagcgctctcgaaaaagatggtcttttgggtgccgagcttcggattttaagaaaaaaaccatcggacaccgccaagcccgctgctcccgggggcgggagagccgcgcagctgaagctaagcagctgccccagcggcaggcagcccgccagtctgctcgatgtgagaagcgttcctgggctggacgggtccggatgggaagtgtttgatatctggaaactgtttagaaattttaagaactcagctcagctctgcttggagctcgaagcctgggagagagggcgggcagtggatctgcgaggcctcggcttcgatcgggctgcccggcaagtgcacgagaaagccctgtttctagtgtttggtagaaccaagaagcgggacttattttttaatgaaatcaaagcccggtcaggccaggacgacaaaacggtttatgagtatctcttctcgcagagacgcaagcgaagggcgccactggctacaagacaggggaagcggccttccaaaaacctgaaggcccggtgttcgaggaaagccctgcacgttaattttaaagatatgggatgggacgactggatcatcgctcctttggagtatgaggcttttcattgcgaaggcttgtgtgaatttccactccgcagccacctggagcctaccaaccatgcagtgatccagacattgatgaacagtatggaccctgagagcacgccacctacgtgctgcgtgcctaccaggttgtccccaattagcatattgttcatcgattcagccaataacgttgtttataagcagtacgaagatatggtggtggagtcctgtggctgtcgg

SEQ ID NO: 250320 - DNA, 1503 bp, Artificial Sequence
  Description of Artificial Sequence: Synthetic coding sequence
atgcgtctccctaaactgctcaccttcctcctgtggtacttggcttggctggatctggagttcatatgtacggtgctcggcgccccggatctgggccagagacctcaggggacacgccctggactcgcgaaggcggaagccaaggaacgaccaccgctggcgcgcaatgtcttccggcccggaggccattcgtacggaggcggagccaccaacgcaaacgcccgagcaaaaggtggcactggtcaaacgggagggctgacccagcctaagaaagacgagcctaagaaactcccgccgaggcctggtggccccgagccaaagcccggccatccgcctcaaactcgacaggccacggcccgtacagtgactcccaaaggacagctgcctggaggcaaggccccacccaaagctggttccgtgccctcctccttcttgctcaagaaggcgcgtgaacccggcccaccccgtgagcctaaagagccatttcgtccgccacctattaccccccacgagtatatgctgtcattgtatagaaccctgtccgatgccgaccgcaagggcggcaactcgagcgtgaagctggaggccggtctggccaatacaatcacctccttcattgacaagggccaagatgaccgcggcccagtcgtacgaaagcagcgttacgtcttcgatatctccgccctggaaaaagacggtttattgggtgctgaacttagaatactacgaaaaaagccatccgacacggcgaaaccggccgcccccggtggcggacgcgccgcccagctcaagctatcgtcctgtccgtcgggccgccagccggcctcactcttggatgttcgcagtgtgcccggccttgacggaagcggatgggaggtctttgatatttggaagttgtttagaaattttaagaactccgcgcagctctgtctggagctggaggcctgggagcgtggacgcgctgtagatctgcgcggactgggcttcgaccgcgctgcccgccaggtacacgagaaagccttgttcctagtcttcggacgcaccaagaagagggacctgttcttcaacgaaattaaggccagatccggacaggacgataagacagtttacgagtacctgttcagtcagcgacgcaaacgtcgagctcccctcgccacgcggcaaggcaaacgaccaagtaagaatttgaaggcacgatgtagcaggaaggcccttcacgtgaacttcaaagacatgggttgggacgactggatcattgccccgctggagtacgaagccttccactgcgagggcctttgcgaatttccactgcgaagccacctcgagccgaccaatcacgccgtgattcagacgttaatgaacagcatggatccagaaagcacgccacctacgtgctgtgtgccgacgcgcctttcacccataagcatcttgttcatagatagtgcgaacaacgtcgtctacaagcagtatgaggatatggtggtcgaaagctgcggatgccga

SEQ ID NO: 250321 - DNA, 1503 bp, Artificial Sequence
  Description of Artificial Sequence: Synthetic coding sequence
atgcgcctgccaaaactgctgacttttctgctgtggtatctggcttggctggaccttgagttcatctgtaccgtcctgggcgctccggacctcgggcagcggccgcagggcaccaggccaggtttagccaaggcagaggccaaagaaagaccgccactggctcgaaacgtatttaggccaggagggcacagctacggcggcggcgctaccaacgccaacgccagggccaaagggggcactggacagacagggggcctgacccagcctaagaaggacgagcccaagaagctgccaccccggccaggtggcccagagcctaaaccgggccaccctccccagacccgtcaggcaacggctcggacggtaacccccaaaggccagctcccaggcgggaaggcaccccccaaggcaggttccgtgcccagttcgttcctgttgaagaaggctcgcgagcctgggcctccgcgtgaaccaaaagaacccttcaggccaccccctatcacccctcacgaatatatgttgagcttatataggaccctctccgatgctgaccgcaaggggggcaactccagtgtgaaactcgaggcgggcctagccaataccataacctcattcatcgataaggggcaggacgacaggggtcccgtggtccgaaagcagaggtacgtgttcgacataagcgccctggaaaaagacggtctgttgggtgccgaacttaggatcctccggaagaaaccatcggacaccgccaaacccgccgcacccggcgggggtagggcagcgcagttgaagctgagctcatgcccctcaggacggcagccggctagcctgctggacgtgcgatctgtgcctggcctggacgggagcggatgggaggtttttgatatctggaaactcttccgcaacttcaagaattccgcgcagttgtgcctcgaactagaggcgtgggagcgcggtagagccgtcgacctgagaggccttggctttgatagggcagcccgccaggtgcacgaaaaggctctttttctggtttttgggagaactaaaaaacgggatctgtttttcaatgaaatcaaggcgcgcagtggtcaggatgataaaacggtctacgagtatttgttctcccagaggagaaaacgtcgagcaccccttgccacccgccagggtaagaggcccagtaaaaatctgaaggccagatgttcacgcaaagcgcttcatgtcaatttcaaggacatgggatgggatgattggatcatcgctcctctggaatacgaggccttccattgcgaggggttgtgtgagtttccattaaggagccacttagagcccacgaaccacgcagtgatacaaaccctgatgaactctatggatcccgagtcaacgccacccacatgctgcgttcctactaggttgtccccaataagcatcctctttattgatagcgctaataatgtggtgtacaagcagtacgaagacatggtagtcgagtcatgtggctgcagg

SEQ ID NO: 250322 - DNA, 1503 bp, Artificial Sequence; identical to SEQ ID NO: 250305
  Description of Artificial Sequence: Synthetic coding sequence

SEQ ID NO: 250323 - DNA, 1503 bp, Artificial Sequence
  Description of Artificial Sequence: Synthetic coding sequence
atgcgtctcccgaaactcctgactttcctgctgtggtatctggcctggctggacctggagttcatctgcacagtcctgggggcaccggatctcggacagagacctcagggaaccagacctgggttggcaaaagcggaagcaaaggagcggcctccgttggcccgaaacgtctttaggcctggcggccacagttacggggggggcgccacaaacgccaacgcgagagccaaaggagggactggtcagactggcggtcttacccagccaaaaaaggacgagcctaagaaactcccgccccgtcctggcggacccgagcctaagcctgggcacccacctcagacccgacaggctaccgctcggaccgttacaccaaaagggcagttgccaggcggcaaagcacctccaaaggcaggcagcgttccaagttcgtttctcctgaagaaagctcgcgaacccggacctccccgtgagcccaaggaaccgtttagaccgcctccaataacaccccatgagtacatgctctcactgtatcggaccctgtcagatgcagaccgcaagggcggaaactccagcgtgaaattagaggcgggcctggctaacactattaccagctttatagataaggggcaggatgacaggggcccagttgtccgcaagcagcgatacgtcttcgacatctccgcattggaaaaggatggcctactgggagcagagttacgcattttgcgaaagaagccatcagacacagccaagccggcggcgccaggcggtggccgcgctgcacaactgaagctctcatcttgtccatccggacgccagcccgcctcactgttggacgtgcggtccgtacctggcctggatggatctggctgggaggtcttcgacatctggaaattattccgaaacttcaagaactctgctcagctgtgtcttgagctggaagcatgggagagaggaagggccgtggacctccgaggactgggattcgaccgcgcagcacgacaagtccacgaaaaggctctcttccttgtgtttggccgtactaaaaagagagacttgttctttaatgagataaaggccagatcaggccaggatgataagactgtgtatgaatatctcttttctcagaggcggaaaagacgagctccgctggcaactcggcagggcaagcggccctccaagaatctcaaggctcggtgctcgcggaaggcactccacgtgaacttcaaggatatgggctgggatgattggatcattgcacccttagaatacgaggcatttcattgtgaaggactctgtgagttcccactacgcagccaccttgaacccacaaatcatgcggtcatccagactctgatgaatagtatggacccggagagcaccccccctacatgctgtgtccctactaggctgtcaccaatatccatactcttcatcgattcggccaacaatgtagtgtacaagcaatacgaggacatggtcgtggaaagctgcggatgtcgc

SEQ ID NO: 250324 - DNA, 1503 bp, Artificial Sequence
  Description of Artificial Sequence: Synthetic coding sequence
atgcggctccctaaactgttaacttttctgttatggtatctggcctggttggacctggaattcatctgcacggtccttggcgcccctgatctgggacagaggccacaaggcacgaggcctggcctggccaaagctgaggcaaaggaacgaccgcccttggcccgaaatgtgtttcgcccaggtggacattcgtatggggggggtgctacaaacgcaaacgcacgcgcaaaaggggggacaggccagaccggtggcttgactcagcccaaaaaggatgagcccaaaaagctgccacctagacctggagggccagaacctaagcccgggcaccctccccagacccgccaggctactgcgaggaccgtgacacccaaggggcagttgccggggggcaaggcccccccaaaggctgggtccgtgccctctagcttccttctgaaaaaagcacgggagcctggccctcctagagagcccaaggagccgttccgccccccgcccatcactcctcacgagtacatgctctctctataccgcacactgtccgatgcagaccgcaagggaggcaatagctctgtaaagttagaggctggactcgccaacactatcacttcttttattgacaaaggccaagacgatcgtggtcctgtggtgcggaagcagaggtatgtgtttgatattagcgcgcttgaaaaagacggactcctgggtgctgaacttcggatcttgagaaagaagccttcggacacagctaaacccgccgccccaggagggggtcgtgcagcccagcttaaactgtcaagctgcccgtccgggcggcagcctgcctcactgttagatgtgagatccgttccaggactcgacggatccgggtgggaggtcttcgacatttggaaacttttccgcaattttaagaactctgcccagctctgtctggagctggaggcgtgggagcgcgggagggctgtggatctgaggggcctgggttttgacagggccgcccggcaggtccacgagaaagccttgttcctggtctttgggagaaccaagaaaagagacctcttcttcaatgagattaaagcaagaagcggtcaggacgacaaaaccgtgtacgagtacttgttctctcagagacgcaaacgtcgggcacctctggctacgcgtcagggtaagagaccgtccaaaaacttgaaagcaaggtgtagcaggaaagcccttcatgtgaactttaaggatatggggtgggatgattggatcatcgcgccactcgagtacgaggctttccactgtgaaggactgtgcgaattcccactgagatcccaccttgaacccacaaaccacgccgtgatccagacattgatgaactctatggatccagagtccactccaccaacttgctgtgtgcccacccggctttcacccatttcaatcctgttcatcgatagtgccaataacgtcgtatataagcaatacgaagatatggtggtggaatcatgtggctgcaga

SEQ ID NO: 250325 - DNA, 1503 bp, Artificial Sequence
  Description of Artificial Sequence: Synthetic coding sequence
atgcgtctcccaaagctgctcactttcctgctttggtacctggcgtggctggatcttgagttcatctgtactgtgctcggagcaccggatctcggacaacggccacagggaactcgccctggacttgcaaaggcagaagccaaggagcgccctccgttggctagaaacgtctttcggccgggagggcattcatacggaggcggcgccaccaatgccaatgcgagagccaagggtggcactggccagaccggaggcctcactcaaccgaagaaagatgaacccaagaagctgccacccaggccagggggtcctgaaccaaaacccggacatccgccgcaaacccggcaagcgaccgccagaaccgtgactccgaagggccagctgccaggaggcaaagccccaccgaaagccggctcagtgccatcatcattccttctcaagaaagcgcgtgaaccggggcccccgagggagccaaaggaaccgtttaggcctccgccaatcaccccgcacgaatacatgctcagcctctaccgcacgctctcagacgcagatcgcaagggcggtaacagctccgttaaactggaagcgggactggctaacactatcacctccttcatcgacaagggccaggatgatcgcggtccggtggtgcgcaagcagcgatacgtgtttgacatctcggccttggagaaagacggcctcctcggtgcggaactgaggatactgcggaaaaaaccttcagacactgccaagcctgctgctccggggggaggtcgcgcggcgcagttgaaattgagcagctgcccttcgggcagacagcctgcgtcgcttctcgacgtgcggagcgtgccgggactcgacggctcgggttgggaagtgttcgacatctggaagctgttcaggaacttcaagaattccgctcagctttgtctggagctggaggcatgggagaggggccgggcagtggacctgcgcggcctcggattcgatagagccgccaggcaggttcacgaaaaggcattgttcctcgtgttcggccggaccaaaaaacgcgacctgtttttcaatgagattaaagccaggtcgggacaggacgacaagacggtctatgagtacttgttctcgcaacgccgcaagcgacgcgctccgctggccacgcgacaaggaaagcggccgtcaaagaatctgaaggcccggtgcagccggaaggccctgcacgtgaatttcaaggacatgggctgggacgattggatcattgccccattggagtacgaggcgtttcactgcgagggtctgtgtgaatttccattgcgctcacacctcgaaccgaccaaccatgcagtgatccagaccctcatgaactctatggacccagaatcgactccgcctacgtgctgcgtgccgacccgcttgtcccctatcagcattttgttcatcgattccgcaaacaacgtcgtctacaaacagtacgaagatatggtcgtcgaaagctgcggatgcaga

SEQ ID NO: 250326 - DNA, 1503 bp, Artificial Sequence
  Description of Artificial Sequence: Synthetic coding sequence
atgaggctcccgaagctgctaacatttctgctttggtacttggcttggctagacctggaattcatatgcaccgtactaggggcgccagatcttggacagcggccgcaggggactcgacctggactagcaaaggccgaggctaaggagagacccccactggcccggaatgtgttccgccccggtggccactcttatggggggggggccacaaacgcaaatgcccgcgcgaagggcgggacaggccagacaggaggtctgacgcaaccaaagaaagacgagcccaagaagctgccaccccgtccaggagggcctgagccgaagccaggccatccaccgcagaccaggcaggctacagccaggaccgtgacacccaagggccagctaccgggcggtaaagctccaccaaaggctggcagcgtgccatcttccttccttttgaagaaagccagagagccaggccccccccgcgagcctaaagagcccttcagaccccctccaatcactcctcatgaatacatgttatccctttatcggacactgtccgacgcggatcggaagggggggaactcatcagttaaactcgaagccgggctagccaataccatcacctcttttatagacaaagggcaggatgacaggggcccagtcgtcaggaaacagaggtatgtgtttgacataagcgcattggagaaagatggcctgcttggcgccgagttacgtatcctgagaaagaagccgtctgacactgccaagccagccgcccccggaggggggcgcgcagctcagctgaaactgtcttcttgcccatcaggacgccaaccggccagtctcctcgatgtcagaagcgttccgggcctggacggctccggctgggaggtgttcgacatatggaaactgttcaggaactttaagaattcagctcagctgtgcctggaactcgaggcctgggagaggggcagggccgtggatctccgaggccttggcttcgacagggcagcgcgacaagtacacgaaaaagcgctctttctcgtttttggccgaaccaagaagcgggacctgttttttaacgagatcaaagccaggtctggtcaagatgacaagactgtttatgagtacttatttagccagagaagaaagcgaagagcacctttggccacacggcagggcaagcggccctctaaaaacctcaaagccagatgttcaagaaaggctctccacgtcaacttcaaggacatggggtgggatgactggatcatagcacccctggagtacgaggctttccattgtgagggactttgcgaattccctctcagaagccacctcgagcccacaaaccacgccgtcatccagaccctcatgaacagcatggatccggaatccacaccccccacatgctgcgtgccgacacgactgagtccaatttcaattctgtttatcgattctgccaacaacgttgtgtacaagcaatacgaagacatggtggttgagtcttgcggatgccgg

SEQ ID NO: 250327 - DNA, 1503 bp, Artificial Sequence
  Description of Artificial Sequence: Synthetic coding sequence
atgcgtctgccaaaattgctcaccttcctactctggtacctggcgtggttggaccttgagttcatttgtaccgttcttggggctcccgatttgggccagcggccccagggcacccgcccagggctcgcaaaggcggaggccaaagaaagaccgccactggcccgaaatgtttttcgacccggcggacattcctatggcgggggagccactaatgctaatgcccgggctaaagggggcacgggccagaccggtggcttgacccagccaaagaaagatgagcctaaaaagctgccgccgaggcctggggggcctgaacctaaacctggccacccgccccagacacgccaagctaccgcccgcacagtgacacctaaaggacaacttcccggcgggaaagccccccccaaagctggtagcgtgccgtctagcttcctgctcaaaaaagcaagggaaccagggcccccaagggagccaaaggagcctttccggcctcccccaatcacacctcatgagtacatgctgagcctgtatagaaccctctccgatgcagaccgtaagggtgggaatagttctgttaaattggaagctggcctagcgaacacgatcacctctttcatcgataaaggccaggatgatcgggggcccgtggtcagaaaacagcgatatgtttttgacatttccgctctggaaaaggatgggttgttgggcgctgaactcagaattctccggaaaaagccatccgatacagcaaagccggcggcccctggggggggtagggctgcccaattgaaactcagctcttgtcctagtggaaggcaacccgcatctctgcttgacgttcgcagcgtacctgggttagacgggtccgggtgggaagtttttgacatctggaaacttttccgaaattttaaaaactctgctcagctttgcctggaactggaagcctgggagcgtggtagagccgtggatttaagggggctgggtttcgatcgcgcggcaagacaggtgcatgaaaaggctcttttcctcgtgtttggtcgcaccaagaaaagggatctgttttttaatgaaatcaaagcgcgctccggacaagacgacaagactgtgtacgagtacctcttctcccagcgcaggaagcgccgagcccctttagccacgagacaggggaaacgcccctctaagaacctaaaggcccggtgcagccggaaggcgctccacgtaaacttcaaggacatgggttgggacgactggatcattgcaccactggagtacgaggccttccattgcgaaggattgtgtgagtttccactccggagtcacctggagcccaccaaccacgccgtcatccagaccttgatgaactcaatggatcccgagagtaccccccctacatgttgcgttccgactcgcttgtccccgatctcaatcttgtttattgatagtgctaacaacgtggtgtacaagcagtacgaggacatggtggtggagtcatgcggctgtcga

SEQ ID NO: 250328 - DNA, 1503 bp, Artificial Sequence
  Description of Artificial Sequence: Synthetic coding sequence
atgagattacctaagctgctgacattccttctgtggtacctggcttggctggacttggaatttatttgcactgtcttaggagccccagaccttggtcagagacctcaagggactagacccggcctcgccaaggcagaggcgaaggagagaccacctctcgcaaggaacgtgttcagacctgggggccactcctatgggggcggtgccactaacgccaacgctcgggctaaggggggaacgggtcagactgggggactcacccagcctaagaaggatgagcccaagaagctcccccctcgaccaggggggccagagcctaaacctggtcatccccctcagacaagacaggccacggctagaacggtgacccccaaggggcagttacccggtggaaaggcccccccaaaagcgggctcagtgccaagtagcttcctgctgaagaaagctcgcgagcccggcccaccacgggaaccaaaagagccatttcggcctccacctattacacctcatgagtacatgctcagcctgtaccgtactctgagtgatgctgacaggaagggaggaaactcttcagtcaagctagaggccggccttgcaaacacaataacaagcttcatcgataaaggacaggatgatagagggcccgttgttagaaaacaacgatacgtgtttgacatatccgcactggagaaggatgggctgctgggcgctgagttgaggatacttcggaagaagcctagcgataccgccaaacctgctgccccaggaggaggacgagccgcacagctgaagctgtcctcttgtccaagcggacgccaacccgcttctcttctggacgtccggtctgtacccggccttgatggatctggctgggaggtgtttgatatatggaaactattcagaaattttaaaaactcagcacagttgtgccttgagttggaagcctgggagcgcgggagggctgtggatctccggggattggggtttgatcgggccgcgcgccaggttcacgagaaggcattattcttagttttcggaagaactaagaagcgcgacttgtttttcaacgaaataaaggcgaggtccggacaggacgataaaactgtatacgaatacttattcagccaacggaggaagcggcgcgcccccctcgccacacgacagggaaaacgcccctcaaagaatttgaaggccagatgtagccgaaaagctttgcacgtcaatttcaaggatatggggtgggacgattggattatcgctcccctggaatacgaggccttccattgcgaaggcctttgtgaattcccattgcgatctcatctcgaacccaccaatcacgccgtgattcagaccctcatgaattctatggatccggagagcacccctcctacatgctgcgtacctacacggttgtcacccatatcaattctcttcatcgattctgctaataatgtggtctataagcagtatgaagacatggtggtggaatcttgcggttgccgg

SEQ ID NO: 250329 - DNA, 1503 bp, Artificial Sequence
  Description of Artificial Sequence: Synthetic coding sequence
atgaggttgccaaagctgttgacctttctgctttggtatctcgcgtggctggatctggagttcatatgcactgtgctgggtgcaccagatctcggtcagcggccccagggtactaggccaggtctggcaaaagcagaagccaaggagcgcccccctctggcacgaaatgtttttcgtccaggaggtcattcgtacggaggaggcgccaccaatgcaaatgccagagcaaaaggaggaaccggtcagaccggaggactcacccagcctaagaaggatgaacccaagaagctcccacccagaccaggagggccagaacccaagcccggacatcctcctcagacccggcaggcaaccgctcgaactgtcactcctaagggccagcttcctggaggaaaggcacccccaaaggcaggatccgtcccttcgtcatttctcttgaaaaaggccagagagcctggtcctcctcgagagccaaaggaaccgtttagaccaccacctattacgcctcatgaatacatgctctcactttaccggactctgagcgacgcagatcgaaagggtggaaacagctcagtcaagctggaagcggggctcgcaaataccattaccagcttcattgacaagggtcaggacgaccgaggccctgtggtgaggaagcagcggtacgtctttgacatctcggcccttgaaaaggatggacttctcggggccgagctgcggattcttcggaaaaagccgtcggacactgcaaagccagccgcaccaggtgggggccgcgcagcccaactcaagctgtcaagttgcccgtccggtcgtcaaccagcgtccttgcttgacgtgagatccgtcccagggcttgacgggtcgggttgggaagtatttgacatctggaagctgtttcgcaactttaagaattccgctcagctgtgtctcgaactggaggcatgggagcggggccgcgccgttgatcttaggggcctcgggtttgaccgggcagcacgtcaggtgcatgaaaaagcattgttccttgtgtttggcagaaccaagaagcgtgaccttttcttcaacgaaatcaaggcaagaagcggacaggatgataaaaccgtgtacgagtaccttttctcccaaaggcgtaaacgcagagcgccacttgcaactaggcaagggaaacgcccctcaaagaatctcaaggcgcgctgttcaagaaaggcgctccacgttaactttaaggatatgggttgggatgattggatcattgcccctctggaatacgaggcctttcattgtgaaggattgtgtgaatttcctttgcggtcgcatctggaacctaccaaccatgcagtgatacaaacccttatgaacagcatggaccccgaaagcacccctcctacctgttgcgtgccgactagactgtcaccaatctcgatcctctttattgattcggcgaataacgtcgtctacaaacaatacgaggacatggtcgtcgagtcctgcggttgtaga

SEQ ID NO: 250330 - DNA, 1503 bp, Artificial Sequence
  Description of Artificial Sequence: Synthetic coding sequence
atgcgtctcccaaagctgcttacctttttgctctggtaccttgcctggctggatcttgagttcatttgtactgtgctcggagctccagatcttggccaacgacctcagggtacgaggccaggtttggccaaggccgaggccaaggagcggcctcccctcgcaaggaacgtgttcaggcccggaggccactcatacggtggaggcgccactaacgcaaacgcaagggctaaaggtggcaccggtcagacgggcggtttgacccagcctaagaaggacgagccgaagaaactgccaccccgaccaggcgggcccgaaccaaaacctggacatccccctcagactcgacaggcaaccgcgagaactgtgactccaaagggccagctgcccggtgggaaagccccaccaaaagccggaagcgtgccatccagctttttgctcaagaaggcacgagagccaggaccaccgcgggaacctaaggaaccttttcgcccgcctccaattactccacatgaatacatgctttcgctgtaccgaaccctgtcagacgccgatagaaaaggaggtaattcgtcggtgaagctggaagcgggtcttgcaaataccatcaccagcttcatcgacaagggccaagatgatcggggaccagtcgtccgaaaacaacggtacgtgttcgatatttcagcactggaaaaagatggactccttggagccgagcttcggattctccggaagaagccatcggacactgcaaaacctgccgcccccggcggaggcagagcagcccaactgaaactgtcctcgtgccctagcggtcgccagccggcgagcttgctggatgtgagatcggtgccgggactcgacggaagcggctgggaggtgtttgatatttggaagctcttcagaaacttcaaaaactcggcgcaactttgtctggaactcgaagcatgggaaagaggtcgagcagtagatctgagaggactgggttttgacagagccgccagacaggtccacgaaaaggcactctttctggtgtttgggcgcacgaagaagagggatctgtttttcaatgagataaaagcgagaagcggacaagatgacaaaactgtgtatgaataccttttctcccaaagacggaagcgccgagcccctctggcgactcgccaaggaaagcggccttccaagaatctcaaagctaggtgttcccgaaaggcacttcatgtcaatttcaaggacatgggttgggatgattggattattgccccacttgaatacgaagcgtttcattgcgaggggctctgtgaatttccccttagaagccatctcgagcctaccaaccatgccgtgatccaaacgctgatgaacagcatggacccagaaagcaccccgcctacttgttgtgtgccaaccaggctctctcctattagcattcttttcatcgactcagctaacaacgtcgtgtacaagcaatacgaagatatggtggttgaatcatgtggctgccgc

SEQ ID NO: 250331 - DNA, 1503 bp, Artificial Sequence
  Description of Artificial Sequence: Synthetic coding sequence
atgcggctgcctaagcttttgacgttcttgctttggtatctggcctggctggacctcgaattcatctgtaccgtcctcggagccccggacttgggacagcgcccacagggaactcggcccggacttgcaaaggccgaggcgaaagaacggccacctctcgcccgcaatgtttttcgaccaggtgggcactcatacgggggcggagccaccaatgccaatgccagggcaaagggcggtactggccagacgggagggcttacacaacctaagaaggatgagccaaaaaaattgcctcccaggcccggcggccctgaacccaagcccggacaccccccccaaaccagacaggctacggcccggactgtcacacccaagggacagctgcccggaggtaaagctccacctaaggccggcagtgtcccctctagttttctgcttaagaaggctcgagaacctgggcctcccagggaacccaaggaaccctttcggccaccccctatcactccccatgaatatatgctgtctctctatcggaccctgtccgacgctgataggaagggtgggaactccagtgtcaagctcgaggcgggccttgcaaacaccattacctccttcatagataagggccaggacgatagagggcccgtggtgaggaagcagagatatgtgttcgacataagtgcactggaaaaagacggtctgctgggcgcggagctgcggatcttgcgcaaaaaaccatctgacaccgccaagcctgcagctcctggtgggggaagagctgcccagctgaagctgtcaagctgccctagtggtcgacaacccgccagccttcttgatgttcgatcagtgccaggactggacgggtccggatgggaggtgtttgatatctggaagctttttaggaactttaaaaacagcgcacagttgtgccttgaactggaggcatgggaaagagggagggcggtggatctcaggggtctgggcttcgacagggcggctcggcaggtgcatgaaaaggctttgttcctcgtcttcggcaggaccaagaaacgcgatctgttttttaacgaaataaaggccaggtctggccaggatgacaagacggtctacgagtacctttttagtcagcggaggaaacggagagcaccactggccacacgccaggggaagaggccctcaaagaatctcaaggctcggtgcagcaggaaggctctccatgttaactttaaagacatgggttgggacgattggattatagctcctcttgagtatgaggcatttcactgcgaaggactctgcgagtttcccctgagatcccatttggagcctactaaccacgctgttatacagactcttatgaactccatggaccccgagagtactcctccgacttgttgcgttccgaccagactgtcacccatttcaatcctgtttatagatagcgccaacaatgtggtgtacaagcagtacgaagacatggtggtggagagctgtgggtgtcgc

SEQ ID NO: 250332 - DNA, 1503 bp, Artificial Sequence
  Description of Artificial Sequence: Synthetic coding sequence
atgaggctccctaagctgctaaccttcctcctctggtatttggcttggctggacctggagtttatctgcaccgtgctaggcgcgccggaccttggccaacgacctcagggtacaaggcccgggctggccaaggcggaagccaaggagaggccgcctttagcaaggaacgtttttagaccaggaggtcactcctacggcggcggggcgacgaatgccaatgcgagggccaaggggggcacagggcagacgggcggactgacccagccgaagaaggacgagcccaaaaaacttccacctaggcctggaggcccagaacctaagcctgggcaccctccacagacgagacaggcaacggcccgtaccgtgacccctaaaggccagctcccgggaggaaaggcccctcctaaggccggctcagtgccttctagctttctgctgaaaaaggcacgagagcctgggccaccccgggaacccaaagaacctttcagaccgccacctatcaccccgcacgagtacatgctgtcactgtatagaacactttctgatgcagaccgcaaggggggcaattcatcagtgaagctggaggccgggctggccaatacaatcacgtctttcatagataagggtcaagatgaccggggccccgtggtccgaaagcagaggtatgtgttcgatattagtgccttggaaaaagatggcctgctcggagccgagttacgtatcctgagaaaaaaacctagcgatactgctaaaccggccgccccaggaggtggccgtgccgcccagctcaagctgagcagctgtcctagcggtagacaacccgcctcattgcttgatgtaaggagcgtccctggcctggacggctccgggtgggaagtgttcgatatttggaagctctttcgaaattttaaaaactcggcgcaactgtgcttggagctcgaggcatgggagcgtggcagagccgttgacctgagaggacttggctttgatcgggcagcaagacaggtgcacgaaaaggctcttttcctagtgttcggcagaactaagaagcgcgatctctttttcaacgaaatcaaagcccgtagcggacaggatgataagaccgtctatgagtacctgttctcacaacgcaggaaacggagggcccctttggcaactagacaggggaaaagacctagcaagaatctgaaggctcggtgctctcgcaaagccctgcacgttaactttaaggatatgggttgggatgactggatcatcgcgccactagagtatgaggcatttcactgtgaggggctgtgcgaatttcctctgcgtagccatcttgaaccaaccaaccacgccgtaatacagactttgatgaactctatggatcctgaatccactcccccaacttgctgcgttcccacccggctcagccctatctctatcctctttatcgatagtgctaataacgtcgtgtataaacagtatgaagacatggtggtcgaatcatgcggctgccgc

SEQ ID NO: 250333 - DNA, 1503 bp, Artificial Sequence
  Description of Artificial Sequence: Synthetic coding sequence
atgaggcttcctaagctcctcacctttctgctttggtaccttgcatggcttgacctggagtttatctgtacggtcctgggcgcgccggacctgggacagcggccacaaggtactcggccagggttggctaaggcagaggccaaggaacgaccacccctcgcgaggaatgtgtttaggccaggagggcactcctacggaggcggcgctaccaatgcaaacgccagggcaaaaggaggaactggtcagacgggtggactcactcaaccgaaaaaggatgaacccaaaaagctgccaccacggcccgggggaccagaacctaagcctggtcatccaccccaaacccgccaagcgactgcaaggactgtgacgccgaaggggcaactccctggtggaaaggcaccccctaaagcaggaagcgtccctagctccttcctgctgaagaaggcgcgagaaccgggacccccacgcgaacctaaggagccattcaggcctccacctattactcctcatgagtacatgttgtcactttacagaacgctttcagacgcagatcgaaagggaggtaattcgtcagtcaagctggaagccggtctggcaaacactattacttccttcatcgataaaggtcaagacgatagaggcccagtggtgcggaaacagagatacgtctttgacatttccgctcttgaaaaggacggattgcttggagcagaactgagaatactgcggaaaaaaccgtcggatactgcaaagcctgccgcacctggtggaggacgggcagcccaactgaagctctcctcctgtcctagcggaaggcagcctgcctcgctcctggacgttaggtctgtgcccggtctggatggatcgggatgggaagtgttcgacatttggaaactgttccgaaactttaagaactccgctcaactctgcctcgagctggaggcatgggaaagagggagagctgtggatcttaggggccttggttttgatagagccgcacggcaggtccatgagaaagcactgtttttggtgttcggaagaaccaagaaacgggatcttttcttcaacgaaatcaaggcacggtcaggtcaggatgataagaccgtgtacgaataccttttctctcagagaagaaagaggcgagctccactggcaacccgccaaggcaagcgaccttccaagaacctcaaagccagatgtagccgaaaggcactgcacgtgaactttaaggatatgggttgggatgattggattatcgccccactggagtatgaggctttccattgtgaagggctctgtgaatttcctcttcggtcccatctggaacctaccaaccacgcggtgatccaaacccttatgaattcgatggaccctgagtcgactccccctacttgttgtgtcccgacccgcctgtcaccaatttctattctgtttatagactcggccaacaatgtggtgtataagcagtacgaagatatggtcgtggagtcctgcggttgtaga

SEQ ID NO: 250334 - DNA, 1503 bp, Artificial Sequence
  Description of Artificial Sequence: Synthetic coding sequence
atgcggctgccaaagctgctcactttcctcctgtggtacttggcttggctcgacctggagttcatctgcaccgtgcttggagctccagatcttggccagcgccctcaaggaactagaccaggcctcgcaaaagccgaagccaaagaacggcccccacttgcgcggaacgtgtttcggcctggaggacatagctacggaggcggtgctaccaacgccaacgctagagccaaaggaggaaccgggcaaactggaggactgacccaacctaagaaggacgagccgaagaagttgcctccgaggccaggagggccggaaccgaagccgggccatccgccacagacccgccaagccactgcaagaaccgtgactccgaagggtcaactccccggaggcaaagctcctccgaaggccgggtcagtcccgtcatccttcctgctgaagaaggcccgcgagccaggacctccacgggaaccgaaggagccgttccgcccaccgccaatcactccgcacgagtacatgctctcactctaccgcaccctctcggacgcagatcggaaaggaggcaacagctctgtgaagctcgaggcgggactcgcaaataccatcacctcgtttatcgacaaaggtcaagatgatcgcggcccggtggtcagaaagcagagatacgtgttcgatatcagcgccctggaaaaagacggtctgctgggggccgaactgaggatcttgcggaagaagccttccgacaccgctaagcctgctgccccaggaggaggacgggctgcccagctgaagctgtcctcgtgcccgtcaggacggcagccggcatcccttctcgatgtgcgctcggtgccgggactggacggctccggatgggaagtgttcgacatctggaaactcttccggaactttaagaactcagcacagctctgcctggaacttgaagcgtgggagagaggccgggcggtggacctccgcgggctgggttttgacagagcagcccgccaagtgcacgaaaaagcactgtttctggtgtttggacgtactaaaaagagggatctgttcttcaacgaaatcaaagcccggtctggacaagatgacaagaccgtctacgaatacctcttctctcagaggagaaaacggcgggctccccttgcgacccgccaaggaaagaggccttcgaaaaatctgaaagcaagatgcagcaggaaggccctgcatgtgaactttaaggacatgggatgggatgactggatcatcgcaccgctcgagtacgaagccttccactgtgagggactgtgcgaattcccgcttcgctcacatcttgaacccactaaccacgcggtcattcagaccctgatgaatagcatggaccctgagtcgaccccgccgacctgctgtgtgccaacccgcctgtctccaatctcgatcctcttcatcgactccgctaacaatgtcgtctacaagcagtacgaggacatggtcgtggagtcctgcggctgtagg

SEQ ID NO: 250335 - DNA, 1503 bp, Artificial Sequence
  Description of Artificial Sequence: Synthetic coding sequence
atgcgcctgccgaagctgctcacctttctgctctggtacctggcatggctggatctggaattcatctgcaccgtgctgggagctccagacctgggtcaaagacctcagggaactcgcccgggactcgcaaaggctgaggcgaaagagcgcccgccgctggcgagaaacgtctttcgcccggggggccacagttacggaggcggtgccaccaacgcaaacgcccgagccaagggagggactggccagactgggggacttactcagccgaagaaagacgaaccaaagaaactgccaccgcgcccagggggcccggaaccaaagccaggacatccgccgcagacccgccaggccaccgcgcggactgtgaccccaaaaggccagctgccggggggaaaggccccaccaaaggccgggtcggtgccttcctcctttctgctgaagaaggcccgcgagccggggccgccgcgcgaaccgaaggaaccgttccggcctcctccaatcaccccgcatgagtacatgctctcactgtatcgcactctgtctgacgcagaccggaaaggcggaaactcgtccgtgaagctggaagcgggcctggccaacaccatcactagctttatcgataagggccaggacgaccggggccctgtggtgagaaaacagcgctacgtctttgatatcagcgccttggaaaaggacggtctgctcggtgcagagctgcgtatactcagaaaaaagccaagcgacaccgccaagcctgccgcgccgggtggaggaagagctgctcaactcaagctctcgtcctgtccttcgggacgccagccggcttccctgctcgacgtgagatcggttccgggactggacggctcggggtgggaagtctttgacatctggaaattgtttaggaactttaagaattcagcccagctgtgcctcgagctggaggcttgggaaaggggacgcgccgtggacttgcgggggttgggatttgatcgcgctgcgcgccaagtccacgagaaggcgctgttcctcgttttcggtcggacgaaaaaacgggacctgttcttcaacgagatcaaggcgcggagcggacaagatgacaaaacggtgtacgaatacctcttctcccaacgccggaagcgcagagcccccttggcaacgcgccagggaaaacggccgtcgaagaatcttaaggcacgatgcagccgcaaggcattgcatgtgaacttcaaggacatgggctgggacgactggattatcgccccgctggaatacgaggcttttcactgcgagggactctgtgagtttcccctccgctcgcacctggagccgaccaaccatgcagtcatccaaactctgatgaattcaatggacccggaatcgaccccgccgacctgctgcgtgccaactcggctgtccccgatctcgatccttttcatcgactcagcgaacaacgtggtgtacaagcagtacgaagatatggtggtcgaatcttgcggatgtcgc

SEQ ID NO: 250336 - DNA, 1503 bp, Artificial Sequence
  Description of Artificial Sequence: Synthetic coding sequence
atgcgcctgcccaagctcctcactttcctgctgtggtacctcgcttggctggacttggagttcatctgcacggtgctcggcgcacccgacctgggtcagcggccacagggaaccagacccggacttgcaaaagccgaggccaaggaaagaccgcccctggccagaaatgtctttcgtccgggaggacacagctacggtggcggcgctactaacgcgaacgcccgggctaagggagggaccggacagaccggcggcttgactcagcctaagaaggacgagccaaagaaacttccgccgcggcccggaggacccgagcctaagccaggacaccctccgcaaacccgccaagcaactgccagaactgtcaccccaaaaggacagctcccgggaggaaaggctccacccaaggccggttccgtgccatcgtcctttttgctgaagaaggcccgggaacccggcccgccacgagaacccaaagaacctttcaggccacccccaatcaccccccacgagtacatgctgtcactgtaccgcaccctgtccgacgccgacaggaagggaggtaacagctcggttaagttggaggctggcctggctaatacgatcacctccttcatcgacaaaggacaagacgataggggacctgtggtgcgtaagcagcgctacgtgttcgatatttcggcccttgaaaaggacggactcctgggggcggaactgcggatcctgagaaagaagccttcggataccgcgaaacctgcggcgccaggaggcggtagagccgcccaactgaaactttcgagctgcccgtcgggacgccagccggcgtccctgctcgacgtccgctcggtgccgggactcgatggttccggctgggaggtgttcgacatctggaagctgttccgcaatttcaaaaactcggcccagctctgtttggaacttgaggcttgggagcggggacgcgccgtagatctcaggggcctgggattcgaccgggcggcccggcaagtccacgagaaagctctgttcctggtgttcggccggactaagaagcgcgacctctttttcaacgaaatcaaagcccggtccggacaagatgataagacggtgtacgaatacctcttttcacagcgccgaaagagaagggcgccgctggccacccggcagggaaaacggccgtcaaagaacctcaaggcccggtgctcgaggaaggccctccacgttaacttcaaggacatgggctgggatgattggatcatcgccccccttgaatacgaggccttccactgcgaggggctgtgcgaattcccgctgcggtcccacctggaaccaaccaaccacgcggtgattcagactctcatgaactcaatggacccggaatcgactcctcctacctgttgcgtgccaactcggctgtcgcctatttcgattctctttattgactctgcgaacaacgtggtgtacaagcagtacgaggacatggtcgtcgaaagctgtgggtgccgg

SEQ ID NO: 250337 - DNA, 1503 bp, Artificial Sequence
  Description of Artificial Sequence: Synthetic coding sequence
atgcgcttgcccaagcttctgaccttccttctgtggtatctcgcatggcttgatcttgagttcatttgcactgttctgggtgcacccgatttaggccagaggccccagggcactaggcccgggttggcgaaggctgaggcaaaagagcgcccacccttagctagaaatgtgttccggcctggcgggcatagctatggtggcggtgctactaatgccaatgccagagctaaggggggcactgggcagaccggtgggttaacacagcccaagaaagacgaacctaagaagcttcccccacgtcccggagggccagagccaaagccaggacacccaccgcagacccggcaggcaaccgcccggactgtaactcctaaaggacaattgcctggggggaaagcccctcccaaggccgggtccgtgccctcttcctttttgctcaagaaggcccgtgagcccgggccaccacgcgagccaaaggagcccttcagacccccccccatcaccccacatgagtatatgctttcactgtaccggactttatccgacgccgacagaaaaggaggcaacagctccgtgaagttggaggcagggctcgccaacaccattactagtttcatcgataaaggccaggacgatagaggcccggtagtccggaagcagagatatgtgttcgacatctccgccctcgaaaaggatgggctgctcggagcagaactccgcatacttaggaagaaaccaagcgacacagctaagcccgctgccccggggggaggtagggcggctcagctgaagctttcttcatgtccaagcggaagacaacccgcgtccctgctggatgtgcgcagcgtgcccggccttgatgggtctggctgggaggtgtttgacatctggaagctgttccgaaatttcaagaactccgcacagctgtgcctcgagctggaggcgtgggaacgaggacgcgccgtagatctgagggggttgggtttcgatcgagcagctagacaggtgcacgagaaggccctttttcttgtgtttggaaggacaaagaagcgtgaccttttctttaatgagatcaaagctcgaagcggccaagacgacaagactgtttacgaatacctgttcagccagcggagaaagcggcgagctcctctcgcaactcggcagggtaaaaggccaagcaaaaatctgaaggctcggtgttcacggaaggcgttgcatgtgaatttcaaagatatgggttgggacgactggatcattgcacccctggagtatgaggcttttcattgtgagggcctgtgtgaatttccactccgatcccacttggagccaaccaaccatgcagtgatccagacactgatgaattcaatggatccagagtccactcctcctacatgttgtgtcccgaccaggttgagtccaatttccatcctgtttatcgatagtgccaacaacgtggtgtataaacagtacgaagacatggtagttgaaagttgtggctgcagg

SEQ ID NO: 250338 - DNA, 1503 bp, Artificial Sequence
  Description of Artificial Sequence: Synthetic coding sequence
atgcgtctcccaaagttgctgactttcctgctttggtacctcgcctggctggacctggagttcatttgtactgtactcggcgctccagacctgggccagagaccccaaggcacccgacccggtctcgctaaggcggaggctaaagaaagacctcctctcgcacggaatgtgtttcgtcccggtggccattcctatggcggaggcgccacaaatgcgaatgcccgtgccaagggggggaccggccagaccggcggcctcacacagcccaaaaaagatgaacctaaaaagctgcccccaagaccggggggtcccgagcccaagcccgggcatccaccccagactcgccaggccaccgcccgaacagtcaccccgaagggacagctccccggtgggaaggctccacccaaggccggatcggtccccagcagctttcttctgaagaaagcccgggaaccaggcccccccagggagccaaaagaaccattccgcccccctcccatcacacctcacgagtatatgctctcactgtatcgaaccctgagcgacgccgaccgtaagggcgggaacagctccgttaagttggaagctgggctggccaacaccattacctcattcatcgacaaaggacaggatgaccggggccccgttgtccgcaagcagcgatacgtgttcgatatcagtgcacttgagaaagacggcttgctcggtgccgaactgcgcatactgagaaagaagccaagcgacacagctaaacctgcagcaccaggcggcgggcgggctgcccagctgaaactctctagctgtccctccggaaggcagcccgcatccctcctggatgtgcgctctgttccagggctggacggaagcggatgggaggtctttgacatttggaagctgttccgcaacttcaagaacagtgcgcagctttgccttgagctcgaggcttgggagcggggcagagcagtcgacctgcgcgggctgggctttgaccgagctgccagacaggtgcatgagaaagcgctcttcctggtgttcggacggacaaagaagcgggacctgtttttcaatgagataaaagcccgctcagggcaggatgataagacggtgtacgagtacctcttctcccagagacgaaaaagacgtgctcccctggccacccgccaaggaaagagaccgtcaaagaacctgaaggccaggtgtagtagaaaggcactccacgtcaatttcaaggacatgggctgggatgattggatcatcgcccctttggaatacgaagcctttcactgcgagggattatgcgaattcccgcttaggagtcacctggagcctactaatcatgccgtaatccagaccctgatgaactccatggaccccgagtccacgccacccacatgttgcgttcctactcggctgtcaccaatatctatcctcttcatcgactccgccaataatgtcgtttacaagcagtacgaggacatggtggtcgagtcgtgcggctgccga

SEQ ID NO: 250339 - DNA, 1503 bp, Artificial Sequence
  Description of Artificial Sequence: Synthetic coding sequence
atgcggctgccgaaactgttgaccttcctgctgtggtatctcgcctggcttgatctggagttcatctgtactgtgctcggcgccccagacttgggacagcgaccacaaggcactcgcccgggactggcaaaggcggaggcaaaagaacggcctcccctcgcaaggaatgtgttccgtcccgggggtcattcatacggaggaggcgcaaccaatgcaaacgcccgggccaagggcggaaccggtcagaccggtggactgacgcagccgaagaaggacgaaccaaaaaagctgccaccgcgcccgggaggaccagagccaaagccaggacatccgccccagacccggcaagctacggcgcggactgtcacgccgaagggacagctgccgggtgggaaggctccgccaaaagctggcagtgtgccttccagctttctcctcaagaaagcgagagagccgggaccgccccgcgaaccgaaagaaccattccgccctccgcctatcactccgcacgagtacatgctttcgctttatcgcactctctccgacgccgatcggaagggcgggaactcttctgttaagctcgaagccggtctggcaaacaccattacttccttcattgataagggacaagatgaccgcgggccggtcgtgcggaagcagcgctacgtgtttgacatctccgcgctggagaaggacggcctgctgggagctgaactgcgcatcctgcgcaagaagccttcggacaccgcaaagccggctgcaccgggaggcggacgggctgcccagctcaaactgtcgtcgtgtccatccggtcggcagcctgccagcctcctcgacgttagatcggtgcctgggctcgacggttcaggctgggaagtgttcgatatctggaaacttttcagaaacttcaagaattccgctcagctctgcttggaactcgaggcctgggaaagaggccgagccgtcgatctgaggggactgggatttgacagggcggcgcgccaagtacacgagaaggcattgtttctggtgttcggacggaccaaaaagcgcgatctctttttcaatgagatcaaggccaggagcggacaggacgacaaaaccgtgtacgagtacctcttctcgcagcgccgtaagaggagagccccgttggctactcgtcaaggaaagcggccttccaagaatttgaaggcgcgttgttcacggaaggccctgcatgttaacttcaaggatatggggtgggacgattggattatcgcaccgctggaatatgaagcgttccactgcgaagggctgtgcgagtttccacttcgctcgcacctcgaacccactaaccatgccgtaatacagacgcttatgaacagcatggacccagagtcaacccctccgacctgctgcgtgcccaccaggttgtccccaatcagcatcctgttcatcgattccgccaacaacgtggtgtacaaacaatacgaggacatggtcgtggaaagctgcggctgccgg

SEQ ID NO: 250340 - DNA, 1503 bp, Artificial Sequence
  Description of Artificial Sequence: Synthetic coding sequence
atgaggctccccaagctgctgaccttcctgttgtggtacctggcgtggttggacctggagttcatctgcaccgtgctgggtgcgccggacctgggacaacgccctcaaggaacccgcccaggactggccaaggccgaggccaaggaacgccctccactggcacggaacgtattcagaccgggcggacactcctacggcggaggcgccactaatgctaacgccagggcgaaaggcgggactggacagacgggaggcctgacccagccgaagaaggacgagccaaagaagctgcctccacgcccaggcggaccggaaccaaagccaggccatccaccccaaacccgccaagcaactgcccgcacggtgactccgaagggccagctgccaggtggaaaagccccgccaaaggccggctcagtgccctcatcattcctcctgaagaaagcccgcgagccgggcccgccgcgcgaaccgaaagaaccgtttcgccctccaccaatcactccacatgaatacatgttgtcgctctaccgcaccctctccgacgccgaccgcaagggagggaattcctccgtgaagctggaagctggacttgctaacaccatcactagcttcatcgacaagggccaggatgatagaggcccggtggtgaggaagcagagatacgttttcgatatctcagcgttggaaaaggatggacttctgggggccgagctccgcattctccgcaagaagccgtcggacaccgcaaagccagcggcccccggcggagggcgcgccgcccagctcaagctctcgtcatgcccatcagggcggcagcctgcctccctcctggacgtccgatcggtgcccggattggacggctccggatgggaagtgtttgacatctggaaattgttcagaaacttcaagaattcagcacaactgtgtctggaactggaggcttgggaaaggggacgcgcggtcgacctccggggactgggcttcgatcgggcagcccggcaggtccacgaaaaggccctttttctggtgtttggacggaccaagaaacgggacctcttcttcaacgagatcaaggcacggtcaggacaggatgacaagactgtgtacgagtacctgttttcgcagcggaggaaacgcagagcgccgctggcgactcgccagggcaagaggccgtcaaagaatctgaaggcacgctgtagccggaaggcgttgcacgtcaatttcaaggacatgggctgggatgactggattattgctccgctggaatacgaagcgttccactgtgaaggcttgtgcgaattcccgctgcgctcccacttggagccgactaaccatgctgtcatccagaccctcatgaattcgatggatccagaatcgactccgcccacttgctgcgtgcctacccggctgagcccgatttcgatcctcttcatcgactccgcgaataacgtggtgtataaacaatacgaagatatggttgtggaatcctgcggatgcaga

SEQ ID NO: 250341 - DNA, 1503 bp, Artificial Sequence
  Description of Artificial Sequence: Synthetic coding sequence
atgagacttccgaaattgctgacctttttgctttggtaccttgcttggcttgatctggagttcatctgcaccgtccttggggcccccgacttgggtcaaaggcctcagggaacccggcccggacttgcaaaagcagaagcaaaggaaagacccccactggcacgaaatgtgtttcggcctggtggtcattcctacggcggcggggcgactaacgccaacgccagagccaagggagggaccggccagactggtgggctgacccagccaaagaaggacgaacccaagaagttgccacccagacccggaggtccagaaccaaagccaggacatccccctcagacccgacaggcaaccgcaagaaccgtcactcctaagggccaactcccaggagggaaggcacctccaaaggctgggtcggtcccttcctccttcctcctgaagaaagccagagaaccaggacctccacgggagcccaaggaacctttccgccccccacctattactccacacgagtacatgctgagcctgtaccgcaccctgtccgatgcagatagaaaaggtggtaattcgtcggtgaaactggaagctggtctggcaaacactatcacttcgttcattgacaagggacaagatgataggggacctgtggtcagaaagcagagatacgtgttcgatataagcgcgctggagaaggatgggctgctgggagctgagctgcggatcctgagaaagaaaccatccgatacggccaagcctgctgcaccaggcggagggagagcggcacaacttaaactgtcctcctgtccttccgggcggcagccagcgtcgctcctcgatgtgagaagcgtgcctggacttgacgggtccggatgggaagtgtttgatatatggaaactttttcgcaacttcaagaattcggcacaactgtgcctggaactggaggcgtgggagagagggcgcgctgtcgatcttagaggactgggctttgatcgtgcagcaagacaagtccatgaaaaggccctctttctggtgtttggtcgtactaagaaaagagatctgtttttcaacgaaatcaaagcacgttcaggccaggacgataagacggtgtatgaataccttttttcgcaaagaaggaaacgtagggcaccccttgcaacccggcaaggcaagcgcccatctaagaacctgaaggcacggtgttcaagaaaagcgctgcacgtgaactttaaggacatgggttgggatgactggatcattgcacctctcgaatacgaagcatttcattgtgaaggtttgtgtgaattccctttgagatcgcatctcgaacccaccaaccatgcagtgatccagaccctgatgaactcgatggatcctgagtcgaccccgccgacctgttgcgtgcctactcgactgagccctatttcaattcttttcatcgattcggcgaataatgtggtgtacaagcagtacgaagatatggtggtcgagtcgtgcgggtgtagg

SEQ ID NO: 250342 - DNA, 1503 bp, Artificial Sequence
  Description of Artificial Sequence: Synthetic coding sequence
atgcgactacccaaactactgactttccttctctggtaccttgcttggttagatctcgagttcatctgtaccgtccttggtgctccagacctgggccaacgacctcaagggacgaggcctggtttggcgaaggccgaggccaaggaacggccgccgctcgcgcgcaatgtatttcgccccggtggtcacagttacgggggcggcgcaaccaacgcgaatgcaagagcaaagggcggaacaggtcaaactggcggacttactcagcccaagaaagacgagcccaagaagctacccccgagacccggaggtcccgagccgaagccgggccatcctcctcaaactcgccaagcgaccgcccgcacggttacacctaagggacaactccccggcgggaaggctccccccaaagcaggtagcgtgccttcttcgttcctcctgaagaaagcacgcgaaccaggcccgccgcgcgaacccaaggagccctttcggccgcccccgattactccccacgaatatatgctaagcctctatcgtacgctctccgatgcggacaggaagggaggcaactcttctgttaaacttgaggcaggacttgccaataccatcacgagtttcatcgacaagggccaagatgatcgaggccctgtcgtccggaagcagcgctatgtttttgacatatcagctttggagaaggacggtctcctcggcgccgaactcagaatattacgcaaaaagccatcggataccgcgaaacccgctgcacctggagggggccgtgctgcacaactcaagctaagttcttgcccgtcggggcggcagcctgcatcgcttctagatgtcagatctgttccggggctagatgggagcggttgggaagttttcgacatctggaagttgttccgtaattttaagaattctgctcaactttgcctggaattggaagcgtgggagagggggagggccgtcgatctcagaggtctgggattcgatcgagcggcgcgacaggttcatgagaaggctctttttctggtattcggtcggactaagaaaagggacctcttctttaacgagataaaggcccgctctggtcaggatgataagactgtgtatgagtatctgttctcccagcggagaaagagacgagcaccactcgcaacacgtcagggtaaaagaccgagtaagaatctaaaagctcggtgctctcgaaaagccttgcacgttaacttcaaggatatgggatgggacgactggataatcgcaccgctcgaatacgaggctttccactgtgaaggcctttgtgaattccccttgcgttctcacctagaaccgaccaatcacgcagttatccagacactaatgaactccatggacccggagagcactccgccaacatgttgtgtccctacaaggttatctccaatatccatactcttcattgattctgccaataacgtggtctacaaacaatacgaggacatggtcgtcgaatcatgcggctgccga

SEQ ID NO: 250343 - DNA, 1503 bp, Artificial Sequence
  Description of Artificial Sequence: Synthetic coding sequence
atgcgattaccgaaattattaacgtttttattatggtatttagcgtggttagatctagaatttatatgtacggttttaggtgcgccggatctaggtcaacgtccgcaaggtacgcgaccgggtctagcgaaagcggaagcgaaagaacgtccgccgctagcgcgtaatgtttttcgtccgggtggtcattcgtatggtggtggtgcgacgaatgcgaatgcgcgtgcgaaaggtggtacgggtcaaacgggtggtttaacgcaaccgaaaaaagatgaaccgaaaaaattaccgccgcgtccgggtggtccggaaccgaaaccgggtcatccgccgcaaacgcgtcaagcgacggcgcgtacggtaacgccgaaaggtcaactaccgggtggtaaagcgccgccgaaagcgggttcggttccgtcgtcgtttctactaaaaaaagcgcgagaaccgggtccgccgcgagaaccgaaagaaccgtttcgaccgccgccgataacgccgcatgaatatatgttatcgttatatcgtacgttatcggatgcggatcgaaaaggtggtaattcgtcggtaaaattagaagcgggtttagcgaatacgataacgtcgtttatagataaaggtcaagatgatcgaggtccggtagtacgaaaacaacgttatgtatttgatatatcggcgctagaaaaagatggtttactaggtgcggaactacgtatattacgaaaaaaaccgtcggatacggcgaaaccggcggcgccgggtggtggtcgtgcggcgcaactaaaactatcgtcgtgtccgtcgggtcgacaaccggcgtcgttattagatgttcgttcggttccgggtttagatggttcgggttgggaagtatttgatatatggaaattatttcgaaattttaaaaattcggcgcaactatgtttagaattagaagcgtgggaacgaggtcgagcggttgatttacgtggtctaggttttgatcgtgcggcgcgtcaagttcatgaaaaagcgttatttttagtatttggtcgtacgaaaaaacgtgatctattttttaatgaaataaaagcgcgttcgggtcaagatgataaaacggtatatgaatatttattttcgcaacgtcgtaaacgacgagcgccgctagcgacgcgtcaaggtaaacgtccgtcgaaaaatctaaaagcgcgatgttcgcgaaaagcgctacatgtaaattttaaagatatgggttgggatgattggataatagcgccgctagaatatgaagcgtttcattgtgaaggtctatgtgaatttccgttacgttcgcatttagaaccgacgaatcatgcggtaatacaaacgttaatgaattcgatggatccggaatcgacgccgccgacgtgttgtgttccgacgcgtttatcgccgatatcgatactatttatagattcggcgaataatgtagtttataaacaatatgaagatatggttgtagaatcgtgtggttgtcgt

SEQ ID NO: 250344 - DNA, 1503 bp, Artificial Sequence
  Description of Artificial Sequence: Synthetic coding sequence
atgcggctgccaaagctcctcacttttcttctgtggtacctggcttggctcgatttggaatttatatgcaccgtgctgggagctccagatctgggacagcggccccagggcacgagacctggactcgccaaagcagaggcaaaggagaggcctccactggctcgcaacgtgtttaggccgggggggcactcctacggcggtggcgcgaccaatgctaatgcacgcgctaaggggggaactggccagaccggtggactgacacagccaaagaaggacgagcccaagaagctccccccaaggccaggtggacccgagccaaagcccggccaccctccccagacaaggcaggccactgctcggacagtgacaccaaagggacaactccccggcggaaaagctccccctaaggctggaagcgtaccctctagcttcttgctgaaaaaagcccgagagcccggcccccctcgcgaacccaaggaaccctttcgtcctcctcctattaccccccatgaatacatgctctcgctgtatcgcacactatccgatgccgatcggaaaggggggaattccagtgtgaaactggaagcaggcctcgctaacaccatcaccagttttatcgacaaaggccaggacgatcggggccccgtggtgcgaaaacaacgctacgtgttcgacatctctgctctggagaaggatggcttactgggagcagagttgagaatcctcagaaagaaaccttctgatactgcaaagcccgccgccccaggcggggggcgtgctgcacaactgaaattatcatcttgccctagcggccgacagcccgcctcactattagatgtgcggagcgtgcctggacttgacgggagtggctgggaggtcttcgacatctggaaactttttagaaactttaagaacagcgcgcagctgtgtttggagctagaggcttgggaacgaggaagagctgtcgacttacgcggactgggtttcgatagagccgcacgccaagtgcacgaaaaagccctgttcttggtgtttggccggacgaagaaaagagacctcttctttaacgagattaaagctagaagcggacaagatgataagaccgtgtatgagtatctattctcacagagacggaagagacgggcacctctggccacaaggcagggaaaacgtccgagtaagaatctgaaagctcgctgtagcaggaaagctctgcacgtaaattttaaggacatgggatgggacgactggatcatcgctccgctggaatacgaggccttccattgtgagggcctatgtgagttcccactccggtcgcacctagagccaacaaaccatgccgtgattcagactcttatgaattccatggatcccgagtccacacctcctacttgttgtgttcctaccagattgtcccccatttccatcttgtttatcgactccgctaataacgttgtttacaagcagtacgaagatatggtggtcgagtcttgtggctgcaga

SEQ ID NO: 250345 - DNA, 1503 bp, Artificial Sequence
  Description of Artificial Sequence: Synthetic coding sequence
atgcggctgccgaagctcctgactttccttctgtggtacctcgcctggctggatctggagtttatctgcacggtgcttggtgcgcccgaccttggccagaggccacagggtacccgcccgggccttgccaaggctgaagctaaggagaggccgccgctggcccgcaatgtgttcagaccaggaggacactcctacggaggaggtgcgactaacgccaatgcccgcgctaaggggggaactgggcaaaccggaggactcactcaaccaaagaaggacgaaccaaagaagctgccgccccgccccgggggaccggaaccgaagccgggacaccctccgcagactaggcaggccaccgcccgcaccgtgacccctaagggtcaactcccggggggaaaagctcctcctaaggcggggtcggtgccttcctcattccttctgaaaaaggcccgcgaaccgggacctccccgcgaaccaaaagaacccttcagacccccaccgattactccgcacgaatacatgctgtcgttgtatcgcactctgtccgatgcagatagaaaaggcggaaattctagcgtgaaactggaagcgggactcgctaataccataacttcctttattgataagggacaagacgataggggtcccgtggtccggaaacaacgctacgtgttcgacatctcggccctcgaaaaggacggcctgctgggagcggaattgcggatcctgagaaaaaagccgtctgataccgccaagccggcggcaccaggaggtggtcgggccgcccagttgaagctctcgtcgtgtccgtcgggcaggcagccagcgtcgctgctcgatgtgcgcagcgtcccggggctggacggctcaggttgggaagtgttcgatatctggaaactgtttaggaatttcaagaactcagctcagctgtgcctcgagctcgaagcatgggaaaggggacgcgccgtggacctgcggggattggggttcgacagagccgcgcgacaggtgcacgaaaaagctctcttcctcgtattcgggcggaccaaaaagcgggatttgttcttcaacgagatcaaagcgcgctcaggtcaggacgacaagaccgtgtacgaatacctgtttagccaaagacgcaagaggagagctccgctggctactaggcagggcaagcggccttcgaaaaatcttaaggcccggtgcagccggaaggccctgcacgtcaatttcaaggacatgggctgggacgattggatcatcgccccacttgagtacgaggccttccactgcgagggactgtgcgaattcccgctgcgatcacacctggagccaaccaatcatgcggttatccagactctgatgaactccatggaccctgaatcaactccaccgacctgctgcgtgccgacccggctgagcccgatctccattctgttcatcgacagtgccaacaatgtggtctacaagcagtacgaggacatggtggtggagtcgtgcggttgccgg

SEQ ID NO: 250346 - DNA, 1503 bp, Artificial Sequence
  Description of Artificial Sequence: Synthetic coding sequence
atgcgcctgcctaagctgctcactttcctgttgtggtacttggcttggttggaccttgagttcatctgcaccgtgctcggcgcccccgacctcggacagcgcccgcaaggaaccagaccgggactggcaaaggcagaggcaaaggagcggccgccgctggctcggaacgtgtttcggccgggaggacacagctacggcggaggggctactaatgctaacgcgagagcgaagggcggcaccggccaaactggcggactcacccaaccgaagaaggacgaaccaaagaaactgccaccccggccgggaggtccggagccgaagccgggacaccccccacagacgcggcaggcaactgctaggactgtcaccccgaagggccagctccctggcggcaaggctccaccgaaggctggctccgtgccatcgtctttcttgttgaaaaaggccagggaacctggacctccacgggagcctaaagagccgttccgaccgcctccgattactccacacgagtatatgctgtccttgtacagaactctctcggacgcggacaggaagggaggaaattcaagcgtgaagctcgaagccgggctggccaacacgattacgtccttcatcgataagggccaggatgaccggggaccagtggttcggaagcagaggtacgtgtttgacatctcggcgctcgaaaaggatggactgctgggagccgagctgcgcatcttgcggaagaagccgagcgacactgcgaaacccgccgcacctggaggcggaagggccgcgcagctcaaactgagcagctgcccatcgggacgccaaccagcctcgctgctcgatgtgcgctccgtcccgggcttggacggttctggctgggaagtgttcgacatctggaagctcttcagaaatttcaaaaactcggcacagctctgcctcgaactggaagcatgggagcgaggacgggcggttgatctgagaggactgggcttcgaccgggcagcgcggcaggtccacgaaaaggccctgtttctcgtgtttgggcggactaagaaacgcgacctcttcttcaacgagatcaaagctagatccggtcaagatgataagaccgtctacgagtacctttttagccagcggcgcaaacgacgagctcctcttgctactcgccaaggaaagcgaccctccaagaatctgaaggcccggtgtagccgcaaggccctgcatgtcaactttaaggatatgggatgggatgactggatcattgcacccctggaatacgaggcattccactgcgaaggactgtgcgaatttcctctgcgctcgcaccttgaacctacgaatcatgccgtcatccaaacgctgatgaatagcatggatccggagagcaccccaccgacttgctgcgtgccgacccggctcagcccgatcagcatcctgttcatcgactccgcgaataacgtggtgtacaagcagtacgaggacatggtggtcgaatcgtgcgggtgccgc

SEQ ID NO: 250347 - DNA, 1503 bp, Artificial Sequence
  Description of Artificial Sequence: Synthetic coding sequence
atgcgtttgccgaagctgctgacttttctgctttggtacctcgcgtggctcgacctcgagttcatctgcactgtgctcggggcgccggacctgggacaacgcccgcagggcacgcggccagggctcgccaaggcagaagccaaagagcggccgccactggcacgcaacgtgttccgtccaggagggcattcgtacgggggaggcgcgactaacgcaaatgcgcgggccaagggagggaccggacaaacgggcggactcactcagcccaagaaggacgaacctaaaaagttgcccccgcggccgggcggtccggaaccgaaaccaggtcacccgccccaaactcggcaagccactgcacgaactgtgactccgaagggtcagttgccgggcggcaaggccccgcccaaggccggaagcgtcccgagctcatttctgctcaagaaggcacgggagccaggccctcctcgcgagcctaaggagccattcagaccgcccccaataaccccccacgaatacatgctctcgctgtaccggaccctgtcagacgctgacagaaagggaggtaattcatccgtcaaactggaagccggtttggccaataccatcacctccttcatcgacaaaggccaggatgacagagggcccgtagtcaggaagcaaagatacgtgttcgatatcagcgcgctggagaaggacggactcttgggtgctgaactgaggatcctgcgcaaaaaaccgtcggacaccgcaaagcctgccgcacctggaggcggaagggccgcccagcttaagctctcctcgtgcccgtcgggacgacaaccggcgtcattgctcgacgtgcgatcggtgccaggtctggacggatctggatgggaggtgttcgatatttggaagctgtttaggaacttcaagaacagtgcgcagctgtgtctcgaattggaagcctgggagcgggggcgggcggtggatcttcgcggtctgggattcgatcgcgcagcccgccaggtgcacgagaaggccttgttccttgtgtttggacgcacgaagaaacgagatctctttttcaatgaaatcaaagcacggagcggacaagacgacaaaaccgtgtacgaatatctcttctcccagcgccgcaagaggcgcgccccgctggcgacccgccagggaaaacgaccttccaaaaacctgaaagcgagatgcagccggaaggctcttcatgttaactttaaggatatgggatgggacgactggatcatcgcacctctggagtacgaggcgttccactgcgaaggcctctgcgaattcccactgcgcagtcacctcgaaccgaccaaccatgccgtgatccagaccctgatgaattcaatggatcctgaatcgactccgcctacctgctgcgtgccgacccggctgtcccccattagcatcctcttcattgattccgccaacaacgtcgtatacaagcagtacgaggatatggtcgtggaatcatgtggttgtagg

SEQ ID NO: 250348 - DNA, 1503 bp, Artificial Sequence
  Description of Artificial Sequence: Synthetic coding sequence
atgcgacttccaaaactcttaacttttctgttatggtatttggcgtggttagatctggagtttatctgcacggtgttaggggcaccagatttgggacagcggccacaaggcacaagaccgggcctggctaaagctgaagcgaaagaacggccgcctctggctaggaatgtcttccggccaggtggtcacagttatggaggtggggcgaccaatgcgaacgctcgcgctaaaggcggcacagggcagacaggcggtctcacacaaccaaaaaaagacgaacctaagaaacttcctccacggcctggcggaccagagccgaaacccggacaccctccgcaaacacgacaagcaacagcacgaactgttaccccgaaggggcaacttcctggggggaaagcaccgccgaaggcggggagcgttccaagctcgttcttattaaaaaaagctagagagccggggccgccgagagaacctaaagaaccatttaggccgccccctatcacaccgcatgaatatatgttgagcctttatcggacattgtcagacgccgatcggaaaggcggcaactcttctgtgaaattagaagcgggactagctaacacgattacatcatttattgataaggggcaagatgatcggggcccggtcgtgcgcaaacaacggtatgtcttcgatatttccgcactggaaaaagacgggttattgggagcggaacttcgaatcctgcgtaaaaaaccgagcgacacagccaagcctgcagcgcctggcggtggacgggctgcacagttaaaattgtcaagctgcccgagcgggcgtcaaccggcgtccctgcttgatgttaggtccgtgccgggcttggacggatctgggtgggaagtctttgacatttggaaattattccgaaattttaaaaactctgctcagctgtgcttagaacttgaggcttgggagcgcggtcgagcggtggacctacggggattagggtttgatcgcgccgccagacaagtacatgagaaggccctgttcttagtctttggacgtacgaaaaaaagagacctgttttttaatgaaattaaagcgcgatcaggccaggacgacaaaacagtgtatgaatatttgttttcacagcgaagaaagcgtagggccccgctggcgacgcgccaaggaaagagaccgagcaagaatttgaaagcaagatgttcacggaaagccttgcacgtgaacttcaaagatatgggctgggatgactggattatcgctccgttagaatatgaagctttccattgtgaaggcttatgtgagtttccgctgcgctcacatcttgaaccgacaaaccatgcggtaatccagacactaatgaattcaatggatcctgaaagtacgcctcctacttgttgcgttccaacaagattgtcgccgatttctatcctgtttattgactccgcgaataatgttgtttataaacagtacgaagatatggttgtagagagctgtggatgtaga

SEQ ID NO: 250349 - DNA, 1503 bp, Artificial Sequence
  Description of Artificial Sequence: Synthetic coding sequence
atgcgtttaccaaaattacttacatttctattgtggtatttagcctggcttgatttagaatttatttgtacagtattgggtgcacctgaccttgggcaaagaccacaaggaactaggcctggattagcaaaagcagaagctaaggaaagaccaccattagcaagaaatgtgttcagaccaggtggacatagttatggaggaggagctacaaatgcaaatgcacgtgctaagggaggaacaggacaaactggtggtttaacacaaccaaaaaaagatgaaccaaaaaaacttcctcctagaccaggagggccagaacctaaaccaggacacccaccacaaactagacaagcaacagcacgaacagtaactccaaaaggtcaacttcctggaggaaaagctccacctaaggctggatccgtaccatcatcatttttgttaaagaaagcaagagaaccaggaccacctagagaaccaaaagagccatttagaccaccacctattacaccacacgagtatatgttaagtttatatcgtacattaagtgatgcagatagaaaaggaggtaactcttctgttaaattagaagctggacttgctaatacaattactagttttattgataaaggacaagatgatcgtggtccagttgttagaaaacagcgttacgtttttgatattagtgcacttgagaaggatggattacttggagctgagcttagaattcttagaaaaaaaccatctgacactgcaaaaccagctgcaccaggtggaggaagagcagcacaacttaaacttagttcttgtccatcaggaagacaaccagcttcacttcttgatgtccgatcagttccaggacttgatggtagtggatgggaagtttttgatatttggaaacttttccgtaactttaaaaatagtgctcaattatgtttagaattagaagcatgggaaagaggaagagcagttgacttaagaggacttggttttgatagagcagcacgtcaagttcatgaaaaggccctttttttagtattcggaagaacaaagaaaagagacttattcttcaatgaaattaaagccagatctggacaagatgataaaacagtttatgaatatcttttttcccaaagaagaaaaagaagagcaccacttgcaactcgtcaaggtaaaaggccatcaaaaaatttaaaggctagatgttctaggaaggctttacatgttaattttaaagatatgggatgggatgactggattattgctccacttgaatatgaagcttttcattgtgaaggactttgtgaattcccactaagatcacatttagaaccaactaaccacgcagttattcaaactttaatgaattcaatggatccagaaagtactccaccaacttgctgtgttccaactcgtttgtctcctatttcaattttatttattgattcagctaataacgtagtttacaaacaatatgaagatatggtcgtagaatcatgtggttgtaga

SEQ ID NO: 250350 - DNA, 1503 bp, Artificial Sequence
  Description of Artificial Sequence: Synthetic coding sequence
atgcggcttccgaaattgttgacgtttctgctttggtatttggcctggcttgacctcgaattcatttgcacggtcctgggcgcacctgatctgggtcaaagaccccaaggtacccgacctggtctggcaaaagcggaggcgaaagaaagacctccacttgcaaggaacgtttttagaccaggaggacactcatacggtggaggggcaacgaatgccaatgcacgagcaaaaggaggaaccggccaaactggtggtctgactcagccaaagaaggacgaacctaagaaacttccgcctagacccggaggtcccgaacctaagcccggacatccaccccagaccaggcaggccactgcaaggaccgtgaccccgaaaggacaattgcccgggggaaaggcgcctcctaaggcggggtcagtcccttcatcctttttgctgaagaaggcacgcgaacctgggccacctcgggaaccaaaagagccgttcagacctccccctatcaccccacatgaatacatgttgtcattgtaccggaccctcagcgacgcagataggaagggtggtaacagctcggtgaagctggaagctggcctcgcaaacaccattacttccttcatagataagggtcaagatgatcgcgggcctgtcgttcgcaaacaacggtacgtgtttgacatttcggcactcgaaaaggatggacttctcggagccgaactgagaatccttcgaaagaagcctagcgatactgcaaagccagccgcacctggtggcggccgcgctgcacaactcaagctgtcgtcatgcccgtcgggcagacaacccgcctccctgctcgatgtcagatccgtgccaggacttgacggcagcggttgggaagtatttgatatttggaagctctttcgtaacttcaagaattcggcacaactgtgccttgaattggaagcgtgggaacgcggacgggccgtcgacctgcgcgggctgggttttgatagggcagccaggcaagtgcatgagaaagcactgtttctggtctttggcagaaccaagaagagagatctcttctttaatgagatcaaggcccggtcaggacaagatgacaagaccgtctacgagtaccttttcagccagcgccgtaaaaggcgagccccacttgcgaccagacagggtaagcgtccgtccaaaaacctgaaagcacgctgtagcagaaaggccctgcatgtgaacttcaaagacatgggatgggatgactggatcattgctcctcttgagtacgaggcatttcactgtgaaggactttgcgaattccccctgaggtcacatctcgagccaacgaaccacgcagtgatccagactcttatgaactccatggatccagaatccactccaccgacttgttgtgtccctacgaggctttcaccaattagcatcttgtttattgactcagcaaataacgtcgtctacaagcagtacgaggacatggtcgtggaatcgtgcggatgccgc

SEQ ID NO: 250351 - DNA, 1503 bp, Artificial Sequence
  Description of Artificial Sequence: Synthetic coding sequence
atgcggctgcccaaactgctcacctttcttctttggtatctggcgtggcttgacctggagttcatatgtaccgttcttggagctcctgatcttggccaaagacctcaggggacgcgccccgggctggcaaaggcggaggccaaagaaagaccaccattggccaggaacgtgttccgtcctggcggccattcctacggtgggggtgccactaacgcgaatgcaagggcaaagggtggtacgggtcagactgggggacttacccaaccaaagaaggacgaaccgaagaaactgccacctagacctggagggcccgaacctaagcccggacatccacctcaaactcgtcaggccactgcacggaccgtcactcccaaggggcagttgccgggaggaaaagcgcctcccaaggccggttccgtcccgtcctcatttctgcttaagaaggcaagggaaccaggacctccacgggaacctaaggaacctttccgccctccacccattacccctcacgagtacatgttgtccctttacaggactctgagcgacgcagatcgcaagggaggcaactcgtccgtaaaacttgaagcagggcttgctaacaccatcacgagctttatagataagggacaggatgatagggggcctgttgtcagaaaacaacgatacgtttttgacattagcgcattggaaaaggatggtctgcttggtgcagagttgcggattctccgcaaaaagccctcggacactgcaaaaccggcagccccaggagggggtcgagcagcacaacttaagctctcatcgtgtccttcagggcggcaacctgcttcgctgctggatgtgcggtccgtcccaggtctggacggctcgggatgggaagtgtttgatatctggaaacttttccgcaactttaagaattcggctcagctgtgccttgagctcgaagcatgggaaagagggagagcagtggacctcaggggtcttggattcgatcgggccgcaagacaggtccacgaaaaggcattgtttctcgtgtttggtagaaccaagaagagggacctgtttttcaacgagattaaggcgcgctccggccaagatgacaaaactgtttatgaatacctgttttcgcaaagacgcaagaggagggctcctctcgccacgagacaggggaagcgtccatcgaagaaccttaaagcgagatgctcgaggaaggcgcttcatgtgaactttaaggacatgggatgggacgattggattatcgcacctcttgaatatgaagcatttcattgcgaaggtctttgtgagtttcctctcagatctcatctggagcctactaatcacgcagtgattcaaacccttatgaactccatggatcccgaatcgacgcccccaacctgctgtgtgcctacccgtctctcgcctattagcattctgtttattgactcggccaataacgtggtgtacaaacaatacgaggacatggtggtcgagtcatgcggatgtcgc

SEQ ID NO: 250352 - DNA, 1503 bp, Artificial Sequence
  Description of Artificial Sequence: Synthetic coding sequence
atgcggctgccaaaactccttacctttctcctgtggtacttggcctggctggatctggaattcatttgtactgttctcggagcacctgatctcggacagcgtccacaaggaactcggcctgggctcgccaaggccgaagcaaaggaacggccaccacttgcccggaatgtgtttcggccaggaggtcattcgtatggcggcggagccacgaacgccaatgccagagcaaaggggggaacgggacaaactgggggccttacccaacctaagaaagatgagcctaagaagctcccgcctcgacctggtggtccagagccaaaacctggtcaccctccccaaacccgacaggctacggctagaaccgttacccccaaagggcagcttcctggtggtaaggcacccccgaaagcggggtcggttccaagctcttttcttctgaagaaggctcgggaaccaggacctccacgtgagcctaaggaaccgtttcgcccacctccaataactcctcacgagtacatgctgtccttgtaccgaacccttagcgatgccgataggaagggtggtaactcgtcggtgaagctggaagcaggcctggcgaacacgatcactagctttatagataagggccaagatgatcgcggtccggtggtacgtaaacaaagatatgtttttgacatcagcgcgcttgagaaggacggccttctgggagcggagcttagaattttgagaaagaagccctccgatacggccaaacctgcagcacccgggggcgggcgggcggcacagctgaaactttcatcatgcccttcaggaaggcagccagcaagcctgcttgacgtgcggtcagtgcctgggctggatggaagcggttgggaagtctttgatatatggaagctgtttcgcaatttcaagaactccgcccagctttgtcttgaactggaagcgtgggagcgtggcagggccgtggatcttagaggactcggattcgaccgagcagcaagacaagtccatgaaaaagcactctttctggtgtttggaagaacgaaaaagagagacttgttctttaacgagataaaggcacggtccggccaagacgacaagaccgtgtacgagtacctgttttcacaaagaagaaaaagacgtgcaccgcttgcaacccggcagggaaagcggccatcaaagaacctgaaggctcggtgcagccgaaaggccctccacgtcaacttcaaagacatgggatgggatgactggattattgcacctctggaatacgaggcatttcattgcgaaggactgtgtgaatttccactcagaagccatcttgaaccaactaaccatgcagtcatacagaccttgatgaactctatggatccagagtcgaccccacctacctgttgcgtccccaccagactctcacctatttcaatcctgttcattgattccgccaataatgtggtctacaaacagtacgaagatatggtggtggaatcgtgtggttgtcgc

SEQ ID NO: 250353 - DNA, 1503 bp, Artificial Sequence
  Description of Artificial Sequence: Synthetic coding sequence
atgcgcctgcctaagctcctcacgttcctgctgtggtacttggcatggctcgacctcgaatttatctgtaccgtactcggcgcccccgacctgggacagcgcccccaaggaaccaggcccggacttgccaaagctgaggccaaggaaagacctcctttggcacgcaacgtgtttagaccaggaggccattcttacggcggtggagccactaatgcaaatgcacgcgcaaagggtggtaccggccagactggcggactcacccagcccaaaaaggacgagcccaagaagctgcctcctagacccggaggccctgaacctaaacctggacatcctccccagaccaggcaagccacagccagaacagtgaccccaaagggacagctccccggaggcaaggcacccccaaaggctggatccgtgccttctagttttcttctcaagaaggctcgcgaaccaggaccaccccgcgaaccgaaggaaccattcaggccaccaccaattaccccacatgagtacatgctctccctgtaccgcacactgtctgacgccgaccgcaagggcggaaattctagcgtcaagcttgaagccggacttgccaataccataaccagcttcatagataagggccaagacgatagaggaccggttgtaaggaaacagcgctacgtattcgacatctctgcgttggagaaggacggtctgttgggagccgagcttagaatcctcagaaaaaagcctagtgacaccgccaaaccagctgcgcctggaggtggacgcgcagcccagctcaagcttagctcctgtccttccggtaggcagccagctagcttgctcgatgttagaagcgtgccaggcctggatggatcaggttgggaagtgttcgacatttggaagctcttcagaaactttaaaaactccgcgcagttgtgtctcgagctggaagcttgggaaaggggaagagctgtggacctgaggggactcggatttgacagagccgctaggcaggtccacgagaaagccctgtttctggtattcggtagaaccaagaagagggacctgttttttaatgaaatcaaagcccgctctggccaggacgacaagactgtgtacgagtatctgtttagtcagagaaggaagcgccgcgcaccactggctacacgccagggaaagcgcccatcaaagaacctgaaggcccgctgttcacgcaaggccttgcacgtgaacttcaaggacatgggatgggacgactggatcattgctccactcgaatacgaggccttccattgtgaaggtctgtgtgagttccctctgagatcacacctcgagccaacaaatcacgccgttatccaaactctcatgaattctatggatccagaatctacgccccccacatgctgcgtgcccactcgcctctctcccatcagtattctgtttatcgattctgctaataatgtcgtgtataagcaatacgaggacatggtagtggagtcttgcggctgccgc

SEQ ID NO: 250354 - DNA, 1503 bp, Artificial Sequence
  Description of Artificial Sequence: Synthetic coding sequence
atgagactgcccaaactgcttacctttctgctctggtacctggcatggctcgacctggaattcatatgcaccgtccttggagcaccagatctggggcagcggcctcagggaaccagaccaggccttgcaaaagcagaggcaaaggaaaggccacctttggcgagaaacgtgtttcgacctgggggtcattcctacgggggcggcgcaactaacgcaaacgcacgggctaagggcggaactggacaaacgggaggtctgacgcaaccaaagaaggatgagcctaagaagctgccgcctcgacccggcggtcctgaaccgaagccaggtcaccctcctcaaaccaggcaggcaaccgcgagaactgtgaccccaaagggtcaacttcctggtggaaaagcaccccctaaggccggttccgtgccttcgtcgttccttctgaaaaaggcacgtgaacctggtcccccaagggagcctaaagagccatttagacctccacctatcactccgcacgagtatatgctgtcgttgtaccgaactctcagcgatgcagaccggaagggaggcaattcatccgtgaaacttgaagcaggcctggcgaacactattacctccttcatcgataaaggtcaggatgataggggccccgttgtgagaaagcagagatatgtgtttgacatttcggcgctggagaaggatggacttttgggagcagaactgaggattcttagaaagaagccgagcgataccgcaaaaccagcagcacctggaggggggagagcagcccagctgaaactttcgagctgtccatcgggtagacagcccgcatctctccttgacgtgcggtcagtgcccggactcgatggctcagggtgggaagtgttcgatatttggaagctgtttagaaactttaagaactccgcccagctctgtctggaacttgaggcatgggaaaggggaagggccgtggatctcagaggacttgggtttgatcgggctgccagacaagtgcacgagaaagccctgtttttggtctttggaagaaccaaaaagagggatctcttctttaatgaaatcaaagcacgatccggacaagacgataagaccgtgtacgaataccttttttcgcaacgtagaaagcgccgggcacctcttgcaacccggcaagggaagcgcccaagcaaaaaccttaaggctaggtgtagtagaaaagcactccacgtcaactttaaggatatgggttgggatgattggataatcgccccactggaatacgaagcattccattgtgaaggcctctgtgagtttcctctgcggtcgcaccttgagccgactaaccatgcagtcatccagaccctcatgaactcgatggatccagaatccacgccaccgacctgttgtgtccctaccagactgtcgccaatatcaatactgtttatcgattcggcaaacaatgtcgtgtacaagcagtacgaggatatggtggtcgagagctgtggctgcaga

SEQ ID NO: 250355 - DNA, 1503 bp, Artificial Sequence
  Description of Artificial Sequence: Synthetic coding sequence
atgcggctccccaagcttctcaccttcctgctctggtacctcgcttggctcgatttggagtttatatgtacagttttgggagccccagacctaggccagcgcccccagggcaccagacctgggctggctaaggccgaggccaaggagcggccccctcttgcccggaacgtcttccgaccgggtggacattcctatggcgggggcgctaccaatgcaaacgcgcgtgctaagggcggtaccggccaaacaggcggcttgacccagccgaagaaagatgagccaaaaaaactcccccctcgccccggggggcctgagccgaaacccggtcatccaccccagactcgacaagccaccgctcgaactgttacccccaagggtcagttgcccggcggcaaggccccgcccaaggctggatctgtcccttctagcttcctcctgaagaaggcgagagagccgggaccgccccgcgagcctaaggaacctttccgccccccccctatcaccccacacgagtatatgctttctctctaccgaaccctgtctgacgctgatcgtaaggggggcaactcatccgtcaagttggaagctggcctcgccaacacaattaccagctttatcgacaagggccaggatgaccgcgggcccgtggtccgtaaacaacgctacgtgtttgacatctcggccctggagaaggacggcctgctgggggccgagcttcgcatcttacgcaagaagcctagtgacacagccaagcctgccgcgccaggtggcggtcgagcggcccagcttaagctgagctcttgcccgtcgggtcgccagccagccagcctcttagacgtcagatctgtccctggtctcgatggctccggctgggaggtcttcgacatttggaaattgttccgcaacttcaagaattcggcacagctctgccttgaactggaggcttgggaacgagggagagctgtggacctgcgcggtcttggattcgaccgcgccgcccggcaagtgcacgagaaagctctttttctcgtattcggtcgcaccaagaagcgggaccttttcttcaatgagattaaggcacgttcaggccaggacgataagaccgtctacgaatatctcttcagccagcgtagaaagcgccgcgctcccctggcaactcgccaaggaaagcgtcccagcaagaacctgaaggcccgctgttcccgcaaggccttacatgtcaacttcaaggacatggggtgggatgattggatcatcgctccgctcgaatacgaagccttccactgcgaaggtttgtgcgagtttcctctgcgctcccaccttgagcccaccaatcacgccgttatccagacgctgatgaactcgatggatcccgaatctactccgcccacctgctgcgttcccaccaggctctccccaattagcatcctattcatagacagcgcaaacaacgtggtctataagcagtatgaggacatggttgtggagtcctgcggatgccgc

SEQ ID NO: 250356 - DNA, 1503 bp, Artificial Sequence
  Description of Artificial Sequence: Synthetic coding sequence
atgcggctgcctaaactgctgaccttcttgctctggtaccttgcatggctcgacttagaatttatctgcactgtgttgggagcaccagatctgggacagcgcccgcagggaactcgtcccgggttagcaaaggcggaagccaaggagcgccctcccctggcaagaaacgtatttcgcccgggcggccacagttacggtggtggcgctaccaacgctaatgcgcgagcaaagggtggcacagggcagacaggagggttgactcagcccaaaaaggatgagccgaaaaagctcccccctagaccaggggggcctgagccaaagcctggacaccccccgcaaacaaggcaggcaaccgcacgaacagtgactccgaagggccagctgccaggaggtaaagctccacctaaagcgggatctgtgccgtcctctttcctcctgaaaaaagccagagagcccggacctccaagggagcccaaggagccttttaggccgccccccataacgccccatgagtatatgctttctctctaccgaacactttcagatgcagaccggaaaggtggcaattcatccgtgaagctggaggcaggcctggccaacactattacctccttcatagacaaaggacaggacgataggggacccgtcgtccgaaagcagagatacgtttttgatattagcgctctggaaaaagacggattgttaggagctgagctgcgtatactgcgaaagaaaccgagcgacactgcaaagcccgctgccccaggcggagggagggcagcccagctgaaattgtcatcttgtccctcaggccgtcagcccgctagtctcctggatgtgcggtcggtgccgggcctcgacggctcaggttgggaggtgttcgacatctggaaattattccgcaacttcaagaattcggcacagctctgcctggagctcgaggcatgggagcgaggcagggcggttgatctccgggggctgggattcgacagagctgccagacaggtacacgaaaaagccctgtttttagtattcggacggacaaagaaacgggatctgttcttcaatgagattaaggcacgtagcggccaagatgacaagactgtgtatgagtacctgttctcacagcgcaggaaacgcagagcccctttagctaccagacaggggaaaaggccaagtaagaacttgaaagcaaggtgcagtagaaaagcgctgcatgtgaattttaaggacatgggatgggacgactggattatcgcacctctcgagtacgaggcattccactgtgagggcctttgcgagttcccccttcgttctcatctcgagcccacaaatcacgccgtgatccagacgctgatgaatagcatggatccagagtccacacctccaacatgctgtgtgcccacgagattgtcaccaatttcaatactttttatagactctgccaacaatgttgtgtataagcagtacgaggatatggtcgtggagtcgtgcggctgtaga

SEQ ID NO: 250357 - DNA, 1503 bp, Artificial Sequence
  Description of Artificial Sequence: Synthetic coding sequence
atgcgacttcctaaactgctgaccttcctcctgtggtacctggcttggctcgatctggagttcatatgcacggtcctcggcgcccctgatctggggcagaggccgcaaggcacgcgcccggggctcgccaaagccgaagcgaaggaacgccccccgctggcccggaatgtattccgccctggtggacactcctacggaggaggagccaccaacgctaacgcgcgggctaaaggggggaccggccagaccggaggactcacccaaccgaaaaaggatgaaccaaagaaactgccgccgcgtcctggggggccggaacctaaaccgggacatcccccgcagaccaggcaagctacggcgcgcaccgtgacgccgaaaggacaactcccggggggaaaggcgcctcctaaagccggatcggtcccgtcctcgttcctgcttaagaaggcacgggaaccgggtccgccgagagaacctaaggagccattccggcctccacctatcaccccacatgaatacatgctctcgctgtaccgcaccctgtcggacgctgatcgcaagggcggaaactcgtctgtgaagctggaggccggactggctaatactatcacgagcttcatcgacaagggccaggacgaccgaggtcccgtggtgcgcaagcagcgctacgtctttgacatctccgcactggaaaaagatggcctcttgggagcagaactgagaatcctcagaaagaaacctagtgataccgccaagccggccgcccccggagggggacgcgcggcgcagctcaagctgtccagctgcccctccggacgccaaccggcgtcattgctggatgtgcgctcagtgcccgggctggatggatcggggtgggaggtgttcgacatttggaagctgttccggaatttcaagaactcggcacaattgtgtctcgagttggaggcttgggagcgcgggcgcgctgtggaccttaggggtctgggatttgaccgggccgcgcgccaggtgcacgaaaaagctctgtttctggtgttcggtcggaccaaaaagcgggatctctttttcaatgagattaaggcccggagcggtcaggacgacaaaaccgtgtacgagtatctcttctcgcagcgcagaaaaagacgcgcgccactggccactcggcagggaaaaagacccagcaagaacttgaaggcgagatgctcaagaaaggctctgcacgtgaactttaaagacatgggatgggacgactggatcatcgccccactggagtacgaagcgtttcattgcgaggggctgtgcgaattccctcttcgatcccacctggaaccaactaaccacgcggtgattcaaactctgatgaactcaatggatcctgaaagcaccccgccgacttgttgtgtccccacccggctgtcgccaatctcgatcctcttcatcgactcggccaacaatgtcgtgtacaagcagtacgaagatatggtggtcgagtcctgcggctgcaga

SEQ ID NO: 250358 - DNA, 1503 bp, Artificial Sequence
  Description of Artificial Sequence: Synthetic coding sequence
atgagactgccaaaactgctcaccttcctcctttggtaccttgcttggttggacttggaattcatttgtactgtgttgggtgcaccggatttgggacagcgacctcaagggactagacccggactggccaaggcagaagcaaaggaaaggcctcccttggcaagaaatgtgtttcgtcctggcggtcattcgtacggaggaggcgcaaccaacgccaacgcaagagcaaaaggaggcactggacaaaccgggggtctgactcaacccaagaaagacgaacctaagaagctgccacctcggcccggtggacctgagcctaagcctggacaccctccacaaaccagacaagcgactgcccggaccgtcacccctaaaggccaactgcctggcggtaaagccccaccaaaggcagggtcggtgccaagctcttttttgcttaagaaggctagagagcccggtccacctcgagaaccaaaggagccttttcggccgcctccgatcactccccacgagtacatgcttagtctgtatcgtaccctgtcggacgcagaccgaaaaggaggaaatagctcggtgaaactggaggcaggactcgcaaatactattaccagctttattgataagggtcaggacgatcgtggacccgtggtcagaaaacaaagatacgtgtttgacatttccgctcttgagaaagatggtctgcttggcgcagaactgcgtattttgagaaaaaagcccagcgataccgcaaaacctgcagcacctggagggggtagagcggcccaacttaagctcagttcgtgcccatcagggcggcagcctgcatccctcctcgacgtgagatcagtcccaggtcttgacgggagcggatgggaagtatttgatatatggaagttgttcagaaacttcaagaatagcgcccagctttgccttgaactggaagcctgggaacggggtcgggcagtggatctcagagggcttggttttgatcgcgcagcaaggcaagtccatgaaaaggccctgttcctcgtgttcgggcgaaccaagaagagggacctgtttttcaacgagattaaggcacggtcaggacaagatgataagactgtgtatgagtacctttttagccagagacgcaagcgcagagcacccctcgcgactcgtcagggaaagcggccttcgaagaacctgaaggcacgttgttcaaggaaggcacttcacgtcaactttaaagacatgggatgggacgactggatcatcgcccctcttgaatacgaagcgtttcattgtgaaggactctgtgaattcccactgcggtcgcaccttgaacccaccaaccatgcagtgattcagacccttatgaactccatggatccagagagcactcctccaacgtgctgtgtcccaacccgtctgagccctatttccatcctgttcattgactcggccaataacgtggtgtacaaacagtacgaggacatggtcgtggaatcatgtggttgtagg

SEQ ID NO: 250359 - DNA, 1503 bp, Artificial Sequence
  Description of Artificial Sequence: Synthetic coding sequence
atgagattgccaaagctgcttacttttctcctttggtaccttgcctggctggacctggaattcatttgtaccgtcctcggcgcaccggatcttggccagcggcctcaaggtactagacctggactcgcaaaggcagaagccaaggaaagacctccccttgcgcggaacgtgtttaggcccggggggcacagctacggaggcggggcaaccaatgccaacgcaagagccaaggggggtactggccagaccggcggattgactcaacctaaaaaggacgagcccaagaaactgcctccacgacctggaggacccgagccaaagcctgggcatcctccacaaacgcggcaagcaaccgcccggacggtgacccctaagggacaactccctgggggaaaggcgccacccaaggccggttccgtgccctcctctttcctgttgaaaaaggcacgtgaacctggcccacccagagagcctaaagaaccattcagaccaccccccattaccccacatgaatacatgctgtctctctaccggactttgtcggacgctgatcggaagggtgggaattcatcggtgaaactggaagcaggtctggcaaataccatcactagctttatcgacaaaggacaggacgatcgtggacccgtcgtcagaaagcaacgctacgtctttgatatatccgcacttgaaaaggatgggttgctgggtgcagaactccgaatactgagaaagaaaccatccgacaccgcaaagccagccgccccaggaggtggcagagccgcacagcttaaactgtccagctgccctagcggtaggcaacccgcaagccttctcgatgtgcgctcggtccctgggcttgatggctctggttgggaagtctttgacatttggaaactgttcaggaatttcaagaatagcgcacaactttgccttgagctggaggcttgggagagagggcgtgccgttgatctcagaggcctgggatttgaccgggctgcccgccaagtccatgaaaaggccctttttctggtgttcggtcgtactaaaaagagggacttgtttttcaacgagattaaggcgcgctctgggcaagacgataaaaccgtgtacgagtaccttttctcgcagagaagaaagaggcgagcacccctggccactcgtcagggaaagaggccttcgaagaacctgaaggcgaggtgctcgaggaaggcgcttcatgtgaactttaaggacatgggatgggatgactggatcattgcacctctggaatacgaggcatttcactgtgaaggcctttgtgaattccccctgcggtcacacctggaacccacgaaccacgcagtgattcaaactctgatgaactcgatggaccccgaatccactccccctacctgctgcgtccctacccggctttcgccgatttccattctgttcatcgattcagcaaacaacgtggtgtacaagcaatacgaagatatggtggtggagagctgcggatgtcga

SEQ ID NO: 250360 - DNA, 1503 bp, Artificial Sequence
  Description of Artificial Sequence: Synthetic coding sequence
atgcgtctcccgaagctcttgactttcctgctatggtaccttgcttggctcgaccttgaatttatttgcacggtcctgggcgctcctgacctcgggcagaggcctcagggcacacggcccggactcgcgaaagccgaggcaaaggaacgtcccccactggcaagaaacgtattccgcccagggggccacagctatggtggtggggctacaaatgccaacgctagggctaaaggcggaaccgggcagactggaggcttgacccagcccaaaaaagacgagccgaagaaactcccacctcgaccagggggccccgagcctaaaccaggccacccgccccagacccggcaggctactgcacggactgtcactccgaagggccagctgccaggcgggaaggcaccacctaaggccggttctgtgccctcttcatttttgctgaaaaaagccagagagccgggcccaccccgcgagcctaaagagccttttagacctcccccgatcactccccatgaatatatgttgagcttatatcggaccctctcagacgctgaccgaaaaggtgggaactctagcgtcaagctggaggccggattagctaacaccataacttcgttcatcgataaaggtcaagatgaccgtggcccggtcgtaaggaaacagcggtatgtttttgatatatcggcgctggaaaaagatgggctgctgggagctgagcttcgtatactgagaaaaaaaccttcagacacagctaagccagccgcaccaggaggcggacgcgccgctcaactgaaactgagttcctgtccaagcggcaggcaaccagcaagcttgctggatgtccggtctgtaccgggtctagacgggagcggttgggaggttttcgatatctggaagctgtttcggaacttcaaaaattccgcccagctctgtttggagctggaggcttgggaacgaggccgggccgtggatctgaggggacttggatttgaccgggctgcccgccaggtgcacgagaaagccttgtttcttgtgttcggacgcactaaaaaaagagacctgttcttcaatgaaataaaagcgcgctctgggcaagacgacaagaccgtgtatgagtacctgttctcccaaagacggaagaggagggctccactggcgacccgccaaggcaaacggccaagtaaaaacctcaaagctcgttgctcccgcaaagcactccatgtgaatttcaaagacatgggatgggacgattggattatagccccactggagtatgaagcattccactgcgagggcctgtgcgaattccctctgcggtcacatctggaacccaccaatcacgctgtcatccagaccttaatgaactccatggatccagagtcaactccgcctacctgctgcgtgccgactcggctgtcccctatcagcattctgtttatcgacagcgctaacaacgtggtgtacaagcagtacgaggacatggtcgttgaatcctgcggctgtcga

SEQ ID NO: 250361 - DNA, 1503 bp, Artificial Sequence
  Description of Artificial Sequence: Synthetic coding sequence
atgaggctccctaaactgctgacttttctcttgtggtatctcgcctggttagatctggaatttatatgcacagtcctgggagcgcccgatctaggacagaggccgcagggaacacgccccggactggctaaggccgaagctaaagaaaggcctcctctagcgagaaatgtatttcgccccggaggacattcttatggggggggagccactaatgcaaacgcccgagcaaaagggggaacagggcagacagggggactaacacagccaaaaaaagatgaaccaaagaaactgccacctcgccctggggggccagagcctaagccagggcatccacctcagactagacaagctacagctaggactgtgactccaaaaggacaactccctggaggaaaagctcctcctaaagccggatccgtcccttctagtttcctgctcaaaaaagccagggagcccgggcccccccgcgaaccaaaagaaccattccggcctcctccaatcacacctcatgaatatatgctatctctctataggacactcagtgatgctgaccgcaaaggggggaatagtagtgtcaaactagaagccgggcttgctaacactatcacttccttcatagataaggggcaagatgatagagggcctgtggtccgaaaacagcggtatgtgttcgacatatctgccttggagaaagatggacttttaggggctgaactgagaatcctacggaaaaaaccctctgatactgctaaaccagccgccccgggaggggggagggcagcccagctaaaactctcaagttgcccctcaggacgccagccggctagtttgcttgatgtcagatccgttccaggactcgacggatctgggtgggaagtatttgatatctggaagctgttcaggaatttcaaaaattctgcccagctctgtctggaacttgaagcatgggaaagagggagggctgttgatcttcgcggacttggattcgatcgagccgcccgacaggtgcacgaaaaagctctattcctcgtgttcggaaggactaaaaagagagatcttttttttaatgaaatcaaagcaagaagtggacaggatgataaaactgtttatgaatatctgttttctcagcggcggaaacgcagagcgcctttagccactcggcagggaaaaaggccctctaagaatttaaaagccagatgctccaggaaagccttgcatgtgaactttaaagatatggggtgggatgattggatcatcgctccccttgaatatgaggcttttcattgcgaagggctgtgtgaatttcctcttcggagtcatcttgagcctacaaaccacgctgtcatccagacacttatgaatagtatggatccagaatctacaccaccgacatgctgtgtccccactaggctgtccccaatctcaattctcttcatagactcggccaacaatgtggtctataaacagtacgaagatatggttgtggaaagttgcggatgcagg

SEQ ID NO: 250362 - DNA, 1503 bp, Artificial Sequence
  Description of Artificial Sequence: Synthetic coding sequence
atgagattaccaaaactgctgactttcctcctgtggtacctggcttggctggacctggagttcatttgcactgtacttggtgcaccagacctgggccagcgaccacaaggcacacgcccagggctggccaaggccgaggctaaggagcgtcccccactggcaaggaacgtgtttagaccaggggggcattcctacggggggggagccacaaacgcaaatgccagggccaagggcggcaccggccagaccggaggcttgactcaaccaaaaaaagatgaacccaaaaaactccccccacgacccggcggcccagagcctaaacccggccacccaccacagacccggcaagcaactgctcgcactgtcacccctaaaggccagctgcctggtggtaaggccccaccaaaggcaggtagtgtgccctcttcttttcttctcaagaaagccagagagcctggtccacctagggagccaaaggaaccatttcgtccaccccccatcaccccccatgagtatatgctgtccctctaccgcactctctctgatgctgatcggaagggagggaacagctctgtcaaattagaagccggcttagcaaacaccatcacctccttcattgataaaggccaggacgatcgcggccccgttgtccgtaaacagaggtatgtgttcgatataagcgcactagagaaggacgggttactcggcgccgaattaaggatcttgcgcaaaaagccaagcgataccgccaagcccgccgcccctggtggcggccgcgcagcacagctcaaactgagtagctgtccatcaggccgacagcctgccagcctactcgacgttaggagcgtgcctggcttagacggttccggctgggaagttttcgatatctggaagctgttcagaaatttcaagaattctgctcaactgtgtcttgaactagaggcctgggaacgcggcagagctgtcgacctgagaggtctcggtttcgacagggctgctcgacaagtgcacgaaaaagccctgttcctggttttcggaaggacaaagaaacgagacctcttttttaacgagattaaggcaaggtctgggcaggacgataagaccgtgtatgaatacctcttttcccaaaggcgtaagagacgagccccattagctactagacaaggcaaaaggccatccaaaaacctgaaagcccgttgctccaggaaggccctgcacgtcaactttaaggacatgggttgggatgattggattattgccccactcgaatatgaagcattccactgtgaagggttatgtgaatttcctcttaggtcccaccttgagcccaccaatcatgctgtgattcagaccctgatgaacagcatggaccccgaaagcacaccccccacttgctgcgtgccaacaaggctttctcctattagtatccttttcatagactccgccaacaatgtcgtttacaagcaatatgaggacatggttgtggaatcctgcggatgtcgg

SEQ ID NO: 250363 - DNA, 1503 bp, Artificial Sequence
  Description of Artificial Sequence: Synthetic coding sequence
atgcgcctgccgaaacttctgacgttcctcctgtggtacctggcctggctggacctggagttcatctgcaccgtgctcggagcaccggacctgggacaaagacctcaaggtaccaggccgggactcgcgaaagcagaagcgaaagagcggcccccgctggcccgcaacgtgtttcgtccgggcggtcattcgtacggaggcggggccactaacgccaacgcgagagccaagggaggaactggccagactggagggttgactcagccgaagaaagatgaacccaagaaactcccgccacggcccggcgggccagagcctaagccaggacacccgccgcagacccggcaagctaccgctcgtactgttactcctaagggtcaactgcctggagggaaagcccctccaaaagctggatccgtgccttcctcattcttgctgaagaaggccagggagccgggcccccctcgcgaaccgaaagaaccattccgccctccgcccatcaccccacatgagtacatgctcagcctttaccggaccctttcggatgcggatcggaagggcggaaattcctccgtcaagctggaagccggcctggccaacactattaccagctttatcgacaagggccaggacgatcggggcccggttgtgcgcaaacaaagatatgtgttcgacatctctgctctcgagaaggacggtctgctgggagcagaactgagaatcctccggaagaagccaagcgatacggctaagcccgcagcgccgggaggaggacgcgccgcgcaactcaagctgtcatcatgtccgtcgggccgacagcccgcgtcacttttggacgtgcgcagtgtgccggggctggacggaagcggatgggaagtgtttgacatctggaagctgttccgcaactttaagaactcggcgcagttgtgcctggaactcgaagcctgggaacgcggccgggcagtggacctcagagggttgggtttcgacagggcagctcggcaggtgcatgagaaagccctgttcctggtctttggacgcaccaagaaacgcgatctgtttttcaacgaaatcaaggcccggtcaggacaggatgacaagactgtgtacgaatacctgttctcccagagaagaaagaggcgcgcccctctggcaactaggcaggggaaaagaccgagcaagaatttgaaggcacgatgctccagaaaggccctccacgtcaatttcaaggatatgggttgggatgactggattatcgcgccactcgagtacgaagccttccactgcgaaggactgtgcgagttcccactgcggtcgcaccttgagccaaccaaccacgcggtcatccagaccctcatgaattcgatggatccggaatcgacgccaccgacctgctgtgtgccaacccggctctcgccgatctccattctgttcatcgactccgctaacaatgtggtctacaagcaatacgaggacatggtggtcgagagctgcggatgtcgc

SEQ ID NO: 250364 - DNA, 1503 bp, Artificial Sequence
  Description of Artificial Sequence: Synthetic coding sequence
atgagactgccgaagttgttgactttcctcttgtggtatctggcctggctggacctcgagttcatttgtactgtgctcggcgcccccgacttgggacaaaggccacagggaaccagaccggggctcgccaaggccgaggcgaaggaacggcccccactcgcccgcaacgtgtttcgacctggtgggcattcgtacggaggaggggccaccaacgccaacgcacgcgcaaaagggggcaccggacagaccggcggacttactcagccgaagaaagacgagccgaagaagctgccccctcggccgggaggacctgagccgaaaccgggacacccgccccaaactcgccaagcaaccgcgcgcactgtgactccgaagggacagctgcctggtggcaaagccccacccaaggccggctccgtgccttcatcatttctgctcaagaaggccagagaaccgggacctcctcgggagccgaaggaacctttcaggccgcccccgattaccccacacgaatacatgctgtccctgtaccggactctctcagatgccgacaggaaaggaggaaactcgtccgtgaaacttgaggccgggctggccaacaccatcacgagcttcatcgacaaggggcaggacgatcgcggaccagtcgtgcggaaacaaagatacgtgttcgacatctcggctctggaaaaggacgggctgctcggagccgaactgcggatcttgcggaaaaagccctccgacaccgcaaagccagcggcgcctggcggaggacgggccgcacagctgaaactgagcagctgcccgtctgggcgccagccggcgagcctcctggacgtgagatccgtcccaggactggacggatcgggatgggaagtgttcgacatatggaaacttttccggaatttcaagaactcagcccagctttgcctggaattggaagcatgggagcggggcagggcagtggatctgcgcggactcggatttgaccgcgcagccagacaggtgcacgagaaggccttgttcctggtgttcggacggacgaagaaacgggacttgtttttcaacgagattaaagctcggtcaggacaagacgacaagactgtgtacgagtacctgttctcccagcggcggaaaaggcgggcgccactggccacgagacaaggcaagcgcccgtcgaagaacctgaaggccagatgctcgcgcaaggccctgcatgtgaactttaaggacatgggctgggatgactggatcatcgcgccactcgaatacgaagcattccattgcgagggattgtgcgagttccctctgcggagccaccttgagccgaccaaccatgcggtgatccaaaccctgatgaattcaatggatccagagtcgactcccccgacctgctgcgtgccgacccgcctgtcgcccatctccatcctgttcatcgattcggccaacaacgtggtgtacaagcaatacgaagacatggtcgtcgagtcctgcggctgccgg

SEQ ID NO: 250365 - DNA, 1503 bp, Artificial Sequence
  Description of Artificial Sequence: Synthetic coding sequence
atgagacttcctaagctgctcactttcctgctctggtaccttgcttggcttgatctggaattcatttgcactgtgcttggtgcacctgacctcggccaaagacctcagggaactcgccctggccttgcaaaggcagaggcaaaggaacggcctccgctggcacgcaatgtgttccggcccggcggccactcctatggtggaggagcaactaacgccaatgcacgggcaaaaggtggaactggccagaccggcggtcttactcagcctaagaaagacgaacccaagaagttgcctccaagacccggcggtcctgaacctaagcccgggcaccccccacaaactcggcaagccaccgcccggaccgtgactcctaaaggacaactgcccggggggaaggccccgcctaaggccggatcggtgccgtcctccttccttttgaaaaaggcaagagagccaggaccacctagagaacccaaggagccctttcgtccgccacccattactccacatgaatacatgctgagcctgtaccgtaccctttcggatgctgatcggaagggagggaactcctccgtgaagctggaggcaggtctggccaacacgataacttcgtttattgacaagggacaggatgatcggggtcccgtggtccgtaagcaacgctacgtgtttgatatttccgcactggagaaggacggtctgcttggtgcagaacttagaattctccgcaagaaacctagcgatactgcaaagccagcagcacctggaggcggaagagcagcgcagctgaagctgtcgtcctgcccatccggccgacaaccagcctcgctgctggatgtgcgatccgtgcccggcctggatggttcggggtgggaagtgtttgacatctggaaactttttcgaaatttcaagaatagcgctcaactttgcctcgaactggaggcctgggaacgaggacgcgccgtggatctgaggggacttgggtttgatagggcggcgaggcaggtgcatgaaaaagcattgttcctggtgttcggtcgtaccaaaaagagggacctgttctttaacgagatcaaggcccggtccggccaggacgataagaccgtctacgaatacctcttttcccagcgtcggaaaagaagagcgcctctcgcaacccgccaaggtaaacgcccctcgaagaatcttaaagccaggtgttcgcgtaaagcgcttcatgtgaactttaaagatatgggttgggacgactggatcatcgcaccacttgaatatgaggcattccactgtgaaggtctgtgcgagttcccccttcgctcgcatctcgagccaactaaccatgcagtcatccaaaccctgatgaattccatggatccggaatcgactccccctacgtgttgcgtgccaacgaggctgagccctattagcatcttgttcatcgacagcgcaaacaacgtcgtgtacaaacaatacgaagatatggtggtagaatcgtgtggctgtaga

SEQ ID NO: 250366 - DNA, 1503 bp, Artificial Sequence
  Description of Artificial Sequence: Synthetic coding sequence
atgagactccctaaattactgactttcctgctctggtatctggcgtggctggacttggagttcatctgtaccgtgctcggggctccagacctcgggcagaggcctcagggaaccaggccaggcctagcaaaggccgaagccaaagaacgcccgcctctggcacgcaacgtgttccgccctgggggacatagttatggcggtggtgccacaaatgcgaacgctagagccaagggtggcacagggcagacaggtgggctcacccagccaaaaaaagatgaacccaaaaaactcccacctaggcccggcgggcctgaaccaaagccgggccaccccccacagacaagacaggccacagcacgcactgtgactcccaagggacagctgccagggggtaaggcgcctccaaaggcgggatctgtgcccagttcttttctactgaagaaagcgagggagccagggcctcccagggaaccaaaggagcctttccgaccaccccccattactccacacgagtacatgctttccctctatcgcactttgtccgacgctgatcgaaagggcgggaactcttcagtgaagctggaagctggattggctaacaccatcacttcgttcatcgacaaaggccaagatgatcgtggtcccgtcgtgaggaaacagagatatgtcttcgacataagcgcactggaaaaagatggtctgcttggagccgagctccggatcctgcggaagaaaccaagtgacaccgctaaaccagctgcccccggaggtggcagagccgcgcaacttaagctttcaagctgcccaagcggacgccagcccgcgagtcttttggacgtgcggagtgtccctgggctggatgggtctggatgggaggtcttcgacatatggaagctctttaggaatttcaaaaatagcgctcaactttgcttagagctcgaagcctgggagcgtggacgcgccgtcgacttgagagggctaggattcgatagggccgctcggcaggtgcacgaaaaggctctgtttctcgtgttcggccggaccaaaaaacgagacctgttctttaatgagattaaggcccggagcgggcaagacgacaagaccgtatatgaatatctgttctcacagcggcgaaagagacgggccccactggccacccggcagggaaaacgaccctccaagaacctgaaagcccggtgctccaggaaggccttacacgtgaatttcaaagatatgggttgggacgactggatcatagcccccctggagtatgaggcctttcattgtgaaggactgtgtgagtttccactgaggtcacaccttgagccgaccaatcatgcagtgattcagacactaatgaactctatggatcctgaatccacccctcctacttgctgtgttccaacccgcttgagccccatttccattctgttcatagactctgccaacaacgtggtgtataaacagtatgaggatatggttgtggaatcttgtggctgtaga

SEQ ID NO: 250367 - DNA, 1503 bp, Artificial Sequence
  Description of Artificial Sequence: Synthetic coding sequence
atgcggctgccaaaactgctgaccttccttctttggtacctggcctggctcgatctggagtttatttgcaccgtgctgggcgctccagacctcggacagagaccacagggtaccaggcctgggttagcaaaggctgaggcgaaggagagaccgcccttggccagaaacgttttccgcccaggtggacacagctacggtggaggtgccaccaatgccaatgcacgggccaagggaggcaccggtcagacagggggccttacacagcctaaaaaggatgaaccaaagaaactacccccacgcccaggaggtcccgagcctaagcccggtcatccacctcaaaccaggcaagcaaccgcccggacagtgacccccaaagggcagctgccaggtggaaaggcccccccaaaagctgggtctgtgccttccagttttctgctcaagaaggcccgcgagcccggaccacctagggaaccaaaggagccttttaggccgccaccgatcactccacatgagtacatgctgagcctgtatagaacactgagtgatgcagatcggaagggagggaactcatcggtaaaactggaagccggtctcgctaacacaatcacaagcttcattgacaagggtcaagatgaccggggacccgttgtcaggaagcagcgttacgtgtttgacatctcagcccttgagaaagacggtctgctcggggctgagctcaggatcctgagaaagaagccgagcgacacggcaaaaccggccgcacccggaggaggaagggctgcacagcttaagctgagctcttgcccctccggacgccagcctgcttcattgctggacgtccgttctgtgcctggccttgacgggtctggatgggaagtgttcgatatctggaagttgttccggaatttcaagaactctgcccaactctgccttgagctggaggcctgggaacgggggcgggcggtcgacttacgcggcctggggtttgacagggccgcccggcaggtgcacgagaaggctctattcctggtgttcggcagaactaagaagagggatctctttttcaacgagatcaaggcccgctccggacaggatgacaaaaccgtttacgaatacctctttagtcagagacgcaagcgccgcgctcctctggccacccgccaaggcaaacggcctagtaagaatctgaaggccagatgtagccggaaggccctgcacgtgaatttcaaggatatgggctgggatgactggattatcgccccgctcgagtatgaagcgttccattgtgaggggctatgcgagttcccactcagaagccacctcgagccaactaatcacgcggtcatacagactctgatgaacagcatggatcctgagagtactcctccgacttgctgtgttccaactaggttgtccccaatctccatcctctttatcgattctgccaacaacgtagtctacaagcagtatgaagacatggtggtcgagtcatgcgggtgtaga

SEQ ID NO: 250368 - DNA, 1503 bp, Artificial Sequence
  Description of Artificial Sequence: Synthetic coding sequence
atgagactacccaaactcctgaccttcttgctatggtatctcgcgtggctggatctggagttcatctgcacagtcctgggcgcccccgaccttggacagcgtcctcaggggacacgcccaggcctggccaaggctgaagccaaagaaagacctccactggcaagaaatgtgtttcgtccagggggacattcctatggggggggggctacaaacgcaaatgccagagccaaaggaggtacggggcagacgggcgggctgactcaacctaaaaaagatgagcccaaaaaactgcctcctcgccctgggggacccgaacctaaacctggacacccgccacagacgcgccaggcaaccgccagaaccgtgacccctaaaggacaactacccggcggtaaggcccctcctaaagcagggtccgtgccttcctctttcctgttgaaaaaagcgcgcgaacctgggcctcccagagaacccaaggagccattccggccacctcccattaccccgcacgaatatatgctgtctctataccgaacgctgagcgatgcggaccgaaaaggcgggaattcctccgtgaagctcgaagccggattggccaataccattacatccttcattgacaaaggtcaggatgataggggccccgtcgtacggaagcagcgctatgttttcgacattagcgctctggaaaaagatgggctcctcggcgccgagctccggatcctgaggaaaaagccaagtgacacagcgaagccagccgctcccggaggcggacgggccgcccagctgaaactgtcatcctgcccgagcggacgtcaacctgcctcactgctggatgtgcgctccgtacctggcttagatgggagcgggtgggaggtgttcgatatctggaagctatttcggaactttaagaacagtgcgcagctgtgcctggagctggaggcctgggaaagagggcgggcagttgacctcagggggctaggttttgaccgggcggctaggcaagtacacgaaaaagctctgttcctcgtcttcggccggaccaagaagcgtgatcttttttttaatgagattaaggcccggtctgggcaggacgataagaccgtttatgaatacctcttttctcaacgccgaaaaaggagggccccattggcaactcggcaggggaaacggccctcgaaaaatctcaaggcacggtgttcccggaaagccctgcacgtaaacttcaaagatatgggatgggacgactggatcatcgccccactcgagtatgaagccttccactgcgagggattgtgtgaatttcctcttcgaagccacttggaacccaccaaccacgctgtcattcagacgttgatgaacagtatggatcccgagtctacaccccctacgtgctgtgtgcccactagactctccccgatttccattttgtttattgacagtgcgaataacgtcgtctataagcagtatgaggacatggtggtcgagtcatgcggatgtcga

SEQ ID NO: 250369 - DNA, 1503 bp, Artificial Sequence
  Description of Artificial Sequence: Synthetic coding sequence
atgcgactgcccaaacttctaactttcttgctgtggtatttggcatggctcgatctcgagtttatttgcaccgtactgggtgcaccagatttaggtcaacgtccacagggaactcgcccagggttggctaaggcagaggctaaagaaagaccaccattggctagaaatgtttttcgaccaggaggccattcgtacggcggaggtgcaaccaatgctaatgcaagggccaaaggaggaactggacagactggaggcttgacacaaccaaaaaaagatgaacctaagaagttgcccccacgacccggaggaccggaaccaaaacctggacatccaccgcagacaagacaggccactgcaagaacagttacaccgaagggtcaattaccaggaggcaaggctccaccaaaggcgggctctgtcccatcaagcttcttgcttaaaaaagctcgggagccaggcccgccgagagaaccaaaagaaccttttcgaccgccaccaattacaccacatgagtatatgctctcattatatcgaactctgtcagatgctgatagaaaaggtggtaactctagtgttaaactcgaagcgggtcttgctaatacaataactagtttcatcgataaaggtcaggacgatcgaggaccagttgttcgtaagcaacgttatgttttcgatatctctgccttggagaaagatggactcttgggagccgagcttaggattcttagaaaaaagccttcagacaccgctaaaccggccgctcccggtggaggtcgagcagctcaactcaaactttcaagttgcccatcaggtagacaacctgcctcgcttctcgatgtccgctcagtgccaggattggatggctcgggttgggaagtttttgatatttggaagctcttccgaaactttaagaattccgctcagctatgtctggagctggaagcttgggaacggggccgtgctgtggacctgagagggcttggattcgatcgggctgctcgtcaagtgcatgaaaaagctctttttctcgtgttcggacgtactaagaaacgtgatctgttcttcaatgaaatcaaggcacggtcaggacaggatgacaagacagtatatgaatacctcttttcgcaacgtcgtaagcgtagagctccattggctacacgtcaaggaaaacgcccaagtaagaatttgaaggcgagatgttctagaaaggctcttcacgtaaattttaaagatatgggatgggacgattggattattgctcccctagagtacgaggcattccactgcgaaggactttgcgaattcccattgagatcccatttggaacctactaatcacgctgtgattcagacactcatgaatagcatggaccctgaaagtaccccaccgacttgttgtgtaccaacacgtctttctccaatctcaattttattcatcgattccgcaaataacgtcgtgtataaacagtatgaggacatggtggtcgaaagttgcggatgtagg

SEQ ID NO: 250370 - DNA, 1503 bp, Artificial Sequence
  Description of Artificial Sequence: Synthetic coding sequence
atgcgactgccaaagctgctgacctttctcctgtggtacctggcctggctggacctggagttcatctgtactgttctcggggctccggacctgggacagcggccgcagggaaccagacccgggctcgccaaagcagaagcgaaagagaggcccccgctcgcgcggaacgtttttaggcccggaggacactcgtacggcggcggtgccaccaacgctaacgcccgcgctaagggtggaactgggcagactggtggccttacccagcctaagaaggacgagccgaagaaactgccgcctcgccccggaggcccggagccgaagccaggtcacccccctcaaactaggcaagctactgctcgaaccgtcaccccaaaaggacagttgcctggcggtaaggccccgccgaaggcaggctcggtcccatcgtcgtttttgcttaagaaagcccgagaaccgggaccgccgcgggaacccaaggaaccgttcagaccgcccccgattacccctcacgagtacatgctgtcgctgtatcgcaccctctcagacgcggatagaaagggtggtaattcgtctgtaaagctggaagccggactcgcgaacaccatcacctccttcatcgacaagggccaggatgataggggaccagtggtgagaaagcaacgatacgtgtttgacatctccgcgctggaaaaagacggactgctgggcgccgagctcaggatcctgcggaaaaagccaagcgataccgcgaaaccggcagcgccgggcgggggaagagccgcccagctgaaattgtcgtcatgtccttcgggacggcagcctgcgtcgttgctcgatgtccggtcggtccctggtctggacggatccgggtgggaagttttcgacatctggaaactctttcggaatttcaagaattcagcccagctttgtctggaactggaagcatgggaacgcggcagagccgtggatctgcgcggcctcgggtttgatcgggccgcccggcaggtgcatgaaaaggccctgttccttgtgttcggccgcactaaaaagcgggacctgttcttcaatgaaatcaaggcccgtagtggacaggatgacaaaaccgtgtacgagtacctgtttagccaaaggcggaagcgccgggctccgcttgccactcgccagggcaagcgcccgtccaagaatctgaaggcgagatgctcccgcaaagcactgcacgtcaactttaaagacatgggttgggatgattggattatcgccccgcttgagtacgaagccttccactgcgagggcctgtgcgaattcccactgcgctcgcatctggagccgactaatcacgccgtgatccagaccctcatgaactcaatggaccccgagagcacccctccgacctgctgcgtcccgacgcggttgtcgccgatttccattttgttcatcgactcggccaacaacgtggtgtacaaacaatatgaggatatggtggtggaaagctgcggctgtagg

SEQ ID NO: 250371 - DNA, 1503 bp, Artificial Sequence
  Description of Artificial Sequence: Synthetic coding sequence
atgaggttgcccaaactgctgacatttttgctttggtacctggcgtggctcgacttagagttcatatgcactgttcttggcgcccccgatctgggccaaagaccccagggtacccgtcccggactggcgaaagccgaagcaaaagaacggcctcctctggccaggaatgtctttagacctggggggcacagttacggaggtggtgccactaacgctaacgcaagagcaaaaggcggaactggacaaacgggagggctgactcaacccaaaaaggacgagcctaagaagctgcctcctcggcctggaggtcccgagcctaagcctggccacccacctcagacgcgacaggccaccgctaggacagtgactccaaaagggcagctccccgggggaaaagctccacctaaggcaggcagcgtgccgagtagctttttgcttaagaaagccagagaacctggaccaccgagggagccgaaggaaccctttcggccacctccaatcaccccccacgaatacatgttgagtctttaccgcacactctctgacgccgacagaaaaggcggcaacagcagcgttaagctggaggctgggctggcaaacactatcactagtttcatcgataaggggcaggacgatagaggtcctgtcgtgaggaagcagcggtatgtttttgacataagtgctctagagaaagatggcctgttgggcgcggaacttaggattctccgcaagaagcctagcgatacagctaaaccagcagcacccggcggggggagggcagctcagctgaagctgtcatcgtgtcccagtggccggcaaccagcatccttgctcgatgttagaagcgtgcccggactcgacggttcaggatgggaggtgttcgacatatggaagctgttcagaaattttaagaactcagcacaactgtgtctggagctcgaagcctgggagcgcggaagggcagtcgatttgcgcggacttgggtttgatagagccgccaggcaggtccacgagaaggctttgttcctggtttttggacgcacgaagaagagagatttgttttttaacgagatcaaagcacgcagcggccaagacgacaagacagtgtatgagtacctcttctctcagcgcaggaagaggagggcccctttggctacacgccaggggaaacggccatcaaaaaatctgaaagcacggtgctctaggaaggcactgcacgtgaatttcaaagatatgggatgggatgattggattattgcacccctggaatacgaagcgttccattgtgaaggcttgtgtgaatttcctcttagaagccaccttgagccaacaaaccatgcagtcattcagaccctgatgaacagcatggaccccgaaagcacaccaccaacctgctgtgttcctaccaggctcagtcccattagcatcctgttcattgattctgctaacaacgtcgtatataagcagtacgaggatatggtggtcgaaagttgcggatgcagg

SEQ ID NO: 250372 - DNA, 1503 bp, Artificial Sequence
  Description of Artificial Sequence: Synthetic coding sequence
atgaggttgcctaagctgctcactttcctcctgtggtacctggcatggttggacctggagttcatttgcaccgttcttggagctcccgatctcggacaaagaccgcaaggaactcgtccgggcctcgccaaggctgaagcgaaggaaagacctccactggctcgcaacgtctttcgccccggcgggcactcctacggtggaggagccacgaacgcaaatgctagggcaaagggcgggactggacagactggcggtcttacccagcccaagaaggatgagcctaagaagttgcctcctagacctggtggtccagaaccaaagcctggccatccaccacaaacccggcaagcaactgcacggactgtcaccccaaaaggtcagctccctggtgggaaagccccgccaaaggccggatcggtcccttcatcctttctgctgaagaaagccagagaaccaggtccacctcgtgagcccaaagaaccttttagaccaccccccattaccccgcatgaatacatgctttcgctctaccgtaccctttcggatgctgatcgcaagggcggaaattcatcagtgaagttggaggcagggcttgcaaacactattacctcctttatagataaaggccaagacgatcgaggaccagtagtccggaagcaaagatacgtattcgatatttctgcgcttgaaaaagatggcctgctgggtgccgaactgcgaattctgcgcaagaagccatccgacacggcgaagcctgccgcacccggaggcggaagagcggcccaattgaagttgtctagctgccctagcggtaggcagcccgcctctctccttgatgtgcgcagtgtgcccgggcttgatggaagcggctgggaggtgtttgacatctggaagctgttccgtaactttaagaactccgcacaactttgtctggaactcgaggcatgggaacgcggtcgcgcagtggacctcaggggactcgggttcgaccgtgcagcaagacaagtgcatgaaaaggcactttttcttgtctttggtcggactaaaaagagagatcttttctttaatgaaatcaaagcgcggtcaggacaggatgataagaccgtgtacgagtacctgtttagtcagcgtagaaagcggagggcaccacttgcgactcgtcaggggaaacgaccctccaaaaaccttaaggccagatgcagcaggaaagcgctgcacgtgaatttcaaggacatgggatgggatgactggattattgcacctttggaatatgaagcattccactgtgaaggattgtgtgagtttccattgaggtcccatttggagcctacgaatcatgcagtgatacaaaccctcatgaactcgatggaccctgaaagcacccctcctacctgttgtgtgccaaccaggctctcgccgatctcgatcctgtttatcgactccgcgaacaacgtggtgtacaaacagtacgaggatatggtcgtggaatcgtgcggatgtcgg

SEQ ID NO: 250373 - DNA, 1503 bp, Artificial Sequence
  Description of Artificial Sequence: Synthetic coding sequence
atgcgactgcccaaactgctcaccttcctgctttggtacctggcatggctggaccttgaattcatctgcactgtgttgggagcgccggacctcggacagcggccacagggtacccggcccggacttgcgaaggcagaggcaaaagaaaggccaccactggctcggaatgttttccggccgggaggacactcctacggaggcggagccaccaatgcaaatgcgagagccaagggaggaaccgggcagaccggaggtcttactcagccgaaaaaggatgaaccgaaaaaactgccgccgcgtccaggcggacctgagccgaaaccaggacatccaccgcaaacccggcaggctaccgccaggaccgtgactcctaagggacaactgccgggtggaaaggctccccctaaagccggctccgtcccttcctcctttcttctgaagaaggcgcgggaaccgggcccccctcgggagccgaaggaaccattccggcctccgccaatcactccgcacgaatacatgctgtcactctaccgtacgctgtcggacgcagatagaaaggggggcaattcatccgtcaagctcgaagccggcctcgccaacactatcacttccttcattgacaaggggcaggacgatcgaggcccggtggttcggaagcagcggtacgttttcgacatctcggctctcgagaaggacggactcctgggcgcagagctccgaattctcaggaagaagccttcggataccgcaaagcctgccgccccggggggcgggcgtgcggctcagctgaaactctcctcgtgtccatcgggtagacagcccgcgtcattgcttgatgtgcggtctgtgccgggcctggacgggtcgggatgggaggtgttcgatatctggaaactgttccgcaacttcaagaattcggctcaactctgcttggaattggaagcgtgggagcgaggtcgcgccgtggatctgagaggactcggctttgatcgcgccgctcggcaagtccacgaaaaagccctttttcttgtgttcggacgcacgaagaagcgcgatctctttttcaacgagattaaggcacgttccggccaagatgacaaaactgtgtatgagtacctgttttcccaaagaagaaagcgccgggcgcccctggcaactcgccagggcaagcggccctcgaaaaacttgaaggccagatgtagcagaaaggctctgcacgtgaatttcaaagatatgggatgggacgactggatcatcgccccgttggaatacgaggcctttcattgcgaaggactgtgtgaattccccctgcgctcccacctcgaaccgactaaccatgccgtaatccagaccctgatgaacagcatggatcccgaatcgactcctccaacgtgctgcgtcccgacccgcctgtcgccaatctcaatccttttcatcgactctgccaacaacgtggtgtacaagcaatacgaggacatggtcgtggagtcatgcggatgcagg

SEQ ID NO: 250374 - DNA, 1503 bp, Artificial Sequence
  Description of Artificial Sequence: Synthetic coding sequence
atgcggttgcccaagctgctcacgttcctgctgtggtacttggcttggcttgacctcgaattcatctgcactgttctgggagctccggacctgggacaaagaccacagggaacgcgccccggcctggcaaaggccgaagccaaagaaagaccgccactggcccgcaatgttttcaggcccgggggacactcatacggtggcggagccaccaacgcgaacgccagggcgaagggaggaaccggacagaccggaggcttgacccaaccgaagaaagacgaaccaaagaagctgccaccgcggccgggagggcccgaaccaaaaccaggacatcccccacagacccgccaagccaccgcacgcacggtcaccccaaaaggacaactgccgggcggcaaggcaccgccaaaggcgggaagcgtcccgtcgtcattcctgctgaaaaaggcccgcgaaccaggcccacctcgcgagccgaaggaaccgttccggcctcctccgatcaccccccatgagtacatgctgtcgctctacagaacgctctcggacgctgaccgaaaaggagggaacagctcggtgaaactcgaggccggccttgcgaacacgatcacctcgtttatcgataagggtcaggacgatcgcggcccagtggtccggaagcagagatacgtgttcgacatctccgccctcgagaaggatgggcttcttggagctgagctgcgtattctgcggaagaagccatcggatactgcaaagcccgccgcgcctggaggtggacgggcagcgcaactgaaactgtcctcctgcccatccggacgccagcctgcctcactgctcgacgtgcgcagcgtccctggcctggacggcagcggctgggaggtctttgacatctggaagctgttccgcaatttcaagaattcggcgcagctttgcctcgagctggaggcatgggaacggggaagggccgtggacctgcgcggcctcggattcgaccgagccgctcggcaggtgcacgagaaggccctgtttctggttttcggacgcactaaaaagcgggatcttttcttcaatgaaatcaaggctaggtcgggtcaagatgacaagaccgtttatgaatacctgttttcgcagcggcgcaagcgccgcgcgcccctggccaccagacaagggaagcggccttccaagaacctgaaagcccgttgtagcagaaaagcactgcacgtgaacttcaaagatatggggtgggatgactggataattgcgccgctggagtacgaagcatttcactgcgaaggcctgtgcgaattcccgcttcggagccatcttgagccgaccaatcacgccgttattcagactctgatgaactccatggatccggaaagcactcccccaacttgttgtgtgcccactcggctgtcgccgatcagcatcctgtttatcgacagcgccaacaacgttgtgtacaagcagtacgaggatatggtggtggaatcctgcggatgccgc

SEQ ID NO: 250375 - DNA, 441 bp, Artificial Sequence
  Description of Artificial Sequence: Synthetic coding sequence
atggtccatctgactccggaagagaaatcagcggttaccgccctttggggaaaggtcaacgtggatgaagtcggaggcgaagccctgggtcgcctgctggtcgtgtacccatggactcaacggttcttcgaatcgttcggtgacctctccaccccagacgccgtcatgggtaacccgaaggtgaaggcccacggaaagaaggtgctgggggcgttttccgatggactggcgcatttggacaatctcaagggaactttcgccaccctgtccgagctgcactgcgataagctccacgtcgatccggagaactttcgcctgctcggaaacgtgcttgtgtgtgtgttggcccaccattttggaaaggagttcactccgcctgtccaagctgcctatcagaaggttgtggctggagtcgcgaatgccctggcccacaagtaccac

SEQ ID NO: 250376 - DNA, 441 bp, Artificial Sequence
  Description of Artificial Sequence: Synthetic coding sequence
atggtgcacctgacccccgaagaaaagagcgccgtgaccgcgctttggggtaaagtgaatgtcgacgaagttggaggtgaagcgttggggcggctgctcgtggtgtatccctggactcagcgctttttcgagtctttcggagatctgtccacgccggatgctgtcatgggaaacccgaaggtcaaggctcatgggaagaaagtgctgggagcattctccgacggcctggcgcatctggacaatctgaagggcaccttcgccaccctttcggagttgcactgtgacaaattgcacgtggacccggaaaacttcaggctgcttggaaacgtgctcgtgtgcgtgcttgcacatcactttggaaaagagttcactccaccggtccaggcagcgtaccaaaaggtggtcgccggcgtcgccaacgcattggcacacaagtaccat

SEQ ID NO: 250377 - DNA, 441 bp, Artificial Sequence
  Description of Artificial Sequence: Synthetic coding sequence
atggtgcatctgacccctgaggaaaaatcggcggttacggcgctgtggggaaaagtcaatgtggatgaggttggcggtgaagcactcggacgcctgcttgtcgtctacccgtggactcagcggtttttcgaatccttcggagatttgagcaccccggacgcggtgatgggaaaccccaaggtgaaggctcacgggaagaaggtgttgggagcattctcggacggcctggctcaccttgacaacctgaagggcacctttgccactttgtccgaattgcattgtgataagctccacgtcgacccggagaacttcagactcttggggaatgtgcttgtctgcgtgctggcacaccatttcggaaaagagttcactccacctgtgcaggccgcataccaaaaggtagtcgccggagtggcaaacgctcttgcccacaagtaccat

SEQ ID NO: 250378 - DNA, 441 bp, Artificial Sequence
  Description of Artificial Sequence: Synthetic coding sequence
atggtgcacctgacgcctgaggaaaagtcagccgtgactgctctgtggggaaaggtgaatgtggatgaagtgggcggagaagcattgggccggctcctcgtggtctacccatggacccagaggttcttcgagtcatttggtgacctctcgaccccggacgccgtgatgggaaatccgaaagtgaaggcgcacggcaagaaagtgctgggcgccttctcagacggactcgcccatctcgataacctcaagggaacttttgcaaccctgagcgaactgcactgcgacaagctgcacgtggaccctgaaaacttccgcctgctcggtaacgtgctggtgtgcgtgctggcgcatcattttggaaaggaattcactccgccggtgcaggccgcataccaaaaagtcgtggcgggagtggccaatgccctggcacacaagtaccat

SEQ ID NO: 250379 - DNA, 441 bp, Artificial Sequence
  Description of Artificial Sequence: Synthetic coding sequence
atggtgcatcttacccccgaagagaaatctgctgtcaccgcgctctggggtaaggtgaatgtcgacgaagtcggtggtgaggcacttggccgtttgcttgtcgtctacccgtggacacagcggttcttcgagagttttggggatctatctacacccgacgcagtcatggggaaccctaaggtcaaggcgcatggcaagaaagttttgggtgcattcagtgatggtctcgctcatttagataacctgaagggaaccttcgcaaccctgtcggaattacactgtgataaactgcacgttgaccctgaaaacttccgcctgctcggtaacgtcctcgtctgcgtcctggcacatcatttcggtaaagagtttacacctccagttcaggcggcatatcagaaggtagtggctggcgtggcaaacgccttggcacacaaatatcac

SEQ ID NO: 250380 - DNA, 441 bp, Artificial Sequence
  Description of Artificial Sequence: Synthetic coding sequence
atggttcatctcacacctgaggagaagagtgccgtgacagctctctggggcaaggtgaatgttgatgaagtcggcggcgaggccttagggcgactgctggtggtgtacccctggacccagaggttcttcgaatcattcggggacctgagcaccccagatgccgtcatgggcaatcccaaagtaaaagctcatggcaaaaaagtgttaggggcattctctgatggcctcgcccacttggacaatctgaagggtacatttgccactctgtcagagctgcattgcgataagctacatgttgaccccgagaattttaggctgctcggcaatgtgctggtctgtgttttagctcaccactttggcaaggagtttaccccacccgtgcaggccgcctatcagaaagtggtggcaggtgtggccaatgctctcgcccataagtaccac

SEQ ID NO: 250381 - DNA, 441 bp, Artificial Sequence
  Description of Artificial Sequence: Synthetic coding sequence
atggttcacctgaccccagaggaaaagagcgctgtgactgctctctggggcaaggtgaatgtggatgaggtcggtggggaggcccttggcaggctgctggtggtgtacccgtggactcaacgcttcttcgagtcttttggggacctctctacccccgatgccgttatggggaatccgaaagtgaaagcccacggcaagaaagtactaggcgccttctctgatggtttagcacacctggataacctgaagggcacatttgccacattgtcagagttgcactgtgataagctacacgttgatccagagaacttcaggctgctgggcaatgtcctcgtttgtgtactagctcatcattttggtaaagagtttaccccacccgttcaggcggcttaccagaaggtggtggctggcgtggccaatgcactagcacataaatatcac

SEQ ID NO: 250382 - DNA, 441 bp, Artificial Sequence
  Description of Artificial Sequence: Synthetic coding sequence
atggtgcatctgaccccagaggagaagtccgcagtcactgcactttggggcaaggtgaatgtggatgaagtcggcggggaagcacttggacgactcctcgtggtgtacccttggacccaacgcttttttgaatcgtttggggacttgtccacccccgacgcggtaatggggaacccaaaggtgaaagcacacggcaagaaggtgcttggagcgttctcagatggactcgcacaccttgacaatctgaaggggacttttgccaccctctcagaacttcactgtgataagctgcatgtggatccggagaactttagactgctgggtaacgtgctggtgtgcgttcttgcgcaccatttcggtaaggagttcactcctccagtgcaggcagcctatcagaaggtggtcgcgggcgttgcaaacgcgctggcacacaaataccac

SEQ ID NO: 250383 - DNA, 441 bp, Artificial Sequence
  Description of Artificial Sequence: Synthetic coding sequence
atggtccacctgactcccgaagaaaaatctgccgttaccgctctgtggggcaaggttaatgtagacgaggtagggggagaagcactggggagactactagtcgtgtatccctggactcagaggttctttgagtcctttggtgacctgtcaactccagacgccgttatgggaaatcctaaggtgaaggcacacgggaaaaaggttctcggcgctttttctgacgggttggcccacctggataatctcaagggcacttttgctacgctctcggagctccattgcgacaagctgcatgtggatccggaaaatttcagattgcttggcaatgtcctggtatgcgtgcttgcccaccacttcggcaaggagtttaccccaccagtgcaagctgcctaccaaaaggtcgtggcaggcgtggccaatgccctggcccataaatatcac

SEQ ID NO: 250384 - DNA, 441 bp, Artificial Sequence
  Description of Artificial Sequence: Synthetic coding sequence
atggtccatttgaccccagaggagaagtccgctgttaccgcactctggggcaaggtgaacgtggacgaagttggaggagaagcgttgggaagactcttggtcgtatacccatggacgcagaggttctttgagtcgttcggggacctttcaactcctgatgcggtgatgggtaaccctaaagtgaaggctcacggcaagaaagtgctgggggccttctcggatggactggcgcatttggacaatctgaagggtaccttcgcaaccctgagcgaacttcattgcgataaacttcacgtagacccagaaaacttccgcctgctgggaaatgtcctcgtgtgtgttctcgcacaccacttcggcaaggagttcactccgccggtgcaagcggcctatcagaaagtggtcgccggggtggccaacgccctggcacataagtaccac

SEQ ID NO: 250385 - DNA, 441 bp, Artificial Sequence
  Description of Artificial Sequence: Synthetic coding sequence
atggttcatctcacccccgaagaaaagtccgctgtgaccgctctgtggggcaaggttaacgtcgacgaggtcggaggagaagcccttggacggctgctggttgtctacccgtggactcagcgcttcttcgagagcttcggggacctgtccacgccagatgcagtgatgggaaatcccaaggtgaaagcgcacgggaagaaagtccttggcgctttctcagatggactcgcccaccttgataacctcaaaggaactttcgccaccctgagcgaactccactgcgacaagctccatgtggacccagagaacttcagactgttgggtaatgtccttgtgtgcgtgctggcgcaccattttggaaaggagttcacccctcctgtccaagctgcataccagaaggtggtcgctggtgtcgccaacgccctggcccacaaataccac

SEQ ID NO: 250386 - DNA, 441 bp, Artificial Sequence
  Description of Artificial Sequence: Synthetic coding sequence
atggttcatctgacacctgaagaaaagtctgctgtgacagccttatgggggaaagtaaatgttgacgaggtcggaggagaagcactgggacggcttctggtagtctacccctggactcagagattttttgaatccttcggggacttatctacacctgacgccgtcatgggaaatcccaaagttaaagcacacggaaaaaaagtgctaggggctttctctgatgggctggcacacctggataatctcaaagggacattcgctacactatctgaattacactgcgataaacttcacgtcgatcccgagaatttcagattgctgggaaacgtgctcgtgtgtgtccttgcccaccacttcgggaaagaattcacacccccagtacaggccgcataccagaaagtggtcgcgggagtcgccaacgcattagcacataaatatcac

SEQ ID NO: 250387 - DNA, 441 bp, Artificial Sequence
  Description of Artificial Sequence: Synthetic coding sequence
atggtgcacttaacaccagaagagaagtcggcagtgacagctctgtggggaaaggtaaatgtcgacgaggtgggcggcgaggctttaggacggctgcttgtggtgtatccctggactcagaggttttttgagtcctttggagacctgtcgacgccagatgcagtaatgggcaaccccaaggtgaaggctcatggcaagaaggtgctgggcgctttttctgacggcttagctcacttggacaatcttaaaggaacatttgctactctttccgagctgcattgtgataagctgcatgtagatccagaaaactttagactgctgggaaacgttctcgtctgcgttctggcccatcactttgggaaggagttcacaccgccggtccaggctgcctatcagaaggtggttgctggagtggctaatgcacttgcccacaaatatcat

SEQ ID NO: 250388 - DNA, 441 bp, Artificial Sequence
  Description of Artificial Sequence: Synthetic coding sequence
atggtgcacttgacacctgaagagaagtccgccgtaacggccttgtgggggaaggtcaacgtggacgaagtgggcggcgaggctttaggccgtctgttggttgtctacccctggacacagagattcttcgagtcattcggcgatctgtcaacgcctgatgctgttatgggcaaccccaaagtaaaggcccacgggaaaaaagtactgggggccttctctgacggacttgcgcacctagataatctcaaagggacttttgcaacgctgtctgagcttcactgcgataaacttcatgtcgatcccgagaactttaggctgctcggcaatgtgttggtgtgcgttctggcccaccattttgggaaggaatttactccgcccgtgcaagcggcttaccagaaggtagtggcaggagtcgctaacgcgctggctcacaagtaccat

SEQ ID NO: 250389 - DNA, 441 bp, Artificial Sequence
  Description of Artificial Sequence: Synthetic coding sequence
atggttcacttaacccctgaagaaaagtctgccgtaactgcgctctggggcaaagtgaacgtggatgaggtagggggtgaggctttaggacggctgctggtggtctacccgtggacgcagagattttttgaaagctttggcgatctgagtacaccagatgccgtgatggggaaccccaaggttaaggcccatggtaaaaaggtgcttggagctttttctgacggcctggcccatctggacaatttgaagggcacttttgccacactttcagagctgcactgtgataagctccatgtggatcccgagaacttccgcctgcttggaaacgtcctggtctgcgtactggcccaccacttcggtaaggaattcactcctcccgttcaggctgcataccagaaagtcgtcgctggagttgccaacgctctggcccataaataccac

SEQ ID NO: 250390 - DNA, 441 bp, Artificial Sequence
  Description of Artificial Sequence: Synthetic coding sequence
atggtgcatctcacccccgaggagaagagcgctgtcaccgccctgtggggtaaagtgaatgtggacgaggtcggaggcgaggctcttggtcgtctcctggtggtatatccctggacacagcgtttcttcgaatcattcggagatctcagtaccccagatgccgtcatgggcaatcctaaggtgaaggcacatggtaagaaagtcctgggtgccttctccgacggcctggcccacttggacaacttgaagggcacatttgctacactgtctgaattgcactgcgacaagctgcacgtggatcctgaaaattttagactgctcggcaacgtactggtttgcgtccttgcccatcattttggtaaggaattcacccctcccgttcaggctgcataccagaaagttgtcgcaggcgtcgcaaacgccctggctcacaagtaccac

SEQ ID NO: 250391 - DNA, 441 bp, Artificial Sequence
  Description of Artificial Sequence: Synthetic coding sequence
atggtacatctgaccccggaggaaaaatctgccgttacagctttgtgggggaaggtgaacgttgacgaagtcggaggtgaagcattgggcaggctcctcgtggtctatccatggacacagcgtttcttcgagtcttttggggacctgagcacccccgacgccgtgatgggaaatcccaaggtgaaggcgcacggcaagaaggttctgggggctttttcagacgggctagcccacctcgataatctaaaaggcacgttcgcaactctatccgaattgcactgcgacaaactgcacgtagaccctgagaacttccgactgctgggcaacgtcctggtgtgtgtgctggctcatcatttcggtaaggagttcacccccccggttcaggctgcctatcagaaagttgtcgctggcgtcgccaatgccctcgcccataaataccat

SEQ ID NO: 250392 - DNA, 441 bp, Artificial Sequence
  Description of Artificial Sequence: Synthetic coding sequence
atggtgcatcttactccggaggagaagtcagctgtgactgcactctggggaaaggtcaacgtggacgaagtgggaggagaagcactcgggcgcctgctggtggtttacccttggacccaacgcttcttcgaatcgttcggtgacctctcgacccctgacgcagtgatgggtaacccgaaggtcaaggcccacgggaaaaaggtcctcggcgccttttcggatggcctcgcccatctcgacaacctcaaaggaactttcgctaccttgtctgaactgcactgcgacaaacttcacgtcgaccccgagaacttcagactgcttggtaatgtgctggtgtgtgtgctcgctcaccacttcggcaaggagttcaccccgccggtgcaggcagcataccagaaagtggtggccggggtggccaacgccctggcgcacaagtaccac

SEQ ID NO: 250393 - DNA, 441 bp, Artificial Sequence
  Description of Artificial Sequence: Synthetic coding sequence
atggtgcacctgacccctgaggaaaagagcgcggttaccgcactgtggggaaaggtcaacgtggacgaagtggggggtgaagccctgggccgcctcctggtggtgtatccctggacacagcgattttttgagagttttggtgacctcagcacacccgatgcagtgatggggaatccaaaagtaaaagcacacggtaagaaggttctgggggcttttagtgacggactagcccatttggataatctaaagggaacgtttgctactctctcagagttacattgtgacaaactccatgtcgatccggagaatttccgattgctgggaaacgtgctagtatgtgtcctcgctcaccacttcgggaaagagtttacccctcctgtgcaagcagcataccagaaagttgtggccggggtcgcgaacgccctggctcacaagtaccat

SEQ ID NO: 250394 - DNA, 441 bp, Artificial Sequence
  Description of Artificial Sequence: Synthetic coding sequence
atggtgcacctgactccggaagagaaaagcgccgtgaccgcactgtggggtaaggtgaacgtggacgaggtgggaggagaggcactgggacggttgctggtggtctacccgtggacgcagcggttcttcgagtccttcggcgatctctcaactccggatgccgtgatgggtaacccgaaggtgaaagcccacggaaagaaggtcctgggagctttttctgatggcctggcgcatctcgacaacctcaagggaactttcgcaaccctttcggaactccactgcgataagctccacgtggatcctgagaactttaggctgctggggaatgtgctcgtgtgcgtcctcgcccatcacttcggcaaggagttcaccccgccggtgcaggctgcataccagaaggtggtcgctggggtggccaatgccctggcgcacaaataccac

SEQ ID NO: 250395 - DNA, 441 bp, Artificial Sequence
  Description of Artificial Sequence: Synthetic coding sequence
atggtccatttgacaccggaagagaaatcagctgtcacggcgctgtgggggaaggttaatgtggatgaagtggggggggaggctctgggcagactcttggttgtctatccgtggactcagcgattcttcgagtcttttggtgatttatcgactccggatgcagtgatgggaaatccaaaagtcaaagcccacggtaagaaagtgctgggggcattcagtgacggcctggcccatctcgacaatcttaagggcactttcgcaacactgtccgagctacactgtgacaaactgcacgtggatccagaaaacttcaggctcctgggtaatgtgctcgtgtgtgtgctagctcaccattttggaaaggaattcacgccccccgtgcaagctgcttaccagaaagtggtagccggagtcgccaacgccctcgctcataagtaccac

SEQ ID NO: 250396 - DNA, 441 bp, Artificial Sequence
  Description of Artificial Sequence: Synthetic coding sequence
atggtgcacttgactccagaagagaagtccgctgttaccgctttgtggggaaaagtcaacgttgacgaggttggcggcgaggcgctgggccgtctgctggtcgtctacccctggacccagcgcttcttcgagtcctttggtgacctatccactcctgatgccgttatgggcaaccccaaggtcaaggcccacggtaagaaggtcctgggtgccttctccgatggactggcacacctggacaacctgaagggcacgtttgctaccctctcggagctccactgcgataaattgcacgtggaccctgagaacttccggctcctaggtaacgtcctcgtctgtgtgctggcgcaccacttcggtaaggagttcacgccgcccgtgcaggccgcttaccaaaaggtcgtggccggggtggccaacgcgctggcccacaagtaccac

SEQ ID NO: 250397 - DNA, 441 bp, Artificial Sequence
  Description of Artificial Sequence: Synthetic coding sequence
atggtacatctgaccccagaagagaagagcgcagtgacagctctgtggggaaaggtcaacgtcgacgaggtgggtggcgaagctctgggacgtctgcttgtcgtctacccctggacccaacggttctttgaaagtttcggcgatttgtccactcccgacgctgttatgggaaaccccaaggttaaagctcatggcaagaaggtgctgggcgccttcagcgacgggctcgcccacttagacaatctgaaaggaactttcgccactctgagtgaacttcattgtgataaacttcatgtggatcctgaaaattttaggcttttaggcaacgttcttgtgtgtgtgctcgcacaccatttcggaaaggaattcaccccgcctgtgcaagcagcatatcagaaggttgtagctggtgtggcaaatgctctggcgcacaagtatcac

SEQ ID NO: 250398 - DNA, 441 bp, Artificial Sequence
  Description of Artificial Sequence: Synthetic coding sequence
atggtgcatttgacacctgaggaaaaaagcgcagtcacagcattgtggggaaaagtgaacgttgatgaagtaggcggcgaagcattgggaagacttctagttgtatatccgtggacacaacgattctttgaatctttcggggatctttcaaccccggatgcggtcatgggcaatccgaaagtcaaagcccatgggaagaaggttctgggagcttttagcgacggtctggcgcatttggataacttgaagggcacgtttgccacattgtccgaattgcactgcgacaaattgcatgtcgatcccgagaatttccgtttattaggaaatgtccttgtgtgcgttttggctcatcattttggcaaagagttcacgcctccagtgcaggctgcttaccaaaaagttgttgctggagtagctaatgctctagcgcataaataccat

SEQ ID NO: 250399 - DNA, 441 bp, Artificial Sequence
  Description of Artificial Sequence: Synthetic coding sequence
atggtgcatttgacacccgaagagaagagcgctgtaacagcattgtggggcaaagtaaacgttgacgaggtcggcggggaggccctgggaagactcctcgtggtgtatccttggacccagcgcttttttgagtcgttcggtgacctttctacaccagacgccgttatggggaaccccaaggtgaaagctcacggcaagaaagtgctaggtgcattttctgacgggctggcacaccttgacaacctgaagggaacctttgcgaccctgtcggagcttcattgtgacaaactgcatgtcgatccggaaaatttccgcttgctgggcaatgtgcttgtctgcgtgctggcacatcatttcggaaaggaatttacgccaccagtacaggcggcgtatcagaaggtcgtcgccggtgtggcaaacgcccttgcacataaatatcac

SEQ ID NO: 250400 - DNA, 441 bp, Artificial Sequence
  Description of Artificial Sequence: Synthetic coding sequence
atggtacacttgactcctgaggaaaaatcagccgtgaccgctctctgggggaaggtgaacgtggacgaggtgggcggagaggctcttggtaggctcctcgtcgtgtatccttggacacaacgcttctttgagagtttcggcgatctctctacccccgacgctgtgatgggcaaccccaaggttaaagcccacggaaagaaagtgcttggggccttctctgacggcctggcacacctggataatcttaaggggacttttgccactctgtccgagctgcactgtgacaagctgcatgttgatcccgagaatttcagattgctgggtaatgtgctggtgtgcgtgctggcccaccatttcggcaaggagttcacccctccagtgcaggcagcatatcagaaagtggtagccggtgtggcaaacgcgctggcccacaagtatcac

SEQ ID NO: 250401 - DNA, 441 bp, Artificial Sequence
  Description of Artificial Sequence: Synthetic coding sequence
atggtgcaccttacccccgaggaaaagtccgccgtgaccgcactgtggggtaaggtgaacgtggatgaagtgggtggcgaggccctgggtaggctgctggtggtctacccttggacgcagagatttttcgaatcctttggagatctcagcacccctgatgcagtgatgggaaaccccaaggtgaaagcacatgggaaaaaggtgttgggagccttctcggacgggcttgcacatcttgataacctgaagggtacctttgccacccttagcgaactgcactgtgataagttgcatgtggatccggagaattttcggcttctgggcaacgtgctggtgtgtgtgctggctcaccattttggtaaggagtttaccccgccagtccaggcggcctaccagaaagtcgtcgctggggtggcaaacgccctcgcacacaagtaccac

SEQ ID NO: 250402 - DNA, 441 bp, Artificial Sequence
  Description of Artificial Sequence: Synthetic coding sequence
atggtgcacctcactcctgaggaaaagtccgcggtgaccgcgctgtggggtaaggtgaatgtggatgaggtgggaggcgaagccctgggtcggctgctggtcgtgtacccctggacccaacgcttcttcgaatctttcggggacctgtccaccccggatgctgtcatgggaaaccctaaggtgaaagcacacggcaaaaaggtgctcggagctttttcggacgggctcgcccatcttgacaatcttaagggcaccttcgctacgctgtcggaactgcattgcgataaactgcatgttgacccggagaactttaggctgctcggcaacgtgctcgtgtgtgtgttggcccaccactttggaaaggagttcaccccgcctgtgcaggccgcataccaaaaagtcgtggctggagtggccaacgccctggcccataagtatcat

SEQ ID NO: 250403 - DNA, 441 bp, Artificial Sequence
  Description of Artificial Sequence: Synthetic coding sequence
atggttcacctgacccccgaggaaaaatccgcagtcacggccttatggggaaaggtaaacgtagatgaagtgggaggtgaggcattgggtagactactggtggtttacccatggacccagcgctttttcgagtccttcggggacctgtcgacccctgacgccgtgatgggtaatcccaaggtcaaggcccatgggaagaaagtgcttggggctttctcagacggattagcccatctcgataatctaaagggtacatttgctaccctttctgagttgcactgtgacaaattgcacgtggaccccgagaatttccggctgcttggaaatgtcctcgtgtgcgttctggcccaccattttggcaaggagtttacgccacctgttcaagctgcgtaccagaaagtggtggccggcgtcgcaaacgcactcgcacataagtaccac

SEQ ID NO: 250404 - DNA, 441 bp, Artificial Sequence
  Description of Artificial Sequence: Synthetic coding sequence
atggtccatcttacccctgaagaaaagtccgcggtcacggctctgtgggggaaggtgaacgtggatgaagtcggaggagaagcactgggccgccttctggtggtctacccgtggacgcaacgcttttttgagagctttggagacttgtcaacccccgacgcggtcatgggcaaccctaaagtgaaagcccatggtaaaaaggtgctcggagcattctcggacgggcttgcacacctggacaatctgaaaggaaccttcgcaaccctcagcgaactgcactgcgacaagctgcacgtcgatcctgaaaactttcgacttctcggtaacgtgctggtgtgcgtgctggcacatcatttcggaaaagagtttactccaccggtgcaggcagcatatcaaaaagtcgtggcaggtgtggccaatgcactcgcacataagtaccat

SEQ ID NO: 250405 - DNA, 441 bp, Artificial Sequence
  Description of Artificial Sequence: Synthetic coding sequence
atggtgcatctgactcctgaggagaaatccgcggtgacggcgctgtggggtaaggtgaacgtggatgaggttggcggtgaagccctggggcgcctccttgtcgtgtatccttggacccagcgcttcttcgagtctttcggggatcttagtacgccagacgcagtgatggggaatcctaaagttaaagctcatgggaaaaaagtactgggtgccttcagcgatgggttggcgcatctcgacaacctgaagggaacattcgctaccttatccgaattgcactgtgacaaactgcatgtggacccagagaattttcgtctcctgggtaatgtcctggtgtgtgtgttggcccatcactttggaaaggaattcaccccgccagttcaagctgcataccagaaggtcgtagctggagtagccaacgcattggcgcataagtatcac

SEQ ID NO: 250406 - DNA, 441 bp, Artificial Sequence
  Description of Artificial Sequence: Synthetic coding sequence
atggtccacctgacgccagaggagaagtctgccgttaccgcgctgtggggcaaggttaatgttgacgaagtcggaggcgaagcgctcgggcggctgctggttgtgtatccttggactcaacgctttttcgagtcattcggggatctgtccacaccggatgcggtcatgggtaacccaaaggtcaaagcccacggtaagaaggttctgggcgccttcagcgacggcctagctcacctggacaacctaaagggaactttcgcaacactgtcagagctgcactgcgacaaactgcacgtcgatccggaaaacttccggctcctgggtaacgtcctggtctgtgtgcttgcgcaccattttggaaaggagtttactccaccagtgcaagctgcctatcagaaagtggtggctggggtggctaatgcgttggctcacaagtaccat

SEQ ID NO: 250407 - DNA, 441 bp, Artificial Sequence
  Description of Artificial Sequence: Synthetic coding sequence
atggtacatctaacaccggaggagaagtctgcggtcacagctctgtgggggaaagtgaatgtggatgaagttgggggggaagccctggggaggctgctggtggtgtacccatggacacagaggttcttcgaatcctttggtgacctgtccacccctgatgcggtgatggggaatccaaaggtgaaggcccatgggaagaaagtgctcggtgccttcagcgacggactagcacatcttgataatctgaagggaaccttcgctacactaagtgagcttcactgtgataagctccacgtcgaccccgaaaacttccggctcctcggaaacgtattggtatgtgtacttgctcaccatttcggaaaggaattcactccacccgtgcaggctgcctaccagaaggtggtcgccggagtggctaacgcccttgcgcacaaatatcat

SEQ ID NO: 250408 - DNA, 441 bp, Artificial Sequence
  Description of Artificial Sequence: Synthetic coding sequence
atggtgcacctgacccccgaggagaagtcagctgtgacggcgctgtggggtaaggtgaatgtcgacgaagtgggcggcgaagcactcggacggttgctcgtggtgtacccttggacccagagattcttcgagtccttcggtgacctcagcaccccagacgcggtgatgggaaatcctaaagtgaaggcccacgggaaaaaggttctcggcgccttttcagacggcctggcacacctcgacaaccttaaaggcactttcgcgaccctgtcggagctgcattgcgataaactgcacgttgacccagagaactttcgcttgctggggaacgttctcgtgtgtgttctcgcccatcacttcggaaaggagttcacgccacctgtccaggcggcctaccaaaaggtcgtcgccggcgtcgctaatgcactggcccataagtaccat

SEQ ID NO: 250409 - DNA, 441 bp, Artificial Sequence
  Description of Artificial Sequence: Synthetic coding sequence
atggttcacttgactcccgaagaaaagtccgcagtcaccgccttgtgggggaaggtcaatgtagatgaggttgggggggaggctctcggacgactgctggtcgtttatccgtggactcagaggtttttcgaaagcttcggtgatctgagcactcccgacgctgtgatggggaaccccaaggtcaaggcacacgggaagaaagtcctgggagccttttcagacgggctggcccacctcgacaacctgaagggcacctttgccacactgtcagagttgcactgcgacaaactccatgtggaccccgaaaatttccgtcttctcggcaacgtgttggtttgcgtgcttgctcaccactttggaaaggaatttacacctcctgtacaggctgcctaccagaaagttgtggccggcgttgcgaacgcactggcgcataaataccac

SEQ ID NO: 250410 - DNA, 441 bp, Artificial Sequence
  Description of Artificial Sequence: Synthetic coding sequence
atggtacatttaacgccggaagaaaaatcggcggttacggcgctatggggtaaagtaaatgtagatgaagtaggtggtgaagcgctaggtcgattattagttgtatatccgtggacgcaacgtttttttgaatcgtttggtgatttatcgacgccggatgcggttatgggtaatccgaaagtaaaagcgcatggtaaaaaagtactaggtgcgttttcggatggtttagcgcatctagataatttaaaaggtacgtttgcgacgttatcggaattacattgtgataaattacatgtagatccggaaaattttcgtttattaggtaatgtattagtatgtgttttagcgcatcattttggtaaagaatttacgccgccggtacaagcggcgtatcaaaaagttgtagcgggtgtagcgaatgcgttagcgcataaatatcat

SEQ ID NO: 250411 - DNA, 441 bp, Artificial Sequence
  Description of Artificial Sequence: Synthetic coding sequence
atggtgcatttgactcccgaggagaagtctgcagttaccgcactctggggcaaggtcaacgtcgacgaggtgggcggagaggcccttggtagactcctggtggtgtacccatggacacagagatttttcgagtcttttggggatctgagcacacctgacgccgttatggggaaccctaaggttaaggcacacggaaaaaaagtgctgggagcattcagcgatggactcgctcacctggacaatctgaagggtacgtttgcaaccctcagcgaactgcattgcgataagctgcatgtggacccggagaatttcagactgctcgggaatgtattggtgtgcgtcctggcccaccatttcggcaaggaattcactcctcccgtccaggctgcttatcagaaggtcgtggcgggagtcgccaacgccctggcccataagtaccat

SEQ ID NO: 250412 - DNA, 441 bp, Artificial Sequence
  Description of Artificial Sequence: Synthetic coding sequence
atggtgcacctgacccccgaggagaaaagcgcagtgaccgcactctggggtaaagtgaacgtcgacgaggtcggtggcgaggcactcggcagactgctcgtggtgtacccgtggacccaaaggttctttgagtcgttcggcgacctctctacgccggacgccgtgatgggaaacccgaaggtgaaagcccatggaaaaaaggtcctcggagccttctcagatggcctggcccatttggacaacttgaaggggacttttgccactctgagcgaactgcactgcgataagctgcatgtggacccagaaaacttcaggcttctgggcaacgtccttgtgtgcgttctcgcgcaccattttgggaaggagtttactccacctgtccaagctgcctatcagaaggtggtggcgggagtggccaatgcgttggcgcacaagtaccac

SEQ ID NO: 250413 - DNA, 441 bp, Artificial Sequence
  Description of Artificial Sequence: Synthetic coding sequence
atggtgcatctgactcctgaagaaaaatccgcggtgaccgcactttggggtaaagttaacgtcgacgaagtgggcggggaagcactgggacgtctccttgttgtgtacccatggactcaacgcttctttgaatcctttggggatctgtcaactccggacgcagtcatgggaaaccccaaggtgaaagcacatggtaaaaaggtgctgggcgcattttcagacggactggcacacctggataaccttaaaggaacctttgcgactctgtcggaactgcactgcgataagctgcatgtggacccagaaaactttcgtcttttgggaaatgtccttgtgtgtgtgcttgcccatcacttcggtaaggagttcacccctcctgtgcaggcagcctaccaaaaagtcgtggcaggagtcgcgaatgccctggcacataagtaccat

SEQ ID NO: 250414 - DNA, 441 bp, Artificial Sequence
  Description of Artificial Sequence: Synthetic coding sequence
atggtgcacctgacaccggaagaaaagagtgctgtgacggccctgtggggaaaggtgaacgtggatgaagttggaggtgaagcactcggtagactcttggtggtatatccctggacccagagattttttgagagctttggtgacctgagtacacccgatgccgtaatgggaaaccccaaagtgaaggcccatgggaaaaaggtgctgggggctttctctgatggtctggctcacctcgataatctgaaggggactttcgctacactgtccgagctgcactgtgacaagctgcatgtagatccagagaattttaggctgcttggcaacgtcctggtctgcgtgctagcccaccactttggaaaggagttcacaccgcctgttcaggctgcctaccaaaaagtagtggcgggcgtggcgaatgcgctggcacataaataccac

SEQ ID NO: 250415 - DNA, 441 bp, Artificial Sequence
  Description of Artificial Sequence: Synthetic coding sequence
atggtgcatttgacccctgaggaaaaatctgcggtaaccgctctatggggcaaagttaacgtcgatgaagttgggggggaagctctgggaagacttctggttgtttatccgtggactcagcgtttctttgagagttttggagatctgagtaccccagacgctgtgatgggtaacccaaaagtaaaagctcatggaaagaaggttttgggagccttctcagatgggttggctcatctggataatttgaagggtacctttgccacactgtctgagcttcattgtgataagcttcatgttgatcctgaaaattttagactcttgggtaatgtcttagtttgcgttctcgctcaccattttgggaaggagttcacacctccggttcaagccgcctatcaaaaggttgttgctggggtggctaacgctttagcgcataagtaccat

SEQ ID NO: 250416 - DNA, 441 bp, Artificial Sequence
  Description of Artificial Sequence: Synthetic coding sequence
atggtgcatctgactcccgaggaaaagtcagccgtgactgcactgtggggtaaagtgaatgtggacgaagtgggaggagaggcactgggcaggctgcttgtggtgtatccatggactcaaaggtttttcgagagcttcggagatctgtcgactccggatgctgtgatggggaaccctaaagtgaaagcccatggaaagaaggtgctcggagcattttcggacggacttgcccaccttgacaacctgaagggtacctttgccaccctctcggagctgcactgcgacaagctgcatgtcgatcctgagaactttcgccttctgggtaacgttttggtctgtgtcctggcccatcatttcggcaaggagtttaccccacctgtgcaagcagcgtaccagaaggtcgtggcaggagtcgcaaatgctctggcgcataagtaccac

SEQ ID NO: 250417 - DNA, 441 bp, Artificial Sequence
  Description of Artificial Sequence: Synthetic coding sequence
atggtgcatttgactcccgaagagaaatccgcagttacagccctctggggcaaagtcaacgtggacgaggtcggaggggaggcgttgggacggctgttggtcgtgtacccgtggacacagcggttctttgagagctttggggacctttcgacgcctgacgcagtgatgggcaacccgaaggtaaaagcccacgggaagaaagtgctgggggccttttccgatggcctggcacacctagataacctgaagggaacatttgcgacgctgtctgaattgcattgcgacaaacttcacgtagatccagagaatttccgactgttgggcaacgtgctcgtctgtgtgctggcccatcatttcggaaaagaatttaccccacccgttcaggccgcctatcagaaagtggtagctggtgtggccaatgccctagctcacaaataccat

SEQ ID NO: 250418 - DNA, 441 bp, Artificial Sequence
  Description of Artificial Sequence: Synthetic coding sequence
atggtgcatctgactccggaggaaaagagtgcagttactgctttatgggggaaagttaacgtagacgaagtgggcggggaagcattggggcgcctgttagttgtttatccatggacacaacggttttttgaatcattcggagatttaagcacgccggatgctgttatgggaaatccaaaagttaaagcacacggaaagaaggttttgggtgctttctcagatggattggctcacctggacaatttgaagggaactttcgcaaccctttccgaattgcattgtgacaagctgcatgtagatccagagaactttagattgctggggaacgttttagtttgtgttcttgcccatcatttcggaaaagagttcacacctccagttcaagctgcatatcaaaaagttgttgccggtgtcgccaatgcacttgcacacaagtatcac

SEQ ID NO: 250419 - DNA, 441 bp, Artificial Sequence
  Description of Artificial Sequence: Synthetic coding sequence
atggtgcatctgacccctgaggaaaagtcagccgtcacggcattgtggggaaaggtgaacgtcgacgaagtgggcggcgaggcccttggacgccttttggtggtgtacccatggacccaaagattcttcgaatcttttggggatctgtccactcccgatgcagtgatgggtaatccaaaagtgaaggcacatggcaaaaaggtgcttggtgccttttccgacgggctggcacacctcgataatctcaaaggaacttttgcaactctctcggaacttcactgtgataagctccatgtcgaccctgagaatttcaggctccttggtaatgtcctcgtctgtgtgcttgcccaccattttggaaaggaattcactcccccagtgcaggcagcataccagaaagttgtcgcaggtgtggctaatgcattggcacacaaataccac

SEQ ID NO: 250420 - DNA, 441 bp, Artificial Sequence
  Description of Artificial Sequence: Synthetic coding sequence
atggtgcatttaacgcccgaagaaaaatctgccgtgacagctctatgggggaaggtcaacgtcgacgaagttgggggggaagccctggggcgcttgcttgtcgtgtatccttggactcaaaggtttttcgaatccttcggggatttgtctactcctgatgcagtgatggggaatccaaaagtaaaagcacacggaaaaaaagtgttaggggcgttctccgatggacttgcacatctggacaacctgaaaggaactttcgccactctttcagaactccactgcgataaattacacgtcgatcccgaaaactttcgactgctgggaaatgtgcttgtgtgcgtccttgcacaccactttggaaaagaatttacacctcctgtacaggctgcctatcagaaagttgtggccggagtggctaatgccctggctcacaagtaccac

SEQ ID NO: 250421 - DNA, 441 bp, Artificial Sequence
  Description of Artificial Sequence: Synthetic coding sequence
atggtccacctgactcccgaagaaaagtcagctgtgaccgcattgtggggtaaagttaacgtcgatgaagtgggaggggaagccttggggcggctcttggtcgtgtacccatggacacaacgcttctttgagtcctttggagacctatctactccggatgctgtgatggggaaccctaaagtgaaggctcatgggaagaaggtgctaggcgccttttcggacggcctggcgcacctagataatctgaaaggcacctttgcgaccctttccgagctccactgtgataagctgcacgttgatcccgagaattttcgtttgctgggcaatgtccttgtgtgcgtgttagcacaccattttgggaaggagtttacgccacctgtccaagcagcataccaaaaagtcgtagctggcgtggctaacgcgcttgcacacaaataccat

SEQ ID NO: 250422 - DNA, 441 bp, Artificial Sequence
  Description of Artificial Sequence: Synthetic coding sequence
atggtgcatctcactcccgaggaaaagtctgcagtgaccgctctgtggggaaaagtgaacgtggacgaagtgggaggagaggctttggggcgtctcctggtggtgtacccttggacccagcgatttttcgaatcgtttggtgatctttccacccctgatgcagtgatgggaaatcctaaggtcaaggcccatggaaaaaaggtcctcggagcattttccgatggactggctcacctggataacctcaaaggcacttttgccactctgtccgaacttcattgcgataagttgcatgtggacccggagaactttcgcctgctgggaaacgtccttgtgtgtgtcctggcccaccactttggtaaggagtttacgcctcccgtgcaagccgcgtaccagaaggttgtggcaggtgtggcgaacgcgctcgcacataagtaccat

SEQ ID NO: 250423 - DNA, 441 bp, Artificial Sequence
  Description of Artificial Sequence: Synthetic coding sequence
atggtgcatctcacccccgaagagaagtcagccgtgactgctctgtggggtaaagtcaacgtggacgaagtcggtggagaagcacttggacgcttgctggtggtttacccgtggacgcagcgattcttcgaatcctttggtgatctttcgactcccgacgcggtcatgggcaatcctaaggtcaaagcacacggaaaaaaggtgcttggagccttttcggatggcctcgctcatcttgataacttgaaaggaacgtttgcgaccctgagcgaactccattgtgataagctgcatgttgacccagagaattttcggcttctcgggaacgtactggtgtgcgttttggcacaccacttcggcaaggaatttacccctccagtgcaagcagcttaccaaaaggtagtggcaggagtggcgaatgccctcgcccacaaataccat

SEQ ID NO: 250424 - DNA, 441 bp, Artificial Sequence
  Description of Artificial Sequence: Synthetic coding sequence
atggttcacttgacccccgaagaaaagtccgctgttaccgctctctggggtaaggtcaacgtcgatgaagtgggaggagaagctctgggtcggttgctcgttgtctatccctggacccagcgtttcttcgagtctttcggtgatctgtcgactcctgatgctgtgatgggtaatccaaaggtgaaagctcacggaaagaaagtgctgggcgccttttcagatggcctggcccatctcgacaacttgaaggggaccttcgcaacactctccgagctgcactgtgataaattgcatgtggaccctgagaacttccggcttctcgggaatgtcctggtatgtgttttggctcaccacttcggaaaggaattcaccccccccgtacaagctgcgtaccaaaaagttgttgcaggcgtcgccaacgctctggctcacaagtatcat

SEQ ID NO: 250425 - DNA, 441 bp, Artificial Sequence
  Description of Artificial Sequence: Synthetic coding sequence
atggtccatctcaccccggaagagaagtccgcggtaaccgctctttggggaaaggtgaacgtggatgaagtgggcggagaagcactcggacggcttttggtggtctacccttggactcaaagattctttgagagctttggcgatctctcaacgccagacgcggtaatgggaaatcccaaagtgaaggcacacggtaagaaggtgctgggggcgttcagcgacggccttgcccatcttgataacctgaaaggtactttcgctaccctgtccgagctgcattgtgacaaactgcatgtggacccagagaattttcgtttgcttggcaacgttttggtttgcgtcctggcccaccatttcggaaaggaatttactcctccagtccaagcagcttaccagaaggtcgtcgcgggagtggcaaacgcacttgcacacaaataccat

SEQ ID NO: 250426 - DNA, 441 bp, Artificial Sequence
  Description of Artificial Sequence: Synthetic coding sequence
atggtacatttgaccccagaggagaagagcgcagtgaccgccctgtgggggaaggtcaatgtggacgaggtgggaggtgaggcgttgggacgcctattggttgtgtacccatggacgcagcgcttttttgaatcattcggagacctgtccacgcctgacgctgtgatggggaacccaaaggtcaaagctcatggaaagaaagtgttaggtgcatttagcgacggcttggctcatcttgacaacttgaagggaacgtttgcaacgctgtctgagttacattgcgataagctacacgtagaccctgaaaattttcgcttactcggcaacgtccttgtgtgcgtgctagctcaccactttgggaaggagttcacacctcccgtgcaagccgcataccagaaagtggtggctggtgtggccaacgcgctggcacacaagtaccat

SEQ ID NO: 250427 - DNA, 441 bp, Artificial Sequence
  Description of Artificial Sequence: Synthetic coding sequence
atggtccacttgacgccagaggagaagagcgctgtgaccgcactatggggcaaggtaaacgttgacgaggtgggaggagaggccctgggacggctcttggtcgtatatccttggactcagcgattcttcgagtcattcggtgaccttagtactccagacgcagttatggggaatcccaaggtgaaggctcacggaaagaaggtgctgggggcctttagtgatggtttagctcacctggacaacctgaagggtacgttcgcaacactttccgaattacactgtgacaagctgcatgtcgatcctgagaactttcgactgctaggcaatgtacttgtctgtgtcctggctcatcactttgggaaagaatttaccccccctgttcaggcagcctaccaaaaagtggtggccggagttgctaacgcattggcacataagtaccac

SEQ ID NO: 250428 - DNA, 441 bp, Artificial Sequence
  Description of Artificial Sequence: Synthetic coding sequence
atggtgcacctgactccggaggagaagagcgccgtgacagctctttggggtaaggtaaacgttgacgaggtcggcggcgaggcccttggaaggctcctggtcgtgtatccctggacccagcggttcttcgagtcatttggcgatctctctacccccgatgcggtgatgggcaatcccaaagtgaaagcccacgggaagaaagtgcttggcgcgttttccgacggcctggcccacctggacaacttgaagggtacctttgcaacgctttctgagctgcattgtgataagctccacgtggacccagaaaattttagactgctgggtaatgtgctggtgtgtgtgttggcccaccatttcgggaaagagtttaccccccccgtacaggccgcttaccagaaggtggtcgcaggagtcgccaacgccctagcacacaagtaccat

SEQ ID NO: 250429 - DNA, 441 bp, Artificial Sequence
  Description of Artificial Sequence: Synthetic coding sequence
atggtgcatctgacacccgaggagaagagtgcagtgactgctctgtggggcaaggtgaacgtggacgaggtgggaggagaagcgcttggacggctcctcgtcgtttatccctggacacagaggtttttcgagtccttcggcgatttgtctaccccagacgccgtaatgggcaaccccaaggtgaaagcacatgggaaaaaggtcctaggtgcgttttcagatggtctcgctcatcttgataacctaaagggaacgttcgcaaccttgtcagagttgcactgtgataaacttcacgtcgacccagagaatttccgccttttgggaaatgtgctggtgtgtgtccttgcgcatcatttcggcaaagaattcaccccccccgtgcaggcggcttaccagaaggttgtcgccggagtggccaacgccttagcgcacaagtatcat

SEQ ID NO: 250430 - DNA, 441 bp, Artificial Sequence
  Description of Artificial Sequence: Synthetic coding sequence
atggtccacctgaccccagaagagaagagcgcggtcacggccctgtggggcaaggtcaacgtggatgaagtgggaggtgaagctctggggcggttgttggtggtgtacccctggacccaaagattcttcgagtcattcggtgacctgtccactccagacgccgtgatggggaaccctaaggtgaaggcgcacggaaaaaaggtgcttggagcattctcggatggactggcacatctcgacaacctgaagggaacttttgccactctctcggagctgcactgtgacaaactgcatgtggatccggaaaacttccgcctgctcggaaatgtgctcgtttgcgtgcttgcacatcactttggcaaagagttcaccccgccggttcaggcggcttaccagaaggtggtcgccggcgtcgccaatgctctcgcccataagtaccac

SEQ ID NO: 250431 - DNA, 441 bp, Artificial Sequence
  Description of Artificial Sequence: Synthetic coding sequence
atggtccacctcacgccagaagagaaatcggctgttactgcactatggggaaaggttaacgtggatgaagtgggcggcgaggctttggggagattgttggttgtttatccttggacccagaggttcttcgaatcttttggcgatctgagcaccccagatgcagtgatgggaaaccctaaagtgaaagctcacgggaaaaaagttctgggcgccttttcagacggactggctcatctagacaatcttaaaggcacctttgctacactgtcagagctgcattgtgacaaactgcatgtggatcccgaaaacttcaggctgttaggcaacgtgctggtgtgcgtgctggcccaccacttcggaaaggaattcacccctcctgtccaggccgcatatcagaaggttgttgctggggtggctaacgcgctcgcacataaataccat

SEQ ID NO: 250432 - DNA, 441 bp, Artificial Sequence
  Description of Artificial Sequence: Synthetic coding sequence
atggtgcatcttacacctgaggaaaagtccgccgtcaccgctctgtgggggaaagtgaacgtcgatgaagtaggaggagaggccctgggccgattactggttgtttacccatggactcaaagattctttgagtctttcggcgatctatcgacacccgatgctgtaatgggtaacccaaaggtgaaggcacatgggaagaaagtgctcggcgcattcagtgacggtctagctcatttggataatctaaaaggaaccttcgccacgctgagtgagttgcattgcgataaactgcacgtagatccagagaacttccggttgctcggtaatgtgttggtgtgcgtgctagctcaccacttcggaaaggagttcacccctcccgtgcaggctgcttatcaaaaggtggtggcaggcgtcgcgaacgcccttgcccacaaatatcac

SEQ ID NO: 250433 - DNA, 441 bp, Artificial Sequence
  Description of Artificial Sequence: Synthetic coding sequence
atggttcacttaacccccgaggagaagtctgcagtgacagcactgtggggaaaagtgaatgtcgatgaagttggaggagaagctctgggaaggctgctggttgtttatccatggacccagaggttctttgagtccttcggtgacttatccaccccagacgccgtgatgggaaaccccaaagtgaaggcacacgggaagaaagtgctcggagcgttttccgatgggctggcccaccttgataacctgaaaggaacattcgcaaccttgagcgaactacactgtgataaactgcacgtcgacccggagaactttcggctgttaggaaacgtacttgtttgcgtgctagcgcatcacttcgggaaagagttcacacctccagtgcaagccgcataccagaaagtggtggccggcgtggcaaacgccctggctcataagtatcac

SEQ ID NO: 250434 - DNA, 441 bp, Artificial Sequence
  Description of Artificial Sequence: Synthetic coding sequence
atggtccatctgactccagaggaaaagagcgcggtcacggccctctggggaaaggtgaacgtggatgaagtgggaggtgaagccctgggccgcctgctggtcgtgtacccctggactcagcgcttcttcgagtcgtttggagatctcagcacgccggacgcagtcatgggcaaccccaaggtcaaggcgcacgggaagaaggtgctcggggcattttcagacggactggcccatttggacaacctgaagggcacttttgccaccctgtccgaactgcactgcgataagctgcatgtcgaccctgagaacttcaggcttcttggtaatgtgcttgtgtgcgtgctggcacaccatttcggtaaggaattcaccccaccagttcaagcggcgtaccagaaggtggttgcaggggtggcaaacgcattggcccacaaataccat

SEQ ID NO: 250435 - DNA, 441 bp, Artificial Sequence
  Description of Artificial Sequence: Synthetic coding sequence
atggtacacctgactcctgaagagaagagcgcagtaacggccctttggggtaaggtcaatgtggacgaggttggcggcgaggctttgggccgcctactggtggtgtatccctggacccagcggttctttgagtcctttggagacctgagtacacctgatgctgtcatggggaacccaaaggtgaaggcacatggcaagaaagttctcggggccttcagcgacgggttggcccatttagacaatctgaagggaaccttcgccacactgtccgaactgcattgtgataagttgcatgtcgaccccgagaacttcaggctgctagggaatgtgctggtttgtgtgctggcccaccactttggtaaggagttcacgccgcctgtgcaagctgcctatcagaaggtggtcgccggggttgccaacgctcttgctcacaagtatcac

SEQ ID NO: 250436 - DNA, 441 bp, Artificial Sequence
  Description of Artificial Sequence: Synthetic coding sequence
atggtgcatttgacacctgaggaaaaaagtgcagtgaccgcactttggggaaaggtcaatgttgatgaagtgggtggcgaggcacttgggcgcctgcttgtggtgtacccttggacccagcgcttctttgaatcttttggcgacctatctacacctgacgccgtgatgggtaaccccaaggtcaaagcccacggtaagaaggtcctgggcgccttttcagatgggctcgctcatttggataacctgaagggtacattcgccaccctctctgaattgcattgcgataaactccacgtggatcctgagaatttcaggcttctcggcaacgtgctggtgtgcgtgctcgctcatcacttcggaaaggagtttactcctcccgtccaggcagcataccagaaggttgtggccggagtggctaacgctctggcacataagtatcac

SEQ ID NO: 250437 - DNA, 441 bp, Artificial Sequence; identical to SEQ ID NO: 250399
  Description of Artificial Sequence: Synthetic coding sequence

SEQ ID NO: 250438 - DNA, 441 bp, Artificial Sequence
  Description of Artificial Sequence: Synthetic coding sequence
atggtgcacctcaccccagaagagaagtcagcggtcactgctctctggggtaaagtgaatgtggatgaggtgggaggggaggcgcttggtcgcctgctggtggtgtacccatggacccaacggttcttcgagtccttcggagacttgtcgactccagacgcggtgatgggaaatccaaaagtcaaggcccacggaaagaaggtcctgggcgcatttagcgatggactggctcatctcgataacctcaagggaacctttgccacgctttctgagctccattgcgacaagctgcacgtggacccggaaaacttcagactgctgggcaacgttctggtgtgcgtgctggcccaccactttgggaaggagttcaccccgcccgtgcaagcggcctaccagaaggtcgtcgcaggagtcgcgaatgccctcgcgcacaaataccat

SEQ ID NO: 250439 - DNA, 441 bp, Artificial Sequence
  Description of Artificial Sequence: Synthetic coding sequence
atggtgcacctgacacctgaagaaaagagtgcggtaacggctctttggggtaaggtgaatgtggatgaagtcggaggcgaagccctggggaggttgctggttgtatacccttggactcaacgtttcttcgaatccttcggggatcttagcacccccgatgccgtgatgggaaaccccaaagtgaaggcccacgggaagaaggtcctcggggccttctctgatggcctggcccaccttgataacctcaagggtaccttcgccacgctcagcgaactccattgtgacaagcttcacgttgaccctgagaattttagactcctgggaaacgtactcgtgtgtgttttggcccatcacttcggcaaggagttcaccccgcccgtgcaggccgcataccagaaagtcgtcgcaggggttgccaacgcccttgctcacaagtaccac

SEQ ID NO: 250440 - DNA, 441 bp, Artificial Sequence
  Description of Artificial Sequence: Synthetic coding sequence
atggtgcacctcacaccagaagagaagagtgcagtcaccgctctctggggtaaagtgaacgtagatgaggtgggaggagaggctcttgggagactgttggtggtctatccttggactcagcgcttttttgaatctttcggtgacctatccacaccggatgccgttatgggcaacccaaaggttaaggcccatggcaagaaagtactgggagccttctccgacggcttggctcacctcgacaacctgaaaggaacctttgctacgctatctgagctgcattgtgataaactgcatgtcgaccccgagaactttcgactcttggggaatgtgctggtgtgtgtcttggcccatcacttcggcaaggagttcactcccccagtgcaggctgcctaccagaaggttgtggccggagtggcgaacgccctcgcccacaaatatcac

SEQ ID NO: 250441 - DNA, 441 bp, Artificial Sequence
  Description of Artificial Sequence: Synthetic coding sequence
atggtccacctgactccagaggaaaagtctgccgtgactgcactctgggggaaggtcaatgttgacgaagtgggtggggaagcacttggccgactgctcgtggtgtatccctggacgcaaagatttttcgagtcattcggagatctttcgacccctgatgcagtgatgggcaacccaaaggtgaaggctcacggaaaaaaggtgcttggtgcatttagcgatggtctggctcatcttgacaacttgaaagggactttcgctaccctctccgagctccactgtgataagttgcatgtcgatccggaaaactttcggcttctcggaaatgtgcttgtctgcgtcctcgcacaccatttcggaaaggaatttaccccaccggtgcaagccgcataccagaaagtggtggcgggagtggcgaacgccctggcacacaagtaccac

SEQ ID NO: 250442 - DNA, 441 bp, Artificial Sequence
  Description of Artificial Sequence: Synthetic coding sequence
atggtgcacttgactcctgaggaaaaaagcgccgttacggccctctgggggaaggtgaacgtggacgaggtcggaggagaagccctgggacgcctcctcgtggtgtacccatggacccaacggttcttcgaatcattcggcgacctgtcgactccggacgccgtcatgggcaatcctaaggtcaaggcgcatggtaagaaagtgctgggagcattcagcgatggtttggcgcatctcgataatctgaaagggactttcgcgaccttgagcgagctgcactgcgataagttgcatgtggacccggaaaacttcaggctgctggggaacgtgctggtgtgcgtcctcgcccatcatttcggcaaagagttcactccaccggtccaggcggcttaccaaaaagtggtcgccggggtcgccaacgcattggcacacaagtaccac

SEQ ID NO: 250443 - DNA, 441 bp, Artificial Sequence
  Description of Artificial Sequence: Synthetic coding sequence
atggtgcatcttacccccgaagagaagtcagctgtgaccgccctctgggggaaagtgaacgtggacgaggtggggggagaagcactgggccggctccttgtcgtttatccttggacccaaagatttttcgagtcgttcggagatctgtcaactcctgatgctgtgatgggtaatccgaaggtcaaagcacatggaaaaaaggtgcttggagcgttttcggatggattggcacacctcgacaatctcaaagggaccttcgccacgttgtccgaacttcactgtgacaagttgcatgtggatccagagaactttcgactgctgggcaacgttctcgtgtgcgtgcttgctcatcactttggaaaggaatttactcctcctgtgcaggcagcgtaccaaaaggtcgttgcaggcgtcgcgaacgcacttgcccataagtaccat

SEQ ID NO: 250444 - DNA, 441 bp, Artificial Sequence
  Description of Artificial Sequence: Synthetic coding sequence
atggtgcacttgacccctgaggaaaaaagcgccgtaactgcactctggggaaaggtgaatgtggacgaagtgggaggagaagcattgggtcggcttcttgtcgtttacccttggactcaaaggttcttcgagtcatttggagatctgtcgaccccagatgcagtcatgggtaatcctaaagtcaaggcacatgggaagaaggtcctcggtgcattttctgatggcctggcccatcttgataatcttaaaggaacctttgccaccctgtcggaacttcactgcgacaaactgcatgtggacccggaaaacttcagacttttgggcaacgtgctcgtttgtgtgctggcacatcatttcggaaaagagtttacgcccccagtgcaagccgcctaccagaaggtggtggctggggtcgcaaacgcacttgcgcacaaatatcat

SEQ ID NO: 250445 - DNA, 441 bp, Artificial Sequence
  Description of Artificial Sequence: Synthetic coding sequence
atggtgcacctcacaccagaggaaaagtccgcagtgacagcgctttgggggaaggtgaatgtggacgaggtgggtggagaggccctgggcaggctgttggtcgtgtatccttggactcagcggttctttgaatccttcggagatttatcgacacctgacgcagtgatgggaaaccccaaggtaaaggcacacggcaagaaggtgctcggcgctttctctgatggactcgcacaccttgataatctgaaggggactttcgccacactcagcgaactacattgcgacaagcttcatgtggatccagagaactttaggctactaggaaatgtgttagtctgtgtcctcgcccatcattttggcaaggagttcacaccacccgtacaggcagcataccagaaagtggttgccggggtggctaacgcactggctcataaataccac

SEQ ID NO: 250446 - DNA, 441 bp, Artificial Sequence
  Description of Artificial Sequence: Synthetic coding sequence
atggttcatctcaccccagaagaaaaatccgcggtgactgccctttggggcaaagtgaatgtagacgaggtgggtggggaagccctgggtagactcctcgtggtctacccatggacacagcgctttttcgagtctttcggagacctgtctacaccagatgctgtgatgggcaatccgaaggtgaaggcacatgggaagaaagtgctcggggccttctccgacggtcttgcccacctggacaatctgaaaggcacttttgctactctgagcgagctgcattgtgacaagctgcatgtggaccctgagaattttaggcttcttggcaacgttcttgtgtgcgtactggctcatcatttcggaaaagagtttacgccgcccgttcaggcggcatatcagaaggtggtagctggcgtggcaaatgccctggcccacaagtatcat

SEQ ID NO: 250447 - DNA, 441 bp, Artificial Sequence
  Description of Artificial Sequence: Synthetic coding sequence
atggtgcatctgactcccgaggagaagtctgcggttaccgcgctttggggcaaggttaacgtggacgaggtaggtggtgaggcgctgggcagattgctggtggtgtatccatggactcagcgcttctttgaaagttttggtgacctctccacgcccgatgctgtaatgggaaaccccaaagtaaaagcccacggaaaaaaggtgctgggtgccttttccgacggcttggcccatctggataatcttaaaggtaccttcgccacgctgtcagagcttcattgcgataaactccacgtcgaccctgaaaatttcaggctgctcggcaatgtgctggtgtgcgtccttgctcaccactttggcaaggagttcacgcctcccgtccaagcagcctatcagaaggtggtcgccggtgtggccaatgcacttgcgcacaaataccat

SEQ ID NO: 250448 - DNA, 441 bp, Artificial Sequence
  Description of Artificial Sequence: Synthetic coding sequence
atggtgcatcttactccagaagagaaaagcgcagtgaccgctctctggggcaaggtgaatgtggatgaggtcgggggcgaggctctcggtcgcttgctcgtggtctacccctggacccagcgcttcttcgagtccttcggagatctctcaactcctgatgccgtgatgggcaatccgaaggtgaaagcgcacggaaaaaaggtcctgggggcattctccgatggactggcgcacctggataatctgaaaggaaccttcgcaacgctttcggagcttcactgtgataagctgcacgtcgacccggaaaacttccgcctgttggggaacgtgctggtgtgcgttctggcgcatcattttggcaaggagtttaccccgcccgtgcaagccgcataccagaaggtggtcgctggtgtcgccaatgcgctggcccacaagtaccat

SEQ ID NO: 250449 - DNA, 441 bp, Artificial Sequence
  Description of Artificial Sequence: Synthetic coding sequence
atggttcacctcaccccggaggaaaagtcggcagtgactgcgctgtggggcaaggtgaacgtggatgaggtcggaggcgaggctttgggaaggctcctggtggtttacccatggacccaacggttcttcgaatccttcggagatttgtcgaccccggacgcggtgatggggaatcctaaggtcaaggcccacgggaaaaaggtgttgggggcattttcagacggtctggcacatctcgataatctcaagggcactttcgccactctgagcgagctgcactgcgacaaacttcatgttgacccagaaaacttcagactgcttggtaacgtcctggtgtgtgtacttgcccaccatttcggaaaagaatttacgcccccggtgcaggcggcctaccagaaggtcgtcgctggagtagcgaacgccctcgctcataagtatcac

SEQ ID NO: 250450 - DNA, 441 bp, Artificial Sequence
  Description of Artificial Sequence: Synthetic coding sequence
atggtgcatctgacccctgaagagaaaagtgctgtgacagcactgtggggtaaggtcaatgtggacgaagtcgggggcgaggccctgggacgcctgttggtagtgtatccatggactcaaaggttttttgagtctttcggcgacctgtcaactcccgacgccgttatggggaatcccaaggttaaagcgcacgggaagaaagtgctcggagccttctccgatggcttggctcacctggacaatctaaagggtaccttcgcgactctgtcagaacttcactgtgacaagctgcacgtagaccccgagaactttaggttactcgggaatgtgctggtgtgcgtgctcgctcatcactttggaaaagagttcactcctcccgtccaagccgcctaccagaaggtggttgcaggggtggctaacgctctggctcacaaataccac

SEQ ID NO: 250451 - DNA, 441 bp, Artificial Sequence
  Description of Artificial Sequence: Synthetic coding sequence
atggttcacctgactccagaggaaaagtcagcagtcactgcactttgggggaaggtcaacgtagatgaggtcgggggggaggcgcttgggcgcctgttagtggtttatccttggacccagcgtttttttgagtcgtttggtgatctgtccacacccgacgccgtgatgggaaatcctaaggtgaaagcccatgggaagaaggtgctgggagccttttctgatggactcgctcacctggacaatttgaaaggaaccttcgctaccctgagcgaactgcattgcgataagctgcacgtggaccccgaaaactttcgtctgttaggtaacgtcctggtatgtgttctggctcatcatttcggaaaagaatttactcctcctgtgcaggcggcttatcagaaagtggtggccggagtcgccaacgcgctcgcccataagtatcat

SEQ ID NO: 250452 - DNA, 441 bp, Artificial Sequence
  Description of Artificial Sequence: Synthetic coding sequence
atggtgcatctgactccggaagaaaaatcagccgtgactgccctgtggggaaaagtgaacgtggacgaggtcggaggcgaagctcttggccggctgctggtggtctatccatggactcagagatttttcgaatcctttggtgacctcagcaccccggatgctgtcatgggaaatcctaaagtgaaggcgcacggaaaaaaggtgcttggggcgttttcggatgggctggcgcaccttgacaacctgaaaggaaccttcgctactctgtcagaactgcactgtgataagctgcacgtggaccccgagaactttcggctgctgggcaacgtcctggtctgcgtgctggcccatcacttcgggaaggagtttactccgccggtgcaagccgcataccagaaggtggtggcgggagtggcgaacgccctggcgcataagtaccac

SEQ ID NO: 250453 - DNA, 441 bp, Artificial Sequence
  Description of Artificial Sequence: Synthetic coding sequence
atggtccacctcacccccgaggaaaagagcgcagtcaccgccctttgggggaaggtgaacgttgacgaagttggcggcgaggccctgggaaggttgttagtggtgtacccctggactcagcgttttttcgagagtttcggcgacttgagtacacccgatgcggttatgggaaacccgaaagtcaaagcccatggaaagaaagtcctcggggcattttccgatggccttgcccacctggataaccttaaaggcacattcgcaacactgagtgagcttcattgtgataagctgcacgttgaccccgaaaactttcgtctgctgggcaacgtacttgtctgtgtgctggctcatcactttggtaaggagttcacccctcccgttcaagccgcatatcagaaggtcgtagccggtgtggcaaacgcattagcacataaataccac

SEQ ID NO: 250454 - DNA, 441 bp, Artificial Sequence
  Description of Artificial Sequence: Synthetic coding sequence
atggtgcacctcacccctgaagagaagagcgctgtgaccgcattatggggtaaggttaatgtcgatgaagtcggcggtgaagctcttggccggctgctggtcgtgtatccctggacacaacgattcttcgaatcattcggagacctgtcaacccccgacgctgtcatgggcaacccgaaggtgaaagcccacggcaagaaggtcctgggggccttctcggacgggctagcgcatctggacaaccttaaaggaacattcgcaactttgtccgaactgcactgcgacaagctgcacgtcgaccccgagaacttccggctcctagggaatgttttagtgtgtgtgctggcacatcacttcggtaaagaattcaccccccccgttcaagctgcttaccagaaagttgtcgcgggagttgccaacgcgcttgcccataaataccac

SEQ ID NO: 250455 - DNA, 441 bp, Artificial Sequence
  Description of Artificial Sequence: Synthetic coding sequence
atggtccatctgacgcctgaggaaaagtcagcagtgactgcgctctggggtaaggtgaacgtcgacgaggtcgggggagaggctctggggcgccttcttgtggtgtacccttggacccagcgcttctttgaatcgtttggcgatcttagcaccccagacgccgtgatggggaatcccaaggtaaaggcacacggtaaaaaggtcctgggtgccttttcggacggactggcccaccttgataacctgaagggaacttttgcaactttgagcgagctgcattgtgataaactgcacgtggatcctgagaacttccggctgctgggtaatgtcctcgtctgcgtcctcgctcatcattttggtaaggagtttacgcctcctgtgcaggcggcctaccaaaaggttgtggcaggtgtggcgaacgcacttgcccataagtaccac

SEQ ID NO: 250456 - DNA, 441 bp, Artificial Sequence
  Description of Artificial Sequence: Synthetic coding sequence
atggtgcaccttactcccgaagagaaaagtgcggtgaccgcactgtggggaaaagtcaacgtggacgaggtcggtggtgaagcactgggacggctccttgtcgtgtatccatggacccaaagattctttgagtcgttcggtgatttgtcgaccccagatgcagtgatgggcaatcctaaggttaaagcgcatggcaagaaggtcttgggagccttttccgatggcctcgcccatctggataacctgaagggtacttttgcaactctgtcagaacttcactgcgacaagttgcatgtcgatccagaaaacttccgcctgcttggcaacgttctggtgtgtgttttggcgcatcattttgggaaggagtttacgcctcctgtccaagccgcataccagaaggtggtagctggggtggcaaatgcactcgcacataagtaccac

SEQ ID NO: 250457 - DNA, 441 bp, Artificial Sequence
  Description of Artificial Sequence: Synthetic coding sequence
atggtccaccttactccggaggagaaatcggctgtgaccgccctgtggggcaaggtgaacgtggacgaagttgggggagaagccctgggacggctgctggtcgtgtacccatggactcagcggttctttgagagctttggcgacctttccactcccgacgctgtcatgggaaacccgaaggtcaaggctcacggcaagaaagtgctgggagctttctcggacggactggcgcatctcgataatctcaaggggacctttgcgactctcagcgaacttcactgtgacaagctccacgtcgacccagaaaactttagactcctggggaacgtgctcgtctgcgtcctggcccatcacttcggaaaggagttcactccgcccgtccaggcggcctaccaaaaggtggtggccggagtggccaacgcactggcgcacaaatatcac

SEQ ID NO: 250458 - DNA, 441 bp, Artificial Sequence
  Description of Artificial Sequence: Synthetic coding sequence
atggtccacttgaccccagaggagaagagcgccgtcactgccctgtggggcaaggtgaatgtggacgaagttggcggagaagcgttggggcggctcctggtggtgtacccatggactcaaagattcttcgagtcctttggagacttgtcaactccggatgcggtcatgggaaacccgaaggtcaaagcacacgggaaaaaagtcctcggagcgttctcggacggcctcgcgcacctggataacctcaagggaaccttcgcgactttgagcgaacttcactgcgacaagctgcatgtggaccctgaaaacttccgactgctgggaaacgtgttggtgtgtgtgcttgcgcatcactttggtaaggagttcaccccaccggttcaggccgcgtaccagaaggtggtggctggggttgcgaacgccctcgcccataagtaccac

SEQ ID NO: 250459 - DNA, 441 bp, Artificial Sequence
  Description of Artificial Sequence: Synthetic coding sequence
atggtgcacctgacccctgaagaaaagtcagccgttacggcgctgtggggtaaagttaacgttgacgaagtggggggagaggcacttggaagattgctcgtggtctacccttggactcaacggttttttgagtcattcggtgatttgtcgaccccggatgcggtgatgggtaatccaaaagtgaaagcccacgggaagaaggtgctgggtgctttttccgacggactggcccacctggataaccttaagggaacctttgctacgctgtcagagcttcattgtgataaactccacgtggatccagaaaacttcaggctcctgggaaacgtcctggtgtgcgtgctggcgcatcatttcggaaaggaatttactcctcctgtgcaagcagcttatcagaaagtggtcgcaggtgtggcaaacgcgcttgcacataagtaccat

SEQ ID NO: 250460 - DNA, 441 bp, Artificial Sequence
  Description of Artificial Sequence: Synthetic coding sequence
atggtgcatcttacccccgaagaaaagagcgcagtgactgcactctggggaaaggtgaacgtggatgaagtcggtggagaggctctgggacggctgctggttgtgtatccatggacccaacgctttttcgagtcatttggagatcttagcactccagatgcggtgatgggaaaccccaaggtgaaggcacatgggaagaaagtccttggtgcctttagtgacggactcgcccatcttgataacttgaagggcacctttgcgacgctgtcagaactccattgtgacaagctgcacgtcgatcctgagaactttcgactgctcggtaatgtgcttgtctgtgtgcttgcacaccattttggcaaagaatttaccccaccggtacaagccgcgtaccagaaggtcgtggcgggggtcgcgaacgctctggcacacaaataccac

SEQ ID NO: 250461 - DNA, 441 bp, Artificial Sequence
  Description of Artificial Sequence: Synthetic coding sequence
atggttcatttaactccagaagaaaagtcagcagtcactgctttatggggaaaagttaatgttgatgaagttggaggagaggcattaggaagattattagttgtttatccttggactcaaagattttttgaaagcttcggagatttatctacaccagatgcagttatgggaaatccaaaagtaaaggctcatggaaagaaagttcttggagctttttctgatggattagctcatttagacaatcttaaaggaacttttgctactttaagtgaattgcattgtgacaaattacatgttgatcctgaaaattttagacttttaggaaatgttttagtttgtgttttagctcatcatttcggaaaagaatttacacctccagttcaagcagcttatcaaaaagttgttgctggagtagctaatgccttagctcataaataccat

SEQ ID NO: 250462 - DNA, 1083 bp, Artificial Sequence
  Description of Artificial Sequence: Synthetic coding sequence
atgtccggcaacggaaacgccgcagcaaccgccgaggaaaactcacccaagatgcgggtgatacgcgtgggcacgcggaagagccagctggcccggatccagactgactccgtggttgcgactctcaaagctagctaccccggccttcagttcgaaatcattgcgatgtcaaccactggcgacaagattctggacaccgcgctgtcgaagatcggagaaaagtcgctgttcaccaaggagttggagcacgctctcgaaaagaatgaagtcgacctggtggtgcacagcctcaaggacctgccaaccgtcctcccaccgggattcaccatcggggccatttgtaagagggagaaccctcacgatgcagtggtgttccaccccaagtttgtgggcaagactctcgaaaccttgccggagaaatcggttgtgggaacttcaagcctgcgccgcgcggcacaactgcaaaggaaatttccacatctggagttccgttcgatcagaggaaaccttaatacgcggctgcggaagctcgacgagcagcaggaattcagcgcgatcatcctggcgactgcgggcctgcagcgcatgggttggcataaccgggtgggacagatcttgcaccccgaagagtgcatgtacgcggtcggacagggagccctcggagtggaggtccgcgcgaaggaccaggacatcttggatctcgtcggagtgctccacgatccagaaactctgttgagatgcatagctgaacgagcgttcctgcgccacctggagggcggttgttcagttccagtggctgtgcacacggctatgaaggacgggcagttgtacctgaccggcggagtgtggagcctggacggatcagattcgatccaggagactatgcaggctactatccatgtgccagcccagcacgaagatggccctgaggatgacccccaactggtggggatcaccgcacgcaatatcccgagggggccgcagctggccgcccaaaacctcggaattagcctcgcgaatctgctcctgagcaagggagccaaaaacattttggacgtggcccgccaactgaatgacgcccat

SEQ ID NO: 250463 - DNA, 1083 bp, Artificial Sequence
  Description of Artificial Sequence: Synthetic coding sequence
atgtcgggaaacggaaacgcagccgcaactgcagaagagaacagcccgaagatgagagtgatccgcgtgggcacgcgcaagtcgcagctggcaagaatccagacggactccgtggtggctaccctcaaggcgtcctacccggggctgcaattcgagatcatcgcgatgtccactaccggagacaaaatcttggacaccgccctctcaaagatcggagagaaatcgcttttcaccaaggaactcgaacatgcccttgagaaaaatgaggtcgatctcgtggtgcactccctgaaggatctcccgactgtgctgccaccaggcttcactatcggagccatttgcaagcgtgaaaacccccatgatgccgtggtgtttcacccgaagttcgtgggaaagaccttggaaacgctgccggaaaaatcagtggtgggaaccagctcgctccgccgcgctgcacagcttcaaaggaagttcccgcacctggagttccgctccattagaggaaatctgaacactaggctgagaaagctggacgaacaacaagaatttagtgcaattatcctcgctactgcggggctccagcgcatgggctggcataatagagtcggtcagattctgcatccagaagagtgcatgtacgcggtgggacagggagcgctgggcgtggaggtgcgcgctaaagatcaagatatcctggacctggtcggcgttttgcacgacccggaaaccctgctccggtgtatcgcagagagggcattcttgcggcacctcgaaggggggtgttctgttcccgtcgccgtgcacacggcaatgaaggacggtcagctgtaccttaccggcggagtttggagcctggacggatcggatagcatccaggagactatgcaggcaaccatccatgtgcctgcccagcacgaggacggacctgaggacgatcctcagctggtaggcatcactgcaaggaacatcccgcgtggaccacagctggccgctcaaaatctgggaatttctctggcgaatcttctcctttccaagggtgcgaaaaacatcttggacgtagcccggcaactcaacgatgctcac

SEQ ID NO: 250464 - DNA, 1083 bp, Artificial Sequence
  Description of Artificial Sequence: Synthetic coding sequence
atgtcaggtaatgggaacgcggcagcgaccgctgaagaaaactccccgaagatgagggtaattcgcgtcggaacccggaaatcccagctggcgcggatccagactgactccgtggttgccaccctcaaggcatcataccctggcttgcagtttgagatcatcgcaatgtccactaccggcgacaaaatcctcgacacggcgctgtcaaagataggagagaaaagcctgttcactaaagaattggaacacgcgctggagaagaatgaagtcgacctcgtggtgcattcgcttaaggacttgcctactgtcctgccgcccggttttactatcggcgccatctgcaaacgtgaaaacccacacgacgcagtggtgtttcacccgaagtttgtgggaaagacccttgaaactttgccagaaaagagcgtcgtcggaaccagcagcctgagacgggctgcccaattgcaaaggaagttcccgcatctcgaattccgctccatccggggcaacctgaacacgcggctgcgcaagttggatgaacaacaggagttctcagcgatcattctggcgaccgcaggtctgcaacgaatgggatggcataatcgcgtgggacaaattcttcacccagaggagtgcatgtacgccgtaggacagggagctctgggcgtggaagtgcgagctaaagaccaggacatcctcgacctggtgggggtcctccatgatccggagacgctcctgcgctgtatcgcagagagagcgttcctccgccatctggaggggggatgcagcgtgccagtggccgtccacactgccatgaaagatggacagctctaccttaccggaggtgtgtggtccctggacggttcagattcaatccaagagactatgcaggctactatccacgttccggctcaacacgaggacggaccggaagatgatccgcaacttgtcggaattacggcacgcaatatcccgagagggccccaattggctgcccagaatcttggaatcagtctggccaacctcctgctgtctaagggagcgaagaacatcttggacgtcgccagacagctgaatgatgctcac

SEQ ID NO: 250465 - DNA, 1083 bp, Artificial Sequence
  Description of Artificial Sequence: Synthetic coding sequence
atgagcgggaatggtaacgccgcagccactgctgaagaaaactcgcccaaaatgagagtgataagggtgggcactcgcaaaagccaactcgctcgtattcagactgattcagtggtggcaacactgaaggcaagttatccggggctgcagtttgagatcattgccatgagcaccaccggagataagattcttgatacagctctaagtaagattggtgagaagagcctgttcaccaaggaactagagcacgcactggagaagaatgaggtagacctagttgttcactcactaaaagatctcccaactgtcctgccgcccggatttactatcggagctatatgcaagcgggagaatccccacgatgctgttgtgttccaccctaagtttgtcggaaaaaccctggaaacgctgcccgaaaagagcgtggttggaacatctagcctgcgcagagcggctcagcttcaacgcaaattcccacaccttgagttcagaagcattagaggcaatctgaatacccggctccgaaaattagatgagcagcaggaattttctgctattatcctggctactgctggactgcagaggatggggtggcacaatcgagtcggccagatactccatccagaggaatgtatgtacgcagtagggcagggcgcccttggagttgaagtgcgggcgaaggatcaggatattctggacctagtaggggtgttgcacgatcccgagacccttctaagatgcatagctgaacgtgccttccttcgccatctggagggggggtgttcggtccccgtcgcagtgcacaccgcgatgaaagatggtcaattatacttaacagggggcgtgtggagtctcgacggctctgacagcattcaggagaccatgcaagccactatccatgtccccgcgcaacacgaagatggaccagaggatgatccccaactggtcggaattacagctagaaacatccctaggggaccccagctcgctgcccaaaacttaggcatatcactcgccaatctgctgttgtctaaaggtgccaagaatattctggacgtggcccggcagctgaatgatgcgcat

SEQ ID NO: 250466 - DNA, 1083 bp, Artificial Sequence
  Description of Artificial Sequence: Synthetic coding sequence
atgtcgggaaatggaaacgctgctgcaaccgccgaagaaaactcgccgaaaatgagagtgatcagagtcggaactaggaagtcccagctcgcgcgcatccaaaccgacagcgtggtggcaacgctcaaggcgtcgtacccaggattgcaattcgaaatcatcgctatgagcactactggggacaagatccttgataccgcgctgtcgaagatcggagaaaagtccctgtttactaaggaactggaacatgcactggaaaagaacgaggtggacctggtcgtccactcactgaaggacctgccgaccgtgctcccgccgggattcacgatcggggcgatctgtaaacgcgaaaatccgcatgatgccgtggtgttccacccaaagttcgttggcaaaaccctcgagactctcccagagaagtccgtcgtggggacctcatcgctcaggcgggccgcccagctgcagcgcaagtttccgcacttggaattcagatccattcggggaaacctgaatactcggctgcgcaagctggacgagcagcaggaattttctgcgatcatcctcgctaccgcgggacttcagcggatgggatggcataaccgcgtgggacaaatactgcatcctgaggaatgcatgtacgccgtgggccaaggagcgctgggtgtcgaggtgcgggccaaagatcaggatattctggatttggtgggcgtgctgcacgaccctgaaactctcctgaggtgcatcgctgagcgcgccttcctccgccaccttgagggaggttgcagtgtcccagtcgcagtgcacaccgcgatgaaagacggacaactttacctgaccggcggagtgtggagcctcgacgggagcgattccatccaagagactatgcaggccacgatccacgttcctgcacaacatgaggatggcccggaggacgacccccagttggtgggcattaccgcccggaatatccccagaggcccacagctcgccgcccagaacctgggtatttcactggccaatcttctcctgtcgaagggtgcaaaaaacatcctggacgtcgcccgacagctgaacgatgctcac

SEQ ID NO: 250467 - DNA, 1083 bp, Artificial Sequence
  Description of Artificial Sequence: Synthetic coding sequence
atgtctggaaatgggaacgccgcagctaccgccgaggagaactcacctaaaatgagagtaatccgcgtgggtaccaggaagagccaattggctcgaattcagacggattcggtggtggccacgctgaaagcctcttaccctggcctgcagttcgagattatagccatgtcaaccacgggggacaaaatcctcgacactgctctgagcaaaattggggagaagagtctgtttaccaaagagctagagcacgcattagaaaaaaacgaagtggacctggtagtgcattccctgaaagacctacctactgtgctgccgcccggttttacgattggcgcgatctgcaaacgagagaacccgcacgatgctgttgtgtttcacccaaaattcgtggggaaaaccctagagacgctgccggagaagagcgtagtgggtacctctagccttcggagagctgcgcagctgcagaggaaattcccccacctggagtttcgatcaataagaggtaatctcaacacacgactcaggaagctcgacgaacagcaggagttcagcgccatcatactcgccaccgccgggctgcagcgcatggggtggcacaatcgtgtggggcagatcttacacccagaagagtgtatgtacgctgtcggccaaggcgctttgggagtggaggtgagagctaaggatcaggacatcctcgacctagtaggggtgcttcacgatcccgaaaccttgctgagatgcatagccgaacgggcatttttacgccatttggaaggcggctgtagtgtgcccgtcgcagttcataccgccatgaaagatggtcagctgtacctgaccggtggtgtctggtccctggatggttccgacagtattcaagaaacgatgcaggctaccatccacgtccccgctcagcacgaagatggacctgaggatgacccccagttagtgggtatcaccgctcgcaatattcctcgaggccctcaactcgcagcccagaacctaggtatctccctggccaacctgctactcagcaagggcgccaaaaacatcctagacgtggcgcgccaattaaatgatgcccat

SEQ ID NO: 250468 - DNA, 1083 bp, Artificial Sequence
  Description of Artificial Sequence: Synthetic coding sequence
atgtcgggcaatggtaacgccgccgctaccgccgaggaaaattcgcctaaaatgcgtgtgatccgtgtggggaccagaaagagccagctggcacgcatccagacagactctgtggtagcgactctgaaagccagctatcctggactccaattcgagatcattgctatgagcaccacaggagacaagatccttgacacagcgctatccaaaatcggcgaaaaatcactttttactaaagagctcgagcatgctcttgaaaagaacgaggtcgacctggttgtccacagtctgaaggacctccctactgttctgccgccagggtttaccattggagctatttgtaagcgggaaaatccccatgatgccgtcgtgttccatcctaagtttgtgggcaagactctcgagacactgccagagaaatctgtagtcggaacatcttcccttcggcgcgccgctcagcttcagagaaagtttccacacctagaatttaggagtattaggggcaatcttaacactagactacggaaattggacgaacagcaggaattcagtgccatcatcttggctaccgccggactgcagcgaatgggttggcataaccgagtcggacagattctacaccccgaggaatgcatgtatgccgtcggccaaggtgctctgggggtagaagttcgcgctaaggaccaggatattctagatctagtgggcgtcctgcatgaccctgagacactgctccggtgcatcgctgaaagggccttcttgcgacacctggaggggggctgttcagtgccagtggctgtgcatacagcgatgaaggatggccagctctatcttacagggggtgtgtggtcactcgacggaagcgatagcatccaagaaacgatgcaggccactattcatgtgcctgctcagcacgaggatggtccagaagacgatccacaactggtgggcataactgcccggaatatccccaggggcccacagctcgccgctcaaaatttgggcatctctcttgccaatctactgctgtcaaaaggagcaaaaaatattctcgatgtggcccgccagctcaacgatgcgcat

SEQ ID NO: 250469 - DNA, 1083 bp, Artificial Sequence
  Description of Artificial Sequence: Synthetic coding sequence
atgtccgggaacggaaacgcagctgcaaccgccgaagaaaattcgccgaagatgagagtgattcgcgtgggtactcgaaagtctcagcttgcacgaatacaaactgactcggtggtggcaaccctcaaggcgtcctatccggggttgcaattcgagattatagcaatgtccactacgggcgataagattcttgataccgccctttccaaaatcggggaaaagagcctgtttaccaaagaattggaacacgcattggagaaaaatgaagttgatctggtggtgcattcccttaaggatctgccaactgtgcttcccccggggtttactataggagcaatttgtaagcgggagaacccgcatgacgccgtggtgtttcatccgaaatttgtgggtaagacgctggaaacccttcctgaaaagtccgtcgtgggaaccagctccttgaggcgtgcagcacaacttcagagaaagttccctcacctcgaattccgatcaatccggggtaacctcaatacccgcctgcgaaaactggatgagcagcaagaattctcagctatcattttggctacggccgggctccaacggatgggatggcacaaccgggtcggccagatccttcaccctgaagaatgcatgtacgccgtgggtcagggagctctgggagtcgaggtgcgcgccaaagaccaagacattcttgatctcgttggagtgctgcacgatccggagactcttctgagatgtattgctgagagagcgttcctgcggcatctggaaggcggctgttcggtccctgtggcagtccatactgcaatgaaggacggacagctttaccttaccggtggagtctggagccttgacgggtctgactcgattcaggagactatgcaggcaaccattcatgtgcccgcgcagcacgaggatggaccagaagatgacccccaactggtcggtattaccgcgcgcaacattccccgcggacctcaactcgcagcccagaaccttgggatatccctcgcgaacctgcttctgtcaaaaggtgccaagaacatcctggatgtggcacgccagctcaacgatgcacat

SEQ ID NO: 250470 - DNA, 1083 bp, Artificial Sequence
  Description of Artificial Sequence: Synthetic coding sequence
atgagcggtaatggtaatgccgccgctacggccgaagaaaattccccaaaaatgagagtgatccgcgtcggcaccagaaagagccagttggcaagaatacagacggattcagtggtggccactctcaaggcatcctaccccggactccagtttgagatcatcgccatgtctacaaccggcgacaaaatattggacacagcactctccaagatcggtgagaaatctcttttcacgaaagagctcgaacatgccctcgaaaaaaacgaagtcgacttggtcgtgcactcactcaaggaccttccgactgtgttgccgccgggattcaccattggagcaatctgtaagcgcgagaacccgcacgatgctgtcgttttccacccaaaattcgtaggaaaaactttggagacgttgccggaaaagtcagtagtgggtacatcttctctccgccgcgccgcacagctgcagcgcaagttcccacatttggagtttaggtccattcgcggcaatctcaacacccgcctcagaaaactggacgagcagcaagagttttccgccattattttggccactgctggtctccagcgcatgggttggcacaatcgcgtgggacagattctccatcccgaggagtgcatgtacgcagtgggtcagggagcccttggcgtagaagtcagggctaaagaccaagatatccttgacctcgtcggagtgctgcacgatcctgagacactgctcagatgtatagccgagagggcttttctgaggcacctggaaggtggctgtagcgtgccagtcgccgtgcacacggcaatgaaagacggccagctctacttgacaggaggcgtatggagcctggacggatctgattcaattcaggaaaccatgcaggccaccatccacgttcccgcccagcatgaggacggcccagaggacgaccctcagctggtcggtatcaccgcccgcaacatccctcgcggtccccagcttgcagcgcagaatctcggtatcagcctcgccaatttgctcctgtccaaaggagctaagaacatccttgacgtggccaggcaactcaatgatgctcac

SEQ ID NO: 250471 - DNA, 1083 bp, Artificial Sequence
  Description of Artificial Sequence: Synthetic coding sequence
atgagcgggaatgggaacgcagccgccacagcagaagaaaacagccccaaaatgcgcgtgatcagagtgggaactcggaagagccaactggcccggatccagaccgattccgtggttgccacacttaaagcttcatatcccggcctgcagttcgaaatcatagctatgtccaccacgggcgacaagatcctcgatacggcgctgtccaagatcggcgagaagagcctgttcaccaaggagttagagcacgctttggaaaagaacgaggtggatctagtagtccattctcttaaagacctgcccactgtactgcctcccggcttcacgatcggagcgatttgtaaacgggagaatccgcacgacgccgtagtttttcatcccaaattcgtgggcaaaactctggagacactgcccgagaaaagcgttgtcggaacaagttctctgaggcgtgctgcgcagctccagcgcaagtttccgcatcttgaatttaggtcaataaggggtaacctgaacacacgccttcggaaattggatgagcaacaggaatttagtgcgatcatcctggcgacagctggcctgcagagaatgggatggcataatcgggtgggccaaattctgcaccccgaggaatgcatgtacgctgtaggccaaggtgccctaggcgttgaagtcagggctaaagaccaggacatcctagacctggtgggggtgctgcatgatcccgaaacccttttacggtgcatcgctgaacgtgcatttctacgccaccttgagggcggatgcagtgtccctgttgccgtgcacactgctatgaaggacgggcaactctacctcaccgggggtgtgtggagtctcgacggctcggacagcattcaggagaccatgcaggccactatccatgtcccggcacaacacgaagacgggccagaggacgatccacaactggttggcatcaccgctcgcaatatccccaggggcccacaactcgctgcccagaatctcggaatttcacttgcaaacctcctcctcagtaagggtgccaagaacattcttgatgttgcccggcaactgaatgatgcacac

SEQ ID NO: 250472 - DNA, 1083 bp, Artificial Sequence
  Description of Artificial Sequence: Synthetic coding sequence
atgtcgggaaacggaaacgcggccgcaaccgcagaagagaattctccaaagatgcgagtcatcagggtgggtacgcgcaaatcgcaacttgcccgtatccagactgatagcgttgttgcaactctgaaggcaagctaccctggattgcagttcgagattattgcaatgagcaccacgggcgataagatacttgacactgccctgtccaagattggcgaaaaatccctcttcactaaggaactggaacacgcactcgaaaagaacgaagtggatctcgtcgtgcattcgttgaaggatctgcctaccgtccttccaccaggctttacgatcggagcaatctgcaagagagagaaccctcatgacgcagtcgtgtttcaccctaagtttgtcggaaaaacccttgagactcttccagagaaatccgttgtgggaaccagcagcttgagaagggccgcacagctccaaagaaagttcccgcaccttgagtttcggtcaatacgaggcaatctcaatacgcggctgagaaagctggatgagcagcaagaattctcggcgattattctggcaaccgcgggcctgcaacgtatgggttggcataatcgggtgggtcagatccttcacccggaggaatgtatgtatgcagtgggacaaggagctctgggagtcgaagtgagggctaaggaccaggacatactcgatctggtgggggtcttgcatgatcctgaaactctgctccgatgtattgcagagcgtgcatttctgcgccaccttgagggtggatgttcggtgcctgtggcagtgcataccgctatgaaagacggccagctttaccttaccggtggtgtctggtccctggatgggtctgactccatacaagaaacgatgcaagcaactattcacgttcctgcccagcatgaggacggtcccgaagatgaccctcagttggtgggtataaccgctcggaatattcccagaggtccacagcttgcggcacaaaaccttggaattagcctcgccaatctcctgctgtcgaaaggtgctaagaacatcctggacgtggcacgccaactgaacgatgcccat

SEQ ID NO: 250473 - DNA, 1083 bp, Artificial Sequence
  Description of Artificial Sequence: Synthetic coding sequence
atgtcaggcaacggcaatgctgctgcaaccgcggaggagaactcgcctaaaatgagagtgatccgagtggggacgaggaagtcacaactggcccggatccagaccgatagcgtggtggcaacccttaaggctagctacccaggccttcagtttgagatcatcgccatgagtaccaccggagacaagatcctggacactgccctctcgaaaatcggcgaaaagtcgctgtttactaaggaactcgaacatgcgctggagaaaaacgaagtggatttggttgtgcacagccttaaggacctcccaactgtcttgccgccgggattcaccatcggagcgatttgtaagagggagaatccgcatgacgcggtggtgttccatcctaagttcgttggtaagactctcgagactctgcccgaaaaatccgtggtgggaactagctccctcaggcgggccgcgcaattgcagcgcaaattcccgcatctcgaatttagatccattcgcggcaacttgaacaccagactgcgcaagctcgatgagcagcaggagttctcagccatcatcttggcaaccgcaggattgcagcggatgggctggcacaaccgcgttggtcaaatcctccaccccgaggaatgcatgtacgccgtcggacagggagccctcggagtggaggtcagagcaaaagaccaagatattcttgatctggtcggagtgctgcacgaccctgaaactcttctccgttgcatcgcggaacgtgctttcctccggcatctggaaggcggctgttccgtgccagtggccgtccatacggcaatgaaagacggccagctgtacctgactggcggggtctggtcacttgacggttcggactcgatccaggagactatgcaagcaacgattcatgtgcctgcgcaacatgaggacggtcctgaggacgatccgcagttggtcggcatcaccgccagaaacattccgaggggaccacagctggcggcgcaaaaccttggcatctccctggcgaatctgctgctttctaagggagccaagaatattctggacgtggccagacagctcaacgatgcacat

SEQ ID NO: 250474 - DNA, 1083 bp, Artificial Sequence
  Description of Artificial Sequence: Synthetic coding sequence
atgagtggcaacggtaatgcggccgctaccgccgaggagaactcgccgaagatgcgggtcatccgcgtcggcacccgtaaatcccagctggcccgcatccaaactgactccgtggtcgcgaccctaaaggcatcatacccgggtctgcagttcgagattatcgcgatgagcacgaccggcgacaagatccttgacactgcactgtccaagatcggcgagaagtcactcttcacgaaagaactcgaacatgccctggagaagaatgaggtggatcttgttgtgcactccttgaaggatcttcctaccgtcctcccgccgggtttcaccattggtgcaatatgcaaacgggagaacccgcatgatgccgtggtgttccaccccaagttcgttggcaagacgctggagactctccccgagaagagtgttgttgggacctcatctctgcgtcgcgccgcccagctccaacgcaaattcccccacctggagttccgcagcattcgcggtaatcttaacacacgcctccgaaaactggatgaacagcaggaattttcggccattatcctcgcgacagcgggccttcaacggatgggatggcacaaccgcgttggccagatcctccacccggaggagtgcatgtacgcggtcggccaaggcgcgctcggagtcgaggttcgcgcaaaggaccaggacatcttggatcttgtaggtgtgctccacgaccccgagaccctgctccgctgcatcgctgagcgtgccttccttcggcacctcgagggaggttgcagcgtcccagttgctgtccacacggcaatgaaggacggtcagctgtatctcaccggaggcgtttggtccctggatggatccgattctattcaggagaccatgcaggcgaccatccacgtgccggcgcagcacgaggatggaccggaggatgacccacagctcgtaggcatcacggctcgtaacattccgaggggtccgcagctcgccgcgcaaaacctcggtatatcattggcaaacctgctcctgtccaagggagctaagaacattcttgatgtcgctcgtcagctgaatgacgctcac

SEQ ID NO: 250475 - DNA, 1083 bp, Artificial Sequence
  Description of Artificial Sequence: Synthetic coding sequence
atgtcaggcaacggtaacgcggccgcgactgcggaagaaaatagcccaaagatgagggtgatccgcgtcggaacgcggaagtcgcaactggctcggatccaaaccgattcagtcgtggcaaccctcaaagcgtcgtaccccggactccagttcgaaatcatcgccatgtccaccactggcgataagatcttggacaccgctctgtccaaaatcggcgagaagtcattgtttaccaaggagttggaacacgccttggagaaaaacgaagttgacttggtggtgcattcgctgaaagacctccctaccgtcctcccgccaggattcacgatcggcgctatctgcaagcgggagaaccctcacgacgccgtcgtattccatccaaagttcgtaggaaaaacgctcgaaactctcccagagaagtcagtggtcggtacctcctccctgagaagagcggcccaactgcagagaaagttcccgcatctggagtttaggtcaatccgggggaacttgaataccaggctgcgaaaactggacgagcagcaggagttctcggcgattatcctcgccactgccggcctgcaacgcatgggatggcacaaccgggtgggacaaattcttcaccctgaagaatgcatgtacgcagtgggacaaggcgcactcggagtggaggtgcgcgctaaggaccaagatatcctggatctggtgggcgtgctccacgatccggaaactctgctgaggtgcatagctgaaagagcattcctccgacacttggaaggaggatgtagcgtgccggtcgccgtgcacaccgctatgaaagacggtcagctgtacctgaccggtggagtgtggtccctggatgggtcggatagcattcaggaaactatgcaggcgactatccacgtgccagcacaacatgaggatgggccggaggacgacccgcagcttgtggggattactgctcgtaatatccctcgcggtccgcagctcgcggcccagaacttgggcataagcctcgcgaatctcctgctgtctaagggtgctaagaatatactggacgttgcccgccagctgaacgacgctcat

SEQ ID NO: 250476 - DNA, 1083 bp, Artificial Sequence
  Description of Artificial Sequence: Synthetic coding sequence
atgagtggaaacggcaacgcagcggccaccgccgaagagaatagtcctaaaatgagggtgatccgtgtcggtaccaggaagtctcagctggctcgcatacaaacagatagtgtggtggctactctgaaggccagctatccaggccttcaatttgagattatagccatgagcaccaccggggataagatccttgacaccgctttgtcaaagatcggcgaaaagtctctattcactaaggaactggaacatgcacttgagaagaacgaggtggacctcgtggtgcactctttgaaggatctgcctacagtgcttcccccgggatttactattggagcaatttgtaagcgcgaaaaccctcacgatgcagtggtgtttcaccctaaattcgtgggcaaaacattagagaccttgccagaaaagagcgttgtgggcacatctagcttgaggcgcgcagctcagctccaacggaagttcccacacctagagtttcggtccatcagagggaacctgaatacccgcctgcgtaaactcgatgagcagcaggagtttagtgcaataatcttggctaccgctggactccagcggatgggatggcacaacagggttggacagatcctgcatccagaagagtgcatgtatgccgtgggacagggagcactgggggtggaagtcagagccaaagaccaggacatcctcgatctggtgggtgtcctgcatgacccagagaccctgctcaggtgcatcgctgagagggcattcctgcggcatctggaagggggctgcagcgtgcctgtggctgtccatactgctatgaaggacggccagctgtatctaaccgggggcgtatggagcctggatggatccgacagtatccaggagacaatgcaggcaactatccatgtgccagcccagcacgaggatggacctgaagatgatccacagctcgtggggattacagcaaggaatatccctaggggaccacagcttgctgcgcaaaacctggggatctcactggcaaacctgcttcttagcaaaggagctaaaaatatactggacgtcgctaggcagctgaatgacgctcac

SEQ ID NO: 250477 - DNA, 1083 bp, Artificial Sequence
  Description of Artificial Sequence: Synthetic coding sequence
atgtcgggtaatggtaatgcggcggcgacggcggaagaaaattcgccgaaaatgcgtgtaatacgagttggtacgcgaaaatcgcaattagcgcgaatacaaacggattcggtagtagcgacgctaaaagcgtcgtatccgggtttacaatttgaaataatagcgatgtcgacgacgggtgataaaatattagatacggcgttatcgaaaataggtgaaaaatcgttatttacgaaagaattagaacatgcgttagaaaaaaatgaagtagatttagtagtacattcgttaaaagatctaccgacggtattaccgccgggttttacgataggtgcgatatgtaaacgagaaaatccgcatgatgcggttgtatttcatccgaaatttgtaggtaaaacgttagaaacgttaccggaaaaatcggttgtaggtacgtcgtcgttacgacgtgcggcgcaattacaacgtaaatttccgcatttagaatttcgttcgatacgtggtaatttaaatacgcgactacgaaaattagatgaacaacaagaattttcggcgataatattagcgacggcgggtctacaacgtatgggttggcataatcgtgtaggtcaaatactacatccggaagaatgtatgtatgcggtaggtcaaggtgcgctaggtgtagaagtacgagcgaaagatcaagatatattagatttagtaggtgtattacatgatccggaaacgttattacgttgtatagcggaacgtgcgtttctacgtcatctagaaggtggttgttcggtaccggttgcggttcatacggcgatgaaagatggtcaactatatttaacgggtggtgtatggtcgttagatggttcggattcgatacaagaaacgatgcaagcgacgatacatgtaccggcgcaacatgaagatggtccggaagatgatccgcaactagtaggtataacggcgcgaaatataccgcgaggtccgcaattagcggcgcaaaatttaggtatatcgttagcgaatctattattatcgaaaggtgcgaaaaatatactagatgttgcgcgtcaactaaatgatgcgcat

SEQ ID NO: 250478 - DNA, 1083 bp, Artificial Sequence
  Description of Artificial Sequence: Synthetic coding sequence
atgagcggaaacggtaatgctgcagctacagccgaggagaattcccctaagatgcgcgtgatccgcgtgggtacacgtaagagccagctggcacgcatccaaaccgactccgttgtggcaacactcaaggcctcctaccccggtcttcaattcgaaatcatagccatgagcaccactggcgacaaaattcttgataccgctctgtctaaaattggagaaaagagcctctttacaaaggagctggagcacgccctcgagaagaatgaggtggatctcgtcgtacactccctgaaggatttgcctacagtgcttcctcccggttttaccatcggagcaatctgtaaacgtgagaacccacacgatgctgttgtgttccatcccaaattcgtgggtaagacccttgaaacactgccagagaagagtgtggtcggtaccagttctcttcgtcgtgccgcacagctgcagagaaaattccctcacctggagtttcgctcaatccgcggcaacctgaatacccgtcttcgcaagctggatgaacagcaagagttttcagctattatcttggccacagccggcctgcagaggatgggatggcacaaccgcgtgggacagattctgcaccctgaggaatgcatgtatgccgttggccaaggagctcttggcgtcgaagttagagctaaggatcaggacatcttggacctggttggcgtgttgcacgacccagagaccttgctgagatgtattgcagaaagggcattcttgcgtcacctcgagggcggttgctcagttcctgttgcagtacacaccgctatgaaggatggccagctgtatctgaccggaggagtatggtccctggacggatctgactcaatccaagaaaccatgcaggctactatccatgttcccgcacagcacgaagatggcccagaagacgacccccagctggtgggcatcactgcaagaaatattcctagaggtccacagcttgctgcacagaacctgggaatcagcttggcaaatttgttgttgtccaaaggagcaaaaaatattctggatgtggctaggcaactgaacgatgctcat

SEQ ID NO: 250479 - DNA, 1083 bp, Artificial Sequence
  Description of Artificial Sequence: Synthetic coding sequence
atgtccggtaacggtaatgcagccgcaactgcagaagaaaattcccccaagatgagggtcataagggtgggaaccaggaaatcccagctggcacgcattcagaccgatagcgtggtggcgacgctgaaggcctcctatccaggcctgcaatttgagattatcgcgatgagcactaccggtgataagatccttgacactgccctgtcaaagatcggagaaaagagtctttttacgaaggaacttgaacacgctctcgagaagaacgaagtggatcttgtggtgcattcactgaaggatcttccaaccgtcctgccgcctggcttcaccataggtgcaatctgcaagcgagaaaacccacatgatgccgtggtgtttcacccgaagtttgtggggaaaactcttgaaaccctgcctgaaaagtcagtggtgggaacgtcaagcctgcgtcgtgcagcacaactccagcgcaagttcccgcatctggaatttcgttccatacgaggtaaccttaacacgcggcttcgcaaactggatgagcaacaggaattcagcgcaatcattctggcgactgccggtctgcaacgtatgggatggcataaccgcgtgggacaaatactccaccctgaagagtgtatgtacgccgtgggacaaggggcattgggagtggaggtccgagcaaaggaccaagatattctggacctcgtcggcgtccttcatgacccagaaactctccttcggtgtatcgcagagcgcgcgttcctccggcatcttgaggggggatgttccgtccccgtcgcggtccacaccgcaatgaaagatggtcagctgtatctgactggtggggtgtggagcctcgatggctctgactcaattcaagagactatgcaagcaaccattcatgttcccgcacagcatgaggacggacctgaagatgatcctcaactggtgggcattaccgctcggaatattcctagaggcccacaattggcagctcagaacctgggtatctccctcgcaaatcttttgttgtctaaaggcgcaaaaaacattttggacgtcgcccgccagctgaatgacgctcat

SEQ ID NO: 250480 - DNA, 1083 bp, Artificial Sequence
  Description of Artificial Sequence: Synthetic coding sequence
atgtccggaaacggaaacgcggcagcaaccgccgaagagaatagcccaaagatgcgagtgatcagagtcggtacccgtaagtcgcaactggcaagaatccagactgattcggttgtggccactctcaaggcctcatacccaggtttgcagttcgaaatcatcgcaatgtccaccactggagacaagatattggatactgccctcagtaagataggagaaaagagtctctttactaaagagctcgagcacgccctcgagaaaaatgaagtagaccttgtggtccatagcttgaaggatctgcctaccgtgttgcctccgggctttaccataggcgcgatttgcaaacgcgaaaatccccacgatgctgtggtgtttcacccgaagtttgtcggcaagacgcttgaaacgcttccagaaaagtcggtggtcggtaccagctccctccggcgagcagcccagctgcagaggaagtttccacacctggaattcaggtcgataaggggcaatcttaacactagactgagaaagctcgacgagcaacaagaattttccgcgatcattctggccaccgcaggtctgcagcgcatggggtggcataatcgcgtgggtcaaattcttcatccagaagagtgcatgtacgcggtgggccaaggcgcactgggagttgaagtccgagctaaggatcaagacatccttgatctggtgggagtcctccacgatcctgaaacccttttgagatgtattgctgagcgggcattccttcggcatctcgaaggtgggtgttcggtgcccgtggcagtccacactgcaatgaaggatgggcaactctacctcaccggcggagtgtggtcacttgatggttccgacagcatccaagaaactatgcaggctaccatccatgtgcccgcccagcatgaggatggtccagaagatgatccacaacttgttggtattacggcacgaaacataccccgcggtcctcagcttgccgcacaaaacctgggcatttccctcgcaaaccttctgcttagcaagggagctaaaaacattcttgatgtcgcacgacaactgaacgacgcccat

SEQ ID NO: 250481 - DNA, 1083 bp, Artificial Sequence
  Description of Artificial Sequence: Synthetic coding sequence
atgagcggcaacgggaacgctgcggcgacggctgaagagaactccccaaagatgagagtcattagagtgggaacccgcaagtcgcagctggcaagaattcagaccgattcagtggtggccaccctgaaagccagctacccaggattgcaattcgagatcatcgccatgagcacgactggtgataagatccttgacactgccctgtcaaaaatcggggaaaagtcgctgtttaccaaagaactggagcacgcgttggaaaagaacgaagtggacttggtggtccattccctgaaggacttgccaaccgtcctgccacctggattcactatcggagcgatttgcaagcgcgaaaaccctcatgacgccgtggtgttccaccctaagttcgtcggcaagactctcgaaaccctgccggagaagagtgttgtgggcacttcctcgctgcggagagcggcccagcttcagagaaagtttccgcatctggaatttcgctcgatcagagggaacctcaacacccgcctgagaaagctggacgaacagcaagaatttagcgccatcatcctcgcgactgccggtctgcaaaggatgggatggcacaatcgggtgggtcaaatcctccacccagaggagtgcatgtacgcagtcggacaaggagccctgggagtggaagtcagagccaaggaccaggatatcctcgacctggtgggtgtgctccacgatcctgagactctgcttcgctgtatcgcagaaagggccttcttgcgacacctggagggaggatgttccgtgccggtcgctgtgcatactgccatgaaagatggccagctgtacctgacgggtggagtctggagcctggacggttccgactcgattcaggaaaccatgcaagcgactatccacgtgccagcgcagcatgaggacgggcctgaggacgatccgcaactcgttggcatcaccgcccgtaacatcccgagaggtccgcagctggccgcgcaaaacctcggcatttcgctggcaaatctcttgctctcaaagggagctaagaacatcctggacgtggctcggcagctgaatgacgcgcat

SEQ ID NO: 250482 - DNA, 1083 bp, Artificial Sequence
  Description of Artificial Sequence: Synthetic coding sequence
atgtccgggaatgggaacgcagcagctaccgcagaagaaaacagtcccaaaatgcgcgtcatccgggttggcacaaggaagtcccagctagccaggatccagaccgacagcgtggtagcaacactgaaagctagctaccccggactgcagttcgaaatcatcgcaatgagtactactggcgataaaatactggacactgctttatcaaagattggcgaaaagtccctgttcactaaggaactggaacacgcactggaaaaaaacgaagtcgacctcgttgttcatagtctaaaagatctgcctacagttctgcctccaggttttactataggcgcaatttgtaaacgtgaaaatccccacgacgccgtggtctttcaccctaagtttgtgggcaagaccttagaaacactacctgagaagtctgtggtgggcacaagcagtttaagacgggcagcccagctccagcggaagttccctcacctggagtttagatcaatacggggcaacctgaatactcgactgaggaagcttgatgagcagcaggagttttccgctatcatactcgccacagcaggactgcagagaatgggctggcataatcgcgtcggtcaaatcctgcaccctgaggagtgtatgtatgccgtgggccagggcgccctgggtgttgaagttcgcgccaaagaccaggacatactcgatctcgtcggtgtcctgcatgaccccgaaacactacttcggtgtatcgctgagcgggcattcctccgtcacctggaggggggatgcagcgtgcctgttgctgttcacaccgcaatgaaggacgggcaactgtatctgactggaggcgtctggtctctcgacggctctgatagtatccaagaaactatgcaggctacaatccacgtaccagcccagcatgaagatggccctgaagatgaccctcaactagtggggatcacagcacgtaacataccaagggggccccagctggccgcacagaatctgggcataagtcttgccaacctgctcctctccaagggtgccaagaacatcctcgatgtcgcaagacaactcaatgacgcccac

SEQ ID NO: 250483 - DNA, 1083 bp, Artificial Sequence
  Description of Artificial Sequence: Synthetic coding sequence
atgtccggcaatggaaacgccgctgcaacggcagaggaaaacagccccaaaatgcgcgtcattcgagtaggcacccgaaagagccagttggcccgtattcagaccgattctgtggttgccacattgaaagcgtcttatccgggattgcaattcgaaattatagctatgtctactactggagataaaatactggacaccgcactatctaaaatcggggagaaaagcctcttcacaaaggagctggagcatgccttggaaaaaaacgaggtggatctggtggtgcactccctaaaggacctgcctacagtgctgccacctggattcactatcggggccatatgtaaaagagagaatcctcacgacgccgtggtgttccacccaaaattcgtaggcaaaacgctcgaaacattgccggagaaatcagttgtgggaacttcgtctcttaggagagccgcgcagcttcagcgcaagttccctcatcttgagtttaggtcgatacgaggaaatctcaataccaggctgaggaagctggacgaacagcaggaattttccgccatcatcctggcaacggccggactgcagcgcatgggatggcacaatagagtgggacagattctgcaccctgaagaatgtatgtacgcagtgggacagggagcactcggcgtcgaggtgcgagcaaaggatcaagatattctggacctggtcggggtgcttcacgaccccgagaccttgctgcgctgcatcgcagagcgcgcttttttgcgtcacctggagggcggctgttcggtgccagtggccgtgcacaccgcgatgaaagatggccaactctacctcaccggaggagtatggagcctggatggaagcgatagtattcaggagacgatgcaggcgaccatacatgtaccggcccaacacgaggatggccccgaggatgacccacagcttgtaggaatcaccgcccgaaacatacctcgcggtccgcagctggcagcgcaaaatttaggcattagcctggcaaacctgctgctatccaagggagctaagaacatcctggacgtcgcgaggcagctcaatgacgcccac

SEQ ID NO: 250484 - DNA, 1083 bp, Artificial Sequence
  Description of Artificial Sequence: Synthetic coding sequence
atgtcgggcaacgggaatgcagctgctaccgcagaggagaatagcccaaagatgagagtcattcgtgttggcacccggaagtctcaactggcacggattcagacggatagtgtagtggctactcttaaggcaagctaccccgggctacaatttgaaatcatcgctatgagtacaacgggtgacaaaattctggataccgccttatccaagattggcgaaaaaagtctgtttactaaggagctggaacacgcactggaaaaaaacgaggttgacctcgtcgttcactctctgaaagatctgcccacagtgctaccacccggcttcaccattggggcaatctgtaagcgagagaacccccatgatgctgttgtgttccacccgaagtttgttggcaagacattggagacgctgcctgaaaaaagtgttgtgggaacttcctcccttcggagagccgcccagcttcagcgcaagttcccacacttggagttccggtcaataagaggcaatttaaacacgcggctcagaaagttggatgagcagcaggagttcagtgcaattattcttgcgacagccgggcttcagcgaatgggatggcataacagagtgggccagattcttcaccctgaagagtgtatgtacgcggtaggccaaggcgcccttggcgtagaggtgcgtgctaaagaccaggatatcttggatctcgtgggtgtgctacacgatccggaaacattactcagatgtatcgcagaacgagccttcctgaggcacctggagggcggctgttcagttcccgtggccgtgcacaccgccatgaaggacggtcagctctacctgacggggggcgtttggtctcttgatggaagcgactctatccaggagacaatgcaagcgactatccacgtccctgcccagcacgaggacgggccggaggatgatccccagttggtagggattaccgccaggaacatcccgcgcggtcctcagctagccgcccaaaatctgggaatttctcttgctaatctgctgttatcaaagggtgccaaaaacattttggatgtggcaagacaactgaacgatgcccac

SEQ ID NO: 250485 - DNA, 1083 bp, Artificial Sequence
  Description of Artificial Sequence: Synthetic coding sequence
atgtccgggaatgggaatgcagctgcgacggctgaagagaactctccaaagatgagggttattcgagtcggaacgcgaaaaagtcagcttgcgcggatccaaactgactcagtagtggctactcttaaggccagctacccgggactccaattcgagattatcgctatgtctaccacgggagataagatacttgatactgctctgagcaagattggcgaaaaatcgctgttcacaaaggagctggaacatgcactcgaaaagaacgaggtcgacctggtggtgcattcactcaaggatctacctacagtgttacccccaggttttacaattggggcaatatgtaaaagagagaatccccacgacgccgtagtttttcaccccaagtttgtgggcaaaacattagagaccttgccagagaaatcggtggtcgggacctccagcctgaggagagcagcgcaactccaacggaaattcccccacctggagtttagaagcataagaggcaaccttaacacacgactgcgaaagctagacgagcaacaggaattctcagctatcatcctggcaacggctggtcttcaaagaatggggtggcacaatcgcgtaggtcaaatcctccacccagaggagtgcatgtatgcagtgggccagggagcactgggagtggaagtcagggcgaaggaccaagacatccttgacctcgttggtgtgctgcatgatcctgagaccctcctgcgatgcatcgccgagcgcgcgtttctgcgtcacctggagggaggctgctcggtgcccgtggcggttcacactgccatgaaagacgggcagctgtatttgaccggaggcgtgtggtcattagatggctcggactccatccaggaaacgatgcaggctaccatccacgtgcctgcccaacatgaagatggaccagaggacgatccacagctagtgggaatcacagcgcggaatattccgcgcgggccccagcttgctgcccagaatctcgggatctcactggccaacctgctcttatccaaaggagctaaaaatatactggacgtggcccgccagttgaacgacgcacac

SEQ ID NO: 250486 - DNA, 1083 bp, Artificial Sequence
  Description of Artificial Sequence: Synthetic coding sequence
atgagcgggaacggtaatgctgcggcgaccgctgaagaaaactctcctaaaatgagggtgatccgcgttggtactcggaagagtcaactggcgcgtattcaaaccgactctgttgttgctacgctgaaagcctcctaccccggcctgcaatttgagattatcgccatgagtaccacaggcgacaagattctggatacagctttgtctaagattggcgagaagagcctgttcacgaaagaactagaacatgcgctggagaaaaatgaggttgatttggtagtgcactccctcaaagaccttccaaccgtgctgcctccagggtttacaatcggtgcaatttgcaagcgcgaaaaccctcacgacgccgtcgtgtttcatcctaaatttgttggcaagaccctggagaccctcccagaaaaaagcgtcgtggggaccagttcactgagacgcgccgcccaattgcaacgcaagttcccccacctcgagtttcggtccatacgcggtaacctaaacaccaggctcagaaagcttgacgagcagcaggagttttctgccatcatcctcgcaacggctgggcttcagagaatgggatggcataaccgggtggggcaaattcttcatccggaagaatgtatgtacgccgtagggcaaggagctctcggcgtggaagttcgcgccaaagaccaggatattttggacctagtaggtgtgcttcatgatcctgagaccttactgaggtgcattgctgaacgtgctttcttaaggcacctggaggggggctgcagcgtgccggtagcggtccacacagctatgaaggatgggcaactgtacttgactgggggcgtttggtcattggatggatcagactcaatacaagagacaatgcaggccacaattcacgtcccagcgcagcatgaggatggtcctgaagacgaccctcagctggttggtatcaccgcaagaaacatcccgagaggcccccagcttgcagcccagaacctaggaatatcgctagccaacttgttgctgtctaagggcgctaagaatattctggacgtagcccgccaattgaatgatgctcat

SEQ ID NO: 250487 - DNA, 1083 bp, Artificial Sequence
  Description of Artificial Sequence: Synthetic coding sequence
atgagtggcaacggcaatgcagctgcgaccgcagaagaaaactcacctaagatgcgagtgattcgagtcggtacaaggaaaagccaattggctagaatccagacagactctgtcgtggcgaccctcaaggcctcttaccctggcttgcaattcgagatcatcgcgatgtcaaccacaggcgacaagatcctcgatactgcgctgagtaaaatcggcgagaagagtctcttcaccaaggaactggaacacgccctggaaaaaaacgaggtggatttggtcgttcacagtctgaaagatttgccaacagtcctgccacctgggttcaccattggagcaatttgtaaaagagagaatccccatgacgctgtggtgttccaccctaagttcgtaggcaagacactggagacattgccagaaaagtccgtggtcggaacatcatcccttaggagggcggcccaattgcaacgcaagttcccccacttggagttccggtcaattcgagggaatctgaacacacgcctgaggaaactagatgagcagcaggaattctcagcgattattctagccacagccggcctacagcggatgggatggcataacagggtggggcaaatcctccaccccgaggagtgcatgtatgccgtagggcagggcgctttgggggtggaagtgcgggctaaggaccaggatatcctggacctggttggcgtgcttcatgaccccgagaccttgcttagatgcattgctgaacgagcttttctgagacacctcgaggggggctgctccgtgccagtggcggttcatacagccatgaaggacggccagctttacctcacagggggcgtgtggtctctggacggatccgattccatacaggaaaccatgcaggccactatccatgtccccgctcagcacgaagatggcccagaagatgatcctcaactcgtgggtatcaccgccaggaatattcctcggggaccgcagctagccgcccagaatcttgggatctccctcgctaatctactcctttccaagggggcaaaaaacatcttggacgtggctcgtcagctgaacgacgcccac

SEQ ID NO: 250488 - DNA, 1083 bp, Artificial Sequence
  Description of Artificial Sequence: Synthetic coding sequence
atgagcgggaatggaaacgcagcggcgaccgccgaggaaaattctccaaagatgcgcgtgatccgagtggggacaagaaaaagccagctggccaggattcagacagattccgtagtggctacgctgaaagccagctacccagggcttcagtttgaaataatcgcaatgagtacaactggggacaagatcctggacaccgctctgagtaaaataggtgagaagtcgctttttactaaagaactggaacatgcgttggagaagaacgaagtggacctggttgtacattctctgaaagatctcccaacagtactgccccccggctttacaatcggtgccatctgtaagagggagaatccacatgacgccgtcgtgtttcacccaaaattcgtcgggaaaacgctggagacactaccggaaaaatcagtcgtggggacgagctcgctacggcgtgccgcgcagttacagaggaaattcccccatctcgagttcaggtctatccgagggaatctgaataccaggttgcgaaagcttgatgagcagcaagaattctcagctatcatattagcaacagccggccttcaaaggatgggctggcacaacagggttggccagattctgcaccctgaagagtgtatgtacgccgtggggcaaggggccctcggtgtagaagtgagggcgaaggaccaggacatcctagatttagtgggggtgctgcacgatcctgaaactttactacggtgtatcgcggagcgcgcttttctgagacacttggaaggcgggtgttctgtgcctgtcgctgtccacaccgctatgaaggatggacagctgtatctcactggcggcgtctggagcctcgatggctccgactcgatccaggagactatgcaggccacaattcatgttcctgcccaacacgaggacggacccgaagatgatccgcagctcgtgggaatcacagccagaaatatccccaggggaccacaactcgccgcacagaatcttggcatctccctggccaatctgctgctgtcgaaaggagccaaaaacatcttagatgtggccagacagctgaacgacgctcac

SEQ ID NO: 250489 - DNA, 1083 bp, Artificial Sequence
  Description of Artificial Sequence: Synthetic coding sequence
atgtctggaaatggaaacgccgccgccaccgcggaggaaaactcaccaaagatgagagttatccgggtgggcacgcggaagagccagctggcgcgtatccagactgattcggtggtcgcaactctcaaagcgtcatacccgggacttcagtttgagataatcgccatgtcaacgactggagataagattctggacaccgctctgtcaaaaatcggcgaaaagtcgctgtttactaaagaactggagcacgctctcgagaaaaacgaagtcgatctcgtggtccattccctgaaggacctgccgaccgtcctcccacctgggttcacgattggggcgatttgcaagcgggaaaacccacatgacgctgtggtgttccaccctaagtttgtgggaaagactttggaaaccctccccgaaaagtccgtggtcggaacctcgtcactccgcagggcagcccaactgcaacgcaaattcccgcatctggaatttagatcgatccggggaaacttgaacactcggctgagaaaactggacgaacaacaggagttctcggccatcattctcgccactgccggtttgcaacggatgggttggcacaacagggttgggcagatcttgcacccggaggaatgcatgtacgcggtcgggcagggagccctcggagtcgaggtgcgggccaaggaccaagatatccttgacctcgtcggagtgctccatgaccctgaaacgctgctgcgctgcatcgcggagcgggctttcctccgtcacctggaaggaggctgctccgtaccggtggcggtccacaccgccatgaaagacggacaactctatctcacggggggagtgtggtcactggacgggtccgacagcatccaggagactatgcaggccaccattcacgtgccagcccagcacgaggatggaccagaggacgaccctcagctggtgggaattactgcgcggaatatcccgcgcggtccgcagctggcagcccaaaatctcgggatctcgcttgccaatctgctgttgagcaagggagcgaagaatatcctggacgtggcgcgccagctgaatgatgcacac

SEQ ID NO: 250490 - DNA, 1083 bp, Artificial Sequence
  Description of Artificial Sequence: Synthetic coding sequence
atgagtggaaacggaaatgctgcagcaacagcggaagaaaactctccaaagatgagggtgataagagtcgggaccagaaaatcacagcttgctcgaatccagaccgattccgtcgtagcaacactaaaagcgtcctacccgggactccagtttgagatcatcgcgatgtctactaccggggacaagatcctggacaccgcactaagcaagattggggagaagagcctgttcaccaaggagttggaacacgcacttgaaaagaacgaggtcgaccttgtggtccactccctgaaggatctgcccactgtcctgccgccaggatttaccatcggggcaatatgcaaacgagaaaatccccatgatgcagtagtctttcatccaaagttcgtcggcaaaacactggaaacccttccagaaaaatccgtcgtgggcacatcctcactgcgcagggcggcccaattgcagcggaagtttccccacctggaattcagatctattcgaggcaaccttaatacacgtctcagaaaattggatgaacaacaggagttctctgccattatcttggccacggccggtctccaacgaatggggtggcataacagggtcggacaaatcctgcacccagaagagtgtatgtatgctgttggccagggcgctctcggtgttgaagtgagggctaaggatcaagacatcctggatctggtcggtgttctgcatgatccggaaacgctactccgatgcatcgctgaacgagcatttttgcggcacctggaaggtggatgctccgtccctgtcgctgttcataccgcaatgaaggatgggcagctctacctgacaggcggagtttggagcttggatggctctgactccattcaagagacaatgcaggctactatccatgtccccgcacaacacgaagatggacccgaggacgatccccagctcgtaggtattactgcaagaaatattccgagggggccacagcttgccgctcagaatctcgggatctcacttgcaaacctgctcctctccaagggggccaagaacatactcgacgtagccaggcaactaaatgatgcacat

SEQ ID NO: 250491 - DNA, 1083 bp, Artificial Sequence
  Description of Artificial Sequence: Synthetic coding sequence
atgtccgggaatggcaatgccgccgccactgcagaagagaactcaccgaaaatgcgcgtcatcagggtcggaaccagaaaaagccagttggccagaatccaaactgatagcgtggtagcaactctcaaagccagctaccccggactgcagttcgagatcatcgcaatgagcactacgggggacaaaatcttggacaccgcactgtcgaaaatcggagaaaaatcactgttcactaaggagctggaacatgcactcgaaaagaatgaagtcgacctggtggtgcattcgctgaaggatctgccgaccgtgctgcctcctggtttcaccataggagcgatctgtaagagagaaaacccccatgatgcggtggtgtttcatccgaagttcgtcggaaaaaccctggagactctgccagagaaatcggtggtgggcacgtcgtcgctcaggagagccgcccaactgcagagaaagttcccccatcttgaatttcggtctatccgcggaaacctgaacactaggctccggaaattggacgaacaacaggaattctcggcgatcatcctggccaccgcaggactgcaacggatgggatggcacaatagggtgggccagatcctgcatccggaagaatgcatgtacgccgtgggccagggggccttgggggtggaggtgcgagccaaggatcaagacatcttggacttggtcggagtcctccacgacccggagacgctccttagatgtatcgccgagcgggcatttctgagacacctggaggggggctgctccgtccctgtggccgtccacaccgcgatgaaggatggacagctctacctcactggaggggtgtggtcattggacggatcggactcgatccaggaaactatgcaagcgactatccacgtgccggcccagcatgaggatggaccagaggacgacccgcaactcgtgggaattaccgcccggaacattccacgcgggccgcagctggcagctcagaatctgggcattagcctcgctaacctccttctgtcgaagggagcaaagaacatcctggatgtggcccgccagctcaacgacgcccat

SEQ ID NO: 250492 - DNA, 1083 bp, Artificial Sequence
  Description of Artificial Sequence: Synthetic coding sequence
atgagtggaaacggcaatgctgccgccacagcggaggagaactcacccaaaatgcgggtaatcagggtgggaacgagaaagagtcaactcgcacgcatccagactgactctgttgtagccacgctgaaggcctcatacccggggctgcagttcgagatcattgcaatgtctacaacaggagataaaatcctcgacacagcgctctccaagataggtgagaagtcgctcttcacgaaagaactcgagcacgctctggaaaaaaacgaagtcgacttagtggtccattcactgaaggacttgccgaccgtgctcccacctgggtttacaatcggcgccatatgcaagagggagaacccgcacgacgcggtggtcttccacccaaagtttgttggcaaaaccctcgagacccttccagaaaaaagtgttgtggggactagtagtctccgaagggccgcacagctgcagcggaaattcccacacctggagttccggtctatccgcgggaatttgaacactcgtctccggaagctagatgaacagcaagagtttagcgctataattctcgccaccgctggcctgcaaaggatgggttggcacaatagggtagggcagattctacatccagaggagtgtatgtacgctgtgggacaaggagctctgggtgtggaggtgcgcgcaaaggatcaggacatactggaccttgtgggtgttttgcatgatccagagaccctgcttcggtgcatcgcagagagagcctttcttagacacctggaggggggttgctcggtccctgtggccgtgcataccgctatgaaggacggacagttgtaccttaccgggggtgtctggtctctggatggatccgatagtatccaggagaccatgcaggccaccatccacgtgcctgcacagcatgaggatggacctgaggacgaccctcagctggtcggcatcacggcgcggaacattccacgcggccctcagcttgcggcacaaaatctggggatttctctggccaatctgctactgtccaaaggagcgaaaaatatcctcgacgtggcacgacagctaaatgacgcacac

SEQ ID NO: 250493 - DNA, 1083 bp, Artificial Sequence
  Description of Artificial Sequence: Synthetic coding sequence
atgagcggaaacggcaatgccgctgcaacagcggaggagaacagcccgaagatgcgagtcattagggtgggaactcggaaatctcagcttgctcgtattcagacagatagcgtggttgcaactttgaaagcctcatatcccggactccagttcgagatcatcgctatgagcaccactggagataagattctggacacagcgctaagcaagatcggcgaaaaaagcctgtttacaaaggagcttgagcacgccttagagaaaaatgaagttgacttagtcgtacactcactcaaggatctcccaactgtcctgcctccggggttcacgatcggcgcaatatgcaagagggaaaacccccacgatgccgtcgtgttccacccaaaattcgtgggcaaaactcttgaaactctacccgaaaaatctgtcgtgggcacatcctccctaagaagagcggcccagctccagcggaagttccctcatttggagttcagaagcattcgcggtaatctgaatacgaggttaaggaaactcgacgagcagcaagagttctctgcaatcatattggcaacggccggcttgcaacgaatgggctggcacaatcgcgtgggacagattcttcatcctgaagaatgtatgtatgctgtgggtcagggagccctcggtgtggaggtaagggcgaaggatcaagatatcctggacttggttggagtccttcacgacccagaaactctgttgcggtgcatagccgagcgtgcctttctcagacacctggagggtgggtgtagcgtaccagtagcagtgcacacagccatgaaggatgggcagctgtacctgaccggaggggtatggtctttggatggctcggactccattcaggagaccatgcaggccacaatccatgttccggctcagcacgaggacgggcctgaagacgacccccagctcgtcggtatcaccgctaggaatattcctaggggacctcagctggccgcccagaacctgggcatcagtctcgccaacctactgctctctaaaggggcaaagaatatcctggacgtcgccagacaactaaacgacgcgcat

SEQ ID NO: 250494 - DNA, 1083 bp, Artificial Sequence
  Description of Artificial Sequence: Synthetic coding sequence
atgagcggaaacggaaatgccgcagcgacggccgaagaaaactccccgaagatgcgggtgattagagtgggaacccgtaagtcacagctggccaggatccaaaccgacagcgtggtggctactttgaaagcctcctaccccgggctgcaattcgagatcatcgcaatgtcgactactggagacaagatcctggataccgcattgtcgaagatcggtgaaaaatcgctgttcaccaaagagctcgaacacgcgctggagaaaaacgaagtagatctcgtggttcactcactgaaggacctgccaactgtcctgccgccagggttcactattggcgctatttgtaagcgcgaaaatccgcacgatgccgtcgtgttccacccaaagttcgtcggcaagaccttggaaaccctcccagagaagtccgtggtggggacctcttccctccgacgagccgctcagctccagcgcaaatttccgcacctggaatttcgcagcatcaggggaaatctgaacactcgccttagaaagctggacgagcaacaggagttcagcgctatcatccttgcgacggcggggttgcagaggatgggctggcataatcgcgtcgggcaaatcttgcatccggaagagtgcatgtacgcagtcggacaaggtgcgcttggtgtggaagtcagagcaaaggaccaggatatcttggatctcgtgggcgtccttcacgatcccgaaacgctgttgagatgcatcgccgagcgcgcattcctgcgacatctcgaaggtgggtgctcggtgccggttgctgtgcacactgccatgaaagatggccaactgtacctgactggaggcgtttggtccctcgatggatcggactccatccaagaaaccatgcaggccaccatacatgttccagcgcagcacgaggacggacccgaggacgaccctcagcttgtaggaattacggcgcggaacatccctaggggaccgcagctggccgcccaaaaccttggaatcagcctggccaatctgcttttgagcaagggagcgaagaacatcctcgacgtggcacggcagctgaacgacgcccat

SEQ ID NO: 250495 - DNA, 1083 bp, Artificial Sequence
  Description of Artificial Sequence: Synthetic coding sequence
atgagtggaaacggtaatgcagctgcaactgccgaggagaactctcctaagatgcgggttatcagggttgggacgagaaagtctcagctggccagaattcagaccgattccgtagtggctaccttgaaggcctcttaccctggcctgcaatttgaaatcatagctatgagcacgaccggcgacaagatacttgacactgcccttagtaaaatcggcgagaagtcactttttacaaaagaactggagcatgcactggagaagaacgaggtagatctggtcgtgcattccctcaaagacctgcccacggttcttccacctggctttaccattggtgccatctgtaagcgggagaaccctcacgatgccgttgttttccaccccaaatttgtgggtaaaactctggaaacactccctgagaaaagtgttgtgggtacgtcgtcattgaggcgtgccgctcaacttcagagaaagttcccgcacttggaattccggtctatcaggggtaacttgaacactagacttcgtaaactcgacgagcagcaggaattctcggctattatcttggccactgctggactgcagaggatggggtggcataatcgggtgggccaaatcctgcacccagaggagtgtatgtatgccgtaggacaaggggctctgggcgttgaggtgcgggcgaaagatcaagacatcctcgaccttgtgggagtattacatgaccccgagacattgttgcgttgtattgcagagagggcctttttaagacacctggaaggtgggtgttcggtgcctgtagctgtccacactgccatgaaggatggacagttgtatctgactggtggtgtatggtcactggacggtagcgatagcatccaggagacgatgcaagcaaccatccacgtcccagcgcagcacgaagatggtccggaagacgatccacaactggttggcatcaccgcaagaaatatcccaaggggtccccagctggctgcccagaacctcgggatttcattggcgaaccttctcctgtctaagggggctaagaatattctggacgttgcacgacagctcaatgatgcccat

SEQ ID NO: 250496 - DNA, 1083 bp, Artificial Sequence
  Description of Artificial Sequence: Synthetic coding sequence
atgtccggtaacggcaacgctgcggctacggctgaagagaacagcccaaagatgagggtaatccgcgtgggcacaagaaagagccagctagccagaatccagaccgacagtgtagttgccacactgaaggcatcttacccaggcctgcagttcgagatcatcgcaatgtccacaaccggcgacaagattctcgacacggctcttagcaaaatcggagagaagagcctgtttacaaaggaactggagcacgccctggagaagaatgaggtggatctcgttgtgcattcactgaaagacctgccgacagtcctgccaccgggctttaccataggggccatatgcaagagggagaacccacatgatgccgtcgtcttccatcccaagttcgtaggcaagactctggaaaccttgcctgagaaatctgtcgttggaacctcctcgctgcgtcgtgctgcacagctgcagaggaaatttcctcatctggaattcaggtcaattagaggaaatctgaacacccgcctgcgcaagctggatgaacagcaggaattttctgctatcatattagccacagccggactacaaaggatgggctggcacaaccgggtcggccagatcctgcatcctgaggaatgcatgtacgccgtgggccagggggctctcggggtcgaggttcgagcaaaagaccaggacatactagacctggtaggcgtcttgcacgaccctgagactctgctgcggtgtatcgctgagagagcttttctgcggcatctcgagggaggctgtagcgtccccgtggcagtacacactgccatgaaggacggtcagctgtatctgaccggcggcgtctggtctctggatgggtcagattcaattcaggaaacaatgcaggccacaatacatgttcctgctcagcacgaggacggcccggaggacgaccctcagcttgtgggcattacagcccgcaacattccgcgaggaccacagctggcagcacagaacttgggaatttccctcgcgaacctgctgctaagcaaaggagccaaaaatatcctggatgtggctagacagctgaacgacgctcat

SEQ ID NO: 250497 - DNA, 1083 bp, Artificial Sequence
  Description of Artificial Sequence: Synthetic coding sequence
atgagcgggaacggaaatgcggcagcaacggcggaggagaactcgccaaaaatgcgggtcatcagggtgggaactcggaaaagccagctggcgaggatccagaccgattcggtggttgctaccctcaaggcctcgtaccccggactgcagttcgagatcatcgccatgtccactactggggacaagatcctggacaccgccctgtccaagattggagagaagtccctgttcaccaaagagctcgaacacgctctggaaaagaatgaggtcgacttggtggtgcactcactgaaagatctgccgacggtgttgccgccgggtttcaccatcggcgctatttgcaaacgggagaatccgcacgacgccgtggtgttccatccgaagtttgtgggaaagactctggagactctgccggaaaagagcgtggttggcacttcatcactcagaagggctgcgcagctccaacggaagttcccccatctggaattccgctcaatccgcgggaaccttaatacccgactgagaaaactcgacgagcagcaagagttttcggccataatcctcgctactgccggactgcaacggatgggatggcataatcgcgtgggccaaatcctccatccagaggagtgcatgtacgccgtgggccaaggagcactgggtgtggaagtccgcgctaaggatcaggatattctcgatctcgtgggagtcctgcatgacccggaaaccttgctgaggtgcatcgcagaacgggcattcctgcgccacctggagggcgggtgctcggtgccggtcgcggtgcataccgctatgaaggacggtcaactctacctgactggcggagtgtggagcctggacggatccgattcaatccaagaaacgatgcaggccactatccatgtgccagcgcagcacgaggacgggccagaggacgacccacagctggtcggaatcaccgcccgcaatattccccgcggcccgcagctggccgcacagaacctcggaatctcgttggcgaacctcctcctgagcaagggtgcgaagaatattctcgacgtcgcacgccaactcaacgacgcccac

SEQ ID NO: 250498 - DNA, 1083 bp, Artificial Sequence
  Description of Artificial Sequence: Synthetic coding sequence
atgtccggtaatggaaatgcagcagctactgcggaagaaaactccccgaaaatgagggtgatcagagtgggtactcggaaatcgcagctggcaagaattcaaaccgattccgtggtcgcaactctcaaggcatcatacccaggccttcaattcgaaatcattgctatgtccactacgggcgataagattctggatactgcattgtccaagatcggtgagaaaagccttttcaccaaggaacttgaacatgccctcgaaaagaacgaggtggaccttgtcgtgcactcgctgaaggacctgcctaccgtccttcctcctggctttaccataggtgcaatttgtaaacgggaaaaccctcatgacgcggtcgtgtttcatcctaagttcgtggggaaaacccttgagacgctgcccgagaagtctgtcgtcgggacctcctcacttaggcgcgcggcacaactccaaagaaagtttcctcatctggaatttcggtcaatacgcgggaacctgaacactagactcagaaagctcgatgaacaacaagaatttagcgccatcatactggcaacggccggacttcagcgtatggggtggcacaatagggtgggacaaatactccaccccgaagaatgcatgtacgccgtgggtcagggtgcactcggagttgaagtccgcgcgaaagaccaagatatacttgacctggtgggagtgcttcacgaccccgaaaccctccttcgatgcatcgccgaacgagcatttctcagacatctggagggtggatgttcagtgcctgtggcagtccacaccgccatgaaagatggacagctctaccttaccgggggagtttggtcgttggacgggtccgattccattcaagaaactatgcaagcaaccattcatgtgcctgcacaacatgaagatgggcctgaagatgatcctcaacttgtaggaatcaccgccagaaacattcctaggggtccacaacttgcagcacagaatctcggaatttcccttgcaaatcttcttctttcaaagggtgccaagaacatcttggacgtggcaagacagttgaacgacgcccac

SEQ ID NO: 250499 - DNA, 1083 bp, Artificial Sequence
  Description of Artificial Sequence: Synthetic coding sequence
atgagcggcaatggcaatgcagctgctacagctgaagaaaattcccctaagatgagggtcatacgagttggaacccggaagagccagctcgctaggatccagaccgactcagtcgtggcaaccctgaaggctagctaccccggcttacagttcgagatcattgccatgtcaacaaccggggataagatcctggacaccgccctttccaagatcggagagaaaagcttgtttactaaggagttggaacatgctctagagaagaacgaagtagacctggtcgtgcatagtctgaaggacctcccaactgttttgccaccagggttcacgattggggctatttgtaaaagggagaacccgcatgacgcagtagtctttcatcccaagttcgtgggcaagacgctcgagacgctgccggaaaagagtgtggtcggaacgtccagcctgcgtcgcgctgcgcaactgcagagaaaatttccacatttagagttcaggtcaatcaggggtaatcttaacaccaggctccgcaagctggacgagcagcaggaattctccgccataattctcgctacagccggactgcagagaatggggtggcataacagggtgggccaaatcttgcatccagaagagtgcatgtatgcggtggggcagggggcgcttggagtggaggtgagagccaaggatcaagacatccttgatctagttggggttctgcacgatcccgaaaccctcttaaggtgcattgctgaacgggcgttcctacgccatctggagggaggttgtagcgtgccagtggccgtgcacacggccatgaaagatggacagctttacctcacaggaggcgtctggtcattggatggttcagacagtatccaagaaacgatgcaggccaccatacacgtcccggcacaacacgaagacggcccagaagacgatccccaactagtcggcatcaccgcccgaaacatccctagagggccccaactggccgctcaaaaccttggcatctctctggccaatctgctacttagtaagggggcaaagaatattcttgatgtagcacgccagttaaacgatgcccac

SEQ ID NO: 250500 - DNA, 1083 bp, Artificial Sequence
  Description of Artificial Sequence: Synthetic coding sequence
atgtctggcaatggtaacgcagcagcaactgcagaggaaaattcacctaagatgcgcgtcattcgcgttgggacccggaagtcccagctggcaagaatccagaccgattccgtggtggccactcttaaggcatcgtaccctggtctgcagtttgaaatcattgcaatgtccactactggagacaaaattctggataccgcactgtcaaagataggcgaaaagtcgcttttcaccaaagagctggaacatgcgctggagaagaacgaggtggatcttgtggtgcattcgttgaaggatttgcctactgtgcttccacccggatttactattggcgcgatctgtaagcgtgaaaaccctcatgatgcggtggtgtttcatccgaaatttgtgggtaaaacgctcgaaacccttcctgagaagtccgtcgtcggcacctcatcgttgcgacgagccgcacagctccaaaggaagttcccccatcttgaattcagatcaattcgcggcaatcttaacaccaggctcagaaagttggacgaacagcaggaatttagcgcaattatcctggccaccgcgggtctgcagagaatgggttggcataatcgagtgggacagatcctgcatccggaagaatgtatgtacgcagtcggacaaggagctctgggcgtggaggttcgcgcaaaggaccaggacatactggacctggtcggagtcctccacgacccagaaactcttctgcggtgtatcgctgaacgggcatttcttagacatctggagggagggtgttccgtccccgtggcagttcatactgctatgaaggacggccaactttatcttaccggaggagtgtggtcccttgatggaagcgacagcatacaggagactatgcaagcgactattcacgtcccagcccagcacgaagatggtcctgaggatgacccacagctggtgggaatcacggcaagaaatatcccacgagggccccaactcgcagcacagaatctgggaatctcactggccaacctcctgctttccaagggagcaaaaaacatcctggatgtcgcaagacaactcaacgatgcacac

SEQ ID NO: 250501 - DNA, 1083 bp, Artificial Sequence
  Description of Artificial Sequence: Synthetic coding sequence
atgtcgggaaatgggaacgcagcggcaaccgctgaggaaaactcccccaaaatgcgcgtgatcagagtgggcactcgcaaatcacagctggcacggattcagactgactctgtcgtcgcaactctcaaggcaagctaccctggcctgcaatttgagattatagcaatgtcaaccaccggagacaagattttggatactgctctgtccaagattggagaaaagagcttgtttaccaaagaactcgaacatgccttggagaagaacgaggtggatctggtggtgcattcgctgaaggatcttcctaccgtgctcccgcctggatttacgatcggcgcaatttgtaagagggaaaaccctcatgacgcagtggtctttcaccccaaatttgttggaaagaccctggagactctgccagagaagtcggtggtgggaacttcatcactgcggcgggcagcacaactgcagcgcaagtttccccatcttgaatttcgatctatccgcggtaatctgaacacgaggctgaggaaacttgatgagcagcaagagttttcggcaataatccttgcaaccgcaggactccaacgaatggggtggcacaacagagtaggccaaatccttcatcctgaggagtgtatgtacgcagtggggcaaggcgctttgggtgtcgaagtgcgggccaaggatcaggatatccttgatctggtgggagttctccacgatccagaaactctgcttcggtgtatcgccgagagagcctttctccgacatcttgaaggtgggtgtagcgtgccagtcgcagtgcacaccgcaatgaaggacggtcagctgtaccttaccggtggtgtctggtcactggacggatccgatagcatacaagaaaccatgcaagccaccatacatgtgcctgcacagcatgaggacggaccggaggatgacccacagcttgtgggaattaccgcgcgcaacattcctagaggaccacaactcgctgcacagaatcttggaatttccctcgctaaccttttgctttccaagggtgcgaagaacattcttgatgtcgcaagacagttgaacgacgcacac

SEQ ID NO: 250502 - DNA, 1083 bp, Artificial Sequence
  Description of Artificial Sequence: Synthetic coding sequence
atgtcaggaaatggaaatgcagctgctactgctgaagaaaattcaccaaagatgcgagttattcgagttggaactcgtaaaagtcaacttgcacgaattcaaacagattcagttgttgctacattaaaggcatcatatccaggtcttcaatttgaaatcattgcaatgtccacaacaggtgataaaattcttgatactgctttatcaaaaattggagaaaaatctctttttactaaagaattagagcacgcacttgaaaaaaatgaagttgatttagtagttcatagtcttaaagatcttccaacagttttgcctcctggatttactattggtgcaatttgtaaaagagaaaatccacatgatgcagtagtattccatccaaaatttgttggaaagaccttggaaacacttccagaaaaaagtgttgtaggaacttcatcattacgtcgagcagctcagttacaaagaaaatttccacaccttgaatttagaagtattagaggaaatcttaatacaagattaaggaaattagatgaacaacaagaattttcagcaattatcttagcaactgcaggtcttcagagaatggggtggcataatagagtaggtcaaatccttcatcctgaagaatgcatgtatgccgttgggcaaggggcattgggagttgaagtaagagcaaaagaccaagacattcttgatttagttggagttttacatgatcctgaaactttgttaaggtgtatcgctgaaagagcattccttagacatttagaaggaggatgtagtgttcctgttgctgtccatactgctatgaaagatggtcaactttatcttactggaggagtgtggagtcttgatggaagtgattcaattcaagaaacaatgcaagcaactattcatgttccagctcaacatgaagatggaccagaggatgatccacaattggttggaattacagctagaaacattcctagaggacctcaattagctgcacaaaatttaggaataagtttagctaatttattattatcaaaaggagctaaaaatattcttgatgtagctagacaattaaatgatgctcat

SEQ ID NO: 250503 - DNA, 1083 bp, Artificial Sequence
  Description of Artificial Sequence: Synthetic coding sequence
atgtctggcaacggaaacgccgctgctactgctgaggagaactcacctaagatgcgcgttatccgtgtaggaaccaggaagtcgcaattggcacggatacagactgatagtgtcgtagccactctcaaagctagttatcctggactgcagtttgaaatcattgctatgagtacaactggcgataagattctggataccgccctctccaaaattggtgagaagtctctcttcaccaaggaattagagcatgctttggaaaagaatgaggttgaccttgttgtgcattccttaaaggatttgccgaccgtacttcctccgggtttcaccatcggtgcaatctgtaaaagagaaaatcctcacgatgcagtcgtattccaccctaaattcgtcgggaaaaccctcgaaacgttgccggagaaatcggttgtgggtactagctcactcagacgtgcagcccaattacaaagaaagtttccacatttagaatttcgaagtatccgcggcaacttgaacactcgcctccgaaaactagacgagcagcaggagttttctgctatcattttggctaccgctggccttcagagaatgggttggcataaccgggttggccaaatacttcatcctgaggaatgtatgtatgctgtaggacaaggagctcttggtgttgaagttagagctaaagatcaggatattctggacctagttggtgttctgcacgatcccgaaacgctccttagatgtattgctgagcgcgctttcctacgccacttagaaggtgggtgctcagttccggtggcagtgcatacagctatgaaagacggacagctgtatctcactggaggcgtctggtcactagatggttcagattcaattcaggaaactatgcaagctactatccatgtccccgctcagcatgaggatggacctgaagatgatccacaactggttggcattaccgctcgaaacatcccacgaggtcctcaactcgccgcccaaaacttgggaatctccctcgcaaaccttcttctctcaaaaggcgcaaagaacatacttgacgtagctcggcaacttaatgatgctcat

SEQ ID NO: 250504 - DNA, 1083 bp, Artificial Sequence
  Description of Artificial Sequence: Synthetic coding sequence
atgtcgggaaacggcaacgctgcagcgactgcagaagagaactctcctaaaatgagagtgattcgagtgggaaccagaaaaagccaactcgctaggattcaaactgatagcgtggtggctaccctgaaggcctcgtaccctggacttcaatttgaaatcattgcaatgtcgacgacgggagataagattcttgacactgcactctccaagataggcgaaaagtctctttttaccaaggaacttgaacacgcacttgagaagaatgaggtcgatcttgtcgtgcactccctgaaggatctccctactgtgcttccgccaggttttacgatcggtgcaatttgcaagagggagaacccgcacgacgccgtggtatttcatcctaagtttgtgggtaagactcttgaaaccctgcctgaaaagtcggtcgtgggcacctcgtcgcttcgtcgcgcagcacaattgcagcggaagtttccacatctcgagtttcggtccattcgcggtaatcttaacactcgactcagaaaactggacgagcaacaagagttctcggccatcatactcgccactgcaggtctgcagcggatgggatggcataacagagtgggacaaattcttcatccagaagaatgtatgtacgcagtgggacagggtgccctgggagtggaggtccgcgccaaagaccaagacattcttgatctggtgggcgtgctccacgatccagaaacccttctgagatgcattgcagagcgggcctttcttagacatctggagggaggatgctcggtgcccgtggccgtgcatactgcgatgaaagacggacagctttacctgactggcggtgtttggtcgctcgatggatcagattccatacaggaaaccatgcaagcaaccatccacgtcccagcacaacatgaagatgggccggaggacgacccacagcttgtcggtattaccgcacgtaatatccccagaggacctcagcttgccgcacagaacctgggtatatcgctggcaaacctgctgctgtccaagggtgcaaagaacatcctcgatgtggcacggcaactgaacgacgcacac

SEQ ID NO: 250505 - DNA, 1083 bp, Artificial Sequence
  Description of Artificial Sequence: Synthetic coding sequence
atgagcggcaacggaaacgccgcggcaaccgctgaggagaactccccaaagatgcgcgttattcgggttggtactcgaaagtctcaactcgcccgaattcagacagatagcgttgttgccactctgaaagcctcctatcctggcctccaattcgagatcatcgccatgtccactactggagataagatactcgacacagccctttctaagattggtgaaaaaagtctcttcacaaaagagctagagcatgcccttgagaagaacgaggtggacttggtagtccactcccttaaagacctgcctaccgttctgccccccgggtttactattggtgccatatgcaagcgtgagaacccgcacgacgccgtagtgtttcacccgaaatttgttggaaagacccttgagacattacccgagaaatcggttgtcggtacgagctcgttgcgccgagctgcccaattgcaaaggaagtttcctcaccttgagttcaggtcaattaggggaaatctcaacacgcgcctccggaaacttgacgaacagcaggaattttcggcaatcattcttgctaccgctggtctccagcgtatgggatggcacaacagggttggtcagatattgcaccccgaggaatgcatgtacgctgttggccagggcgcactaggcgtagaggtgagggcgaaggatcaggatattttggatctggtcggagtgcttcacgatcccgagacattgctgagatgtattgccgagagagcgtttctcagacatcttgagggcggttgcagtgtccctgtcgctgtgcatacggccatgaaagatgggcaattgtacttaactgggggcgtttggagcttggacgggtccgattctatccaagagactatgcaggcgacaatccatgttccggcccaacacgaggacggccccgaggatgacccacaacttgtcggcattactgcaaggaatattccaaggggcccgcagctagccgcccaaaatcttggcatcagtttggctaatcttctcctgagcaagggcgccaaaaacatcctcgatgtggcgcgacagcttaatgatgcccac

SEQ ID NO: 250506 - DNA, 1083 bp, Artificial Sequence
  Description of Artificial Sequence: Synthetic coding sequence
atgtcagggaacggaaatgccgccgcaacggctgaagaaaactctccgaagatgcgagtcatacgcgtgggaacccgaaaaagccaacttgcaaggatccaaacagacagcgtcgttgcaacgttgaaagccagctatcccgggttgcagtttgaaattatagctatgagcaccacaggggacaaaatacttgacacagccctgtctaagataggagaaaagagcctgttcactaaagagttggaacatgctctcgagaaaaatgaggtggatctcgtggtgcactcactgaaggacttgcctacagtgttgcccccgggcttcaccatcggtgcgatttgtaagagagagaatccacacgacgccgtggtgttccaccccaaatttgtgggtaagaccctagagacattaccggaaaagagcgttgtgggcacctcttccctccgtcgcgccgctcagttgcaacgaaaatttccccaccttgagttccggtcgatcagaggaaacctgaacactaggctgagaaaacttgacgagcaacaggagttttctgctatcattctggctacggctggactccagaggatgggctggcacaatcgtgtgggccagatcttacacccggaagaatgcatgtatgccgtgggacagggcgctctgggtgtggaggtacgggccaaagatcaggatattctggacttagtaggggtccttcatgatccagagacactccttagatgcattgcggagagagctttcctacggcatttggaggggggatgctccgtgcctgtggcagttcacactgctatgaaggacgggcaactgtatctaaccggtggggtatggtcactggacggctccgatagcattcaagaaactatgcaggctaccatccatgttccagcgcagcacgaggatggtcctgaagatgatcctcagttagtgggcattactgccagaaatatcccaaggggcccacagctggccgcccaaaatcttggcatctccctggccaatttactattgtccaagggggccaaaaatatcttggatgttgcacgtcagcttaatgatgcccat

SEQ ID NO: 250507 - DNA, 1083 bp, Artificial Sequence
  Description of Artificial Sequence: Synthetic coding sequence
atgtcaggtaatggaaacgcagctgcaaccgccgaggaaaacagccccaaaatgcgagtcatcagagtggggaccagaaagtctcagcttgcgcgcattcagacggatagtgtcgtggcaaccttgaaggctagttatcctggcctgcagtttgagatcatcgcaatgagcacgacaggtgacaagatcttagacaccgctctgagcaagattggcgaaaaatctttgtttacgaaggagctggaacacgctctcgagaagaacgaagtggacttggtggtgcactctttaaaggacctacctaccgttctaccccccgggtttaccattggagccatatgtaagcgggagaatccgcatgatgctgtagtgttccatcctaagttcgtcggcaagacgctagaaacgctgcccgaaaaatccgtggtgggcacaagcagcttaagacgcgccgcacaactacagcgaaagttcccacatttagaattcagatcaattagaggcaacctcaataccagactgcgcaaacttgacgagcagcaggagttcagcgcgattattcttgctaccgcgggtttgcagcgtatgggttggcataatagagtgggtcagatcctgcatccagaagagtgtatgtatgctgtcggtcagggggccctgggggtggaagtacgggctaaagatcaggacatcctcgacttggtgggtgtgctccacgatccagaaacgctgttaaggtgcatagctgaacgggcctttctccgccatctagaaggcggctgtagtgtcccagtggcagtccacacagccatgaaagatggtcagttgtatctcacgggcggagtgtggtctttagacgggagcgattcgatccaggaaaccatgcaggccacgattcacgttccggcacagcacgaggacggtcctgaggatgaccctcagttggtaggcatcactgcccggaatataccgaggggcccgcaactggccgcccaaaatctcggcatttccctggccaatctcttactgagtaagggcgccaagaatatcttggatgtggcaaggcagttaaacgatgcccac

SEQ ID NO: 250508 - DNA, 1083 bp, Artificial Sequence
  Description of Artificial Sequence: Synthetic coding sequence
atgtctgggaatgggaatgctgctgctactgccgaggaaaactctccaaaaatgcgcgttatcagagtcggcacaagaaagagccaacttgccagaatccaaacagactccgtggtggcaacgctcaaggccagctatcctggccttcagtttgaaattatagccatgtcaaccaccggagataagattcttgacaccgcactcagcaagattggggagaagagtttgttcaccaaggagctggaacatgccctagagaagaacgaggttgatcttgtggtgcatagtctgaaggatttgcccacagtgctgcccccggggtttaccatcggtgcaatctgcaaaagggagaacccccatgacgccgtggtattccatccaaaattcgtcggcaagacactggagaccttgccagagaaatccgtcgtaggaacaagcagcttgaggcgcgccgcacagctccagagaaagttcccccatctggaatttagatctatccgtggtaatctaaacactaggttaaggaaactggacgagcagcaggagttctcagccatcatattagccaccgctggcctccagcgcatgggatggcataacagggttggtcagatcctccatccagaggaatgtatgtatgcggtgggccagggcgccctgggggtcgaagtccgtgcgaaggatcaagatatcctggacctggtcggagtcctccacgaccctgaaaccctccttaggtgtatcgctgaaagagccttcctccgccatctcgagggaggctgcagcgttcccgtcgcggtccacaccgctatgaaggacggacaactttatcttacaggaggtgtatggtcattggacggatcagatagtatccaagagactatgcaggcaacaattcacgtacccgctcaacatgaagacgggccagaagacgaccctcagcttgtcggcattactgctaggaacatcccacgcggcccacaactcgccgcacagaaccttggaatcagcctcgccaatcttttgctaagcaagggagcgaaaaacattcttgacgttgctaggcaactcaatgatgcgcat

SEQ ID NO: 250509 - DNA, 1083 bp, Artificial Sequence
  Description of Artificial Sequence: Synthetic coding sequence
atgtccggaaatggaaatgccgcagccacagctgaagaaaattccccaaagatgagagttatccgtgtaggaactagaaaatctcaacttgctagaattcagactgactcagtggtggcaacgcttaaggcatcctatccgggactgcaatttgaaattattgcaatgtctacaaccggagataaaatcctcgatacggctttatcaaaaatcggagagaaatcattattcaccaaagaattggaacatgctcttgaaaaaaatgaagtggacttagttgttcatagtttaaaggatctaccaacagtactcccaccaggttttactataggagcgatttgcaaaagagaaaacccacatgacgcagtggtattccatcccaaatttgttggaaaaacacttgaaactctcccggaaaagtcagttgtcggaacaagttctttgcgacgagcagcacaacttcaacggaaatttccccacctggaatttcgtagtatacgaggaaatttgaatacacgccttcgaaaactcgacgaacaacaagaattttctgccatcattctcgccacggccggattgcagcgtatggggtggcataatcgggtgggacaaattctccacccagaagaatgtatgtatgctgtgggacagggtgccttgggagttgaggttcgggcaaaggatcaagatattcttgatcttgttggcgttttgcatgatccggaaactcttttgagatgtatcgccgagcgtgctttcctaagacatcttgagggagggtgttccgtgccagtcgccgttcatacagcgatgaaggatggacaactttaccttaccggtggagtctggtctttggatggaagcgatagtattcaagaaaccatgcaagcaacgattcacgtaccggcacaacatgaggatggccctgaggacgacccacaacttgtaggaatcacagctcgaaatattcctaggggacctcaattagcagcacagaacctaggaattagcctagcaaatctcttgctatcgaaaggagccaagaacatcttagatgtcgccaggcaattaaatgatgctcat

SEQ ID NO: 250510 - DNA, 1083 bp, Artificial Sequence
  Description of Artificial Sequence: Synthetic coding sequence
atgagtgggaacggtaacgccgccgcaacagccgaggagaactcccctaaaatgcgagtaatccgtgttggtactcgaaaaagccaactagccagaatccagacagactctgtggtagccactttaaaagccagttatcccggcctgcagtttgaaattattgctatgagcacaactggggataagatcttggatactgcgctgtcaaagataggagagaagagtctgttcactaaggagttggagcacgctctcgagaagaatgaggtcgacctagtcgtgcactctcttaaagaccttccaacggtgttgcccccaggattcactattggcgctatttgcaagcgagagaacccacatgacgccgtcgtgttccaccctaagttcgtgggcaaaacccttgaaacactgccagaaaagagcgtggtgggcacgtcaagcctgcgccgggctgcccagttacaacggaagtttccacatttagagtttcggagcatacggggcaacttaaacacaagactgcggaaacttgatgagcagcaggagttcagcgccatcatacttgctaccgctgggcttcaacgtatggggtggcacaaccgggttggacagatcctgcatcccgaagaatgtatgtacgcagtaggccagggcgcgcttggagtcgaggtgagagcgaaggaccaggatatactggacttagtgggggtactccatgatcccgaaactctgcttcgatgtatagcggagcgggccttcctcagacacctcgaaggcgggtgttccgtgcctgtcgctgtgcataccgccatgaaagatggccagctgtatctgaccgggggggtgtggtcgcttgacggctcggactccatccaggagacaatgcaggccaccatacacgtacccgcgcagcacgaagacgggccagaggacgatccacagctggttgggataacagctcgaaacatacctagaggcccccagctggcggcacagaaccttgggataagcctggctaacctcctgctgtccaaaggagctaagaatattttagacgtggcacggcaattgaatgatgcccat

SEQ ID NO: 250511 - DNA, 1083 bp, Artificial Sequence
  Description of Artificial Sequence: Synthetic coding sequence
atgagcggcaatggcaacgcagccgcgactgccgaggagaacagccccaaaatgagagtgatcagggtgggcaccagaaaatctcaacttgctcgcatccaaactgattcggtcgtcgccacattaaaggcgtcctatccaggcctccagttcgagataatcgccatgtcaacaactggggacaaaatcctggatacggccttgagtaaaataggcgaaaagagcttgtttacgaaggaactcgagcatgctctggaaaagaatgaggtggacctcgttgtacacagtctcaaagatctgcctaccgtcctgcctcctggcttcactatcggcgcaatttgtaagcgcgaaaacccacacgacgccgtggtgtttcatcccaaattcgtgggtaagaccctggagactcttccagagaagtccgtcgtgggcacgtcaagcctgagacgtgcagcacagttacagagaaaattcccccacctcgaatttagatcgatccgggggaacctcaacactcggcttcggaaactggatgagcagcaggagttttctgcgataatcctggcaaccgcgggcttgcagaggatgggatggcacaaccgggtgggccagatactccatccagaggaatgcatgtacgcagtgggacagggagctttgggcgtggaggtccgcgccaaggatcaggatatcttggacctcgttggcgtgctgcatgatcccgaaacactccttcggtgcattgccgaacgtgccttcctaagacatttagagggcgggtgttccgtccctgtagcagtgcacactgccatgaaagacggtcagctgtacctcactggtggggtgtggtctcttgacggttctgacagcatccaggagacaatgcaagccacaattcacgtccccgcacagcacgaggacggacccgaagacgatccccagcttgttgggatcactgcgcggaatatccccagggggcctcagctggccgcccagaacctgggcatctctctggcaaacttgctgcttagcaaaggagccaagaatatactggacgtggcccgacagctgaatgatgctcac

SEQ ID NO: 250512 - DNA, 1083 bp, Artificial Sequence
  Description of Artificial Sequence: Synthetic coding sequence
atgtcaggcaatggaaacgccgcagctactgcagaagaaaatagtcccaaaatgcgagtcatcagagtgggaacacgtaagagccaactggcccggattcagacggatagtgttgtcgccacgctgaaggccagttatcctgggcttcagttcgaaataattgccatgtcaacgactggggataaaatcttagacacggctttatctaaaattggagaaaaatcactcttcacaaaagaacttgagcacgctttggaaaaaaacgaagttgatttagtcgtgcactccctaaaagacttaccgacagtattaccgccgggctttacaatcggcgctatttgcaaaagagagaatcctcacgatgccgttgtctttcaccctaaattcgttggcaaaacattggagacgctgcctgaaaaatctgttgtgggcacaagctccctgcgtcgtgcagcccagcttcagagaaaatttccgcatctagagtttcgttcaatcagaggtaacttgaatactcgtcttcgtaaattggatgagcaacaagaatttagcgctatcatcttggcaacagccggactgcagaggatgggctggcataatcgggtgggccagattttacatccagaagaatgtatgtatgcggttggacagggtgccctgggcgtggaagttagggctaaagatcaagatatcttagatttagtgggcgttctccatgatccagagacgttgttgagatgtattgcagaacgggcttttttgagacatttagaaggtggttgttcagttcctgttgcggttcatacggccatgaaagatggacagctttatttaacaggaggtgtttggtcgctggatggtagtgacagcattcaggaaactatgcaagctactattcatgtgccggcccagcatgaggacggacctgaagatgatccgcaattggtaggaatcacggctcgtaatatcccgagaggtccgcaattagccgcacaaaacctgggaatctcactcgctaatctgcttttatcaaagggagctaaaaatatactggatgttgcccggcagcttaatgacgcacat

SEQ ID NO: 250513 - DNA, 1083 bp, Artificial Sequence
  Description of Artificial Sequence: Synthetic coding sequence
atgtcaggtaacgggaacgcagcagcgacggcggaggaaaattcccccaaaatgcgggttatccgtgtgggcacaagaaagtcccagttagcacgcatccagaccgactcagtggtcgctactctgaaggcaagctaccctgggctccaatttgaaattattgccatgagcaccacgggcgacaaaattctcgacaccgcactgagtaaaattggcgagaagtcactcttcacaaaggagctggagcacgccttggaaaagaatgaggtggaccttgtggtacatagcttaaaggacctgccaaccgtgctgccccctggatttaccatcggggccatttgcaaacgagaaaacccccatgacgccgttgtgtttcaccctaagtttgttgggaagaccctcgaaaccctaccggagaaatccgtggtcggaaccagctctctgcgccgtgccgcccagctccagcgcaagtttcctcacctcgagtttagatccatcagagggaatctgaataccagactgagaaaattggacgaacagcaggagttttctgccatcatactggcgaccgccggcttgcagagaatgggatggcataaccgcgtgggccagatactgcatcctgaggaatgtatgtacgccgtcggtcagggcgctctgggagtagaggtgcgggctaaggaccaggacatccttgatctagtgggagtgctgcacgatcccgagaccctcctccgatgtattgccgagcgggcatttctccggcaccttgagggaggctgttccgtccctgtggccgtccatactgctatgaaagacggccaactctaccttacaggaggagtctggagtctggatggatccgattccatacaagagactatgcaggcaaccatccacgtgccagcccaacacgaggacggcccagaagatgaccctcaactagtaggcataacggcacgaaacattcctcggggtccccagcttgccgcgcagaatctcgggatctccctagccaatctccttctgagcaagggtgccaagaatatactggacgtggcaagacagctcaacgacgctcat

SEQ ID NO: 250514 - DNA, 1083 bp, Artificial Sequence
  Description of Artificial Sequence: Synthetic coding sequence
atgtcaggaaacggaaacgctgccgcaaccgcagaggaaaattcccctaagatgagagtgatacgggttggaacccgaaagtcgcagcttgctcgtattcaaaccgacagcgtcgtcgcgactcttaaagcatcgtacccggggctccagtttgaaatcatagcaatgagcaccactggagacaaaatactggatactgcactgagcaaaatcggggaaaagtcactgtttactaaggagttggaacatgcgctggagaagaacgaagtggatttggttgtgcattccctcaaggatctgcctaccgtcctgccacctggtttcaccataggagccatatgtaagagggagaatccccacgacgcagtggtgttccatcctaaattcgtcggaaagacgctggaaactcttccagagaagtcagtggtggggacctcctcgcttcgccgggcggcacagcttcagagaaaattcccccatctcgaattccggtcgattagaggaaatcttaatactaggctcagaaagctggatgaacaacaggaatttagcgcaatcatccttgcgacggccggcctgcagcggatgggatggcacaacagggtcggacagatcctccaccctgaggaatgcatgtacgcggtcgggcaaggtgcacttggagtggaggtgagggcaaaggatcaagatattctggatttggtcggcgtcttgcatgaccctgagactttgctccgatgtatagcggaacgggcatttctgcgtcatttggaaggaggctgcagtgtgccagtggctgtccataccgcaatgaaggatggtcaactttaccttactggaggggtgtggtcacttgatggttcggactcgattcaagagactatgcaagccaccatccatgtgcctgcacaacatgaagatggtccagaagatgatccccagctggtgggcatcaccgcacgcaatatccctcggggacctcagctggcagctcaaaatctgggtatctcgctggcaaacttgcttctctccaaaggagccaaaaacatccttgatgtcgccaggcaacttaatgatgcccat

SEQ ID NO: 250515 - DNA, 1083 bp, Artificial Sequence
  Description of Artificial Sequence: Synthetic coding sequence
atgagcggaaacggaaacgccgccgcgactgctgaagaaaactcccctaagatgagggtgatccgagtggggactcgcaagagtcaactcgcccggatccagactgattcggtggtggccactctgaaagcctcatacccgggtctgcaatttgagatcatcgcaatgagcacgaccggtgacaagatcctcgatactgcgttgtccaaaatcggagagaagtccctgttcactaaagaactcgaacatgcgctggagaaaaatgaggtggacctggtggtgcattccctcaaggacctcccgaccgtgttgcccccagggttcaccatcggggcaatctgcaagcgggagaacccacatgatgccgtggtgttccacccgaagtttgtcggaaagactctggagacgctccctgaaaaatcggttgtaggtacttcatcacttcgccgcgccgcacaattgcagcgcaagttcccacatcttgagttccgtagtatcagaggaaatctgaacacccgccttcggaagctcgatgaacaacaggagttttcggcaatcatcctggccactgctggcctccaaagaatgggatggcacaacagggtggggcagatcctgcacccggaagagtgtatgtacgcggtgggtcagggagccttgggcgtcgaggtgcgcgccaaggaccaagatatcctggacctcgttggcgtccttcacgatccggagactctgctgaggtgcatcgccgaaagagcgtttcttcgccacctcgagggcgggtgctccgtcccagtggctgttcatactgccatgaaggatgggcaactctacctcaccggcggggtctggtcgctggacggctccgattccatccaggaaactatgcaggcaaccattcacgtcccagcacagcacgaggacggacccgaggacgacccgcaacttgtgggaattaccgcgaggaatatcccgcgcggacctcagctcgccgcccagaatttgggaatttcgctcgcgaacctgctcctgtcgaaaggagccaagaacatcctggacgtggctcggcagctgaacgatgcccac

SEQ ID NO: 250516 - DNA, 1083 bp, Artificial Sequence
  Description of Artificial Sequence: Synthetic coding sequence
atgtccggtaacggcaatgcggcggccaccgcggaggagaatagtccaaagatgagggtcattagggtgggcacgagaaagagtcagctggcgcgaattcagactgattccgtcgttgccacgttgaaggctagctaccccgggctccagttcgaaattatagcaatgtctactacgggggacaaaatcctcgacacagctcttagtaagattggtgaaaagtctctgtttacaaaagaactcgagcacgcactggagaaaaacgaggtagacctggtcgttcattccctgaaggatcttcctaccgtactgcctcctggatttaccattggggcgatttgcaagcgcgaaaatccccacgatgccgtcgtgtttcatcccaagtttgttggcaagaccctcgagacccttcccgaaaagtccgtcgtaggtaccagttccttgcgccgagccgcacagttgcagcgcaaatttccccatctggaatttaggagtataagggggaatctgaacacaagactcagaaaactggatgagcaacaggaatttagtgcaatcatacttgcaaccgcagggctgcagcggatgggctggcataacagagtcgggcagatcctgcacccggaggagtgcatgtacgctgtcggccaaggcgctctgggggtggaggtgagggctaaagatcaggacattttggatctcgtcggggtactgcacgacccggaaacattgcttcggtgcattgccgagagagcctttctccgacaccttgaagggggatgtagtgtgcctgttgcggttcacaccgcaatgaaggatggtcagctgtacctgacgggcggagtttggtctttggacggaagtgactccatccaggagacaatgcaggccacaatccacgtcccagcccagcacgaagacggtcccgaagatgacccccaattggttggaatcacagcccgaaacattccccgcggaccccaactggcggcccagaacctgggaatatctttggccaacttgctgttgagcaagggcgcaaaaaacattctggacgtcgcccgacaactgaacgatgctcat

SEQ ID NO: 250517 - DNA, 1083 bp, Artificial Sequence
  Description of Artificial Sequence: Synthetic coding sequence
atgtcgggaaatgggaatgcggcagcaactgcagaagaaaacagcccaaaaatgagagtcatcagagtgggtactcgcaagtcgcagctggctagaattcaaactgattctgtggtggcgacgcttaaggcatcataccctgggctgcagtttgagattatcgcgatgtcaactaccggagacaaaattcttgataccgctctgtccaaaattggcgaaaagtcactcttcactaaagagctcgaacacgcgcttgaaaagaacgaagtcgatctggtggtccatagcctgaaggatttgccaactgtcctgcccccagggttcactatcggcgcaatttgcaagagagaaaacccccacgatgcggtggtgtttcacccgaagtttgtggggaaaacccttgaaacgctccctgaaaaaagcgtggtgggtacttcgtcccttcgccgcgcggcacaactccaacgtaagttcccccacctggaatttagatcgattaggggtaatcttaatacgagacttagaaaactggacgaacagcaagagttttcggcaatcatccttgcaactgcgggtctgcagcggatgggatggcataaccgggtgggtcaaattctgcatcctgaggagtgcatgtacgcagtggggcagggcgccttgggagtcgaagtgcgagcaaaggaccaagatattctcgacctggtgggcgtcttgcatgaccccgaaactcttctgcggtgtattgctgagcgagcattcctgagacatcttgagggtggatgctcagtcccagtcgcagtacatactgcaatgaaggacggtcagctctatctcaccggaggcgtctggtcgcttgacgggtccgattccattcaggaaactatgcaagcaactatccatgtgcccgcacaacatgaggacggtccggaagatgatccccaactggtgggcattaccgcccggaatattcctcgtggacctcagctggcagcgcagaaccttggcatttcactggccaatcttctgctttccaaaggagcgaagaacattcttgatgtcgcacgacaactgaacgacgctcac

SEQ ID NO: 250518 - DNA, 1083 bp, Artificial Sequence
  Description of Artificial Sequence: Synthetic coding sequence
atgtcagggaacggaaacgcagccgcgaccgccgaggagaattctcctaagatgcgggtcattcgggttggtacaaggaaatctcagctggccagaattcaaaccgactctgtggtcgcgaccttgaaggcctcataccccggacttcagttcgagatcattgctatgtcaactaccggcgataaaattctcgatactgccctcagcaaaattggagaaaagtctctgttcactaaggagctagagcacgccctcgaaaagaacgaagtggatttggtggtgcactccttaaaggatcttccaaccgtactgcccccaggctttaccatcggagccatctgcaagagagagaatccccacgatgctgtagtattccaccccaagtttgtggggaagacactggagactctcccggagaagtctgtcgttgggacatccagcttaaggagggcagcccagctgcagcgaaaatttcctcacctagaattcaggtctatcagggggaatttaaatactcgcctccgaaaactcgacgaacagcaggaattcagcgcaataatactggccacagcgggattgcagagaatgggctggcacaatcgcgtagggcagatcctgcatccggaagagtgtatgtatgccgttgggcagggggctttaggagtagaggtccgtgccaaggaccaggacattctggacctcgtcggggttctgcacgatccagaaacgttgctgcggtgcatcgcagaacgggcctttctccggcacctcgaaggtggttgctcggtgcccgtggccgtccataccgcgatgaaagacggtcagttgtatctgacaggaggcgtgtggtcactggatggatctgactctatccaggagactatgcaggcgacaatccacgtcccagcacagcatgaagacggccctgaagacgatccacagcttgtaggcatcacggcaagaaacatccccagggggccgcaactggcggcccaaaacttgggaatcagtctggcgaatctgttgctgtcaaagggggcaaagaatatcttggacgtcgcaagacaattgaatgacgctcat

SEQ ID NO: 250519 - DNA, 1083 bp, Artificial Sequence
  Description of Artificial Sequence: Synthetic coding sequence
atgtctggcaacggtaacgctgcggcgacagctgaagagaactctcccaaaatgcgcgtaatccgtgtgggcacaaggaaatcccaattggcccgtatacagaccgattcggtggttgccaccctgaaggcgagttaccctggtctccagtttgagattattgctatgtcaacgacgggcgacaaaattctcgacaccgccttgtccaagatcggtgagaaaagcttgttcacaaaggagttagaacacgcgttagagaagaatgaagtcgatctggtagtacacagcctcaaggatctgccaaccgtcctgccgcccggattcacgattggagccatttgcaaacgcgagaacccgcatgacgccgtggttttccatccgaagttcgtcggcaagaccctcgagaccctgccggagaagtctgtggtaggaaccagtagtttgcgcagggctgcgcagctgcagcgtaaattcccacacttagaattccgctcgattcgcggcaacttgaatacccgtctaagaaaattggatgaacagcaggagttttcggccatcattctggcaaccgccggactccagcggatgggctggcacaatcgtgtgggccagatattgcacccagaagaatgcatgtatgcagtcgggcagggcgccctgggagtggaggtcagggccaaagatcaagatatcctggatctggtgggcgtgctgcatgaccccgagactcttctccggtgcatagctgagagagccttcctacgccatcttgagggaggctgctcagtgcccgtcgccgtgcacacagccatgaaggacggccaattgtacctaactggcggcgtttggtcgctggatggttcggatagcatccaggagaccatgcaggctaccattcacgtgccagcccagcacgaggatggccctgaagatgatccgcagcttgtgggaatcaccgcccgtaacattccacgaggaccccagctagcggctcagaatttaggcatttccctggccaatctcttgctgtctaaaggcgccaagaacatcctggatgtagcacgccagctgaatgatgcccat

SEQ ID NO: 250520 - DNA, 1083 bp, Artificial Sequence
  Description of Artificial Sequence: Synthetic coding sequence
atgtccggaaacggcaatgcagctgcaaccgcagaagagaattcgcctaagatgcgcgtcatcagagtcggaaccaggaaaagccagctcgctaggattcagactgacagcgtggtggcaaccttgaaggcatcctatcctggccttcaatttgagattattgcaatgtctaccaccggtgacaaaattctggatacggccttgagcaagatcggtgaaaagtcactgtttaccaaggaactggaacacgccctcgaaaagaacgaagtggatcttgtcgtccattcgctgaaggatttgccgaccgtgctcccgccaggtttcaccataggggcgatatgtaaaagagaaaatcctcatgacgcggtggtgttccatcccaagtttgtgggaaaaacccttgagactctgccagaaaaatcggttgtgggcacctcctcgctgaggagggcggcacaactccagaggaagtttccacatctggagtttcggtcaattcgtggaaaccttaacacgagacttcggaagttggatgagcaacaggaattctcagcgattattctcgcaacggctggtctgcagcgaatgggctggcataatcgggtcggccagatacttcatccagaggaatgcatgtacgcagttggtcagggggcactgggagtcgaggtgcgcgcgaaagaccaagatatcctcgaccttgtgggtgtgctgcacgaccccgaaacgctcctgcgctgcattgcagagagagcattcctgagacaccttgaaggtggatgttcggtgccggtggcagtccataccgcgatgaaggatggacagctgtaccttactggaggcgtgtggtccctggatggctcagattcgatccaagagactatgcaagccactatacacgtccccgcacaacacgaagatggaccggaagatgatcctcaactggtgggaattacggcgagaaatatccctcgcggtcctcaactggccgcccaaaacctcggtatcagcttggcaaaccttctgcttagcaagggcgccaagaacatattggatgtggcgaggcaactgaacgacgcacat

SEQ ID NO: 250521 - DNA, 1083 bp, Artificial Sequence
  Description of Artificial Sequence: Synthetic coding sequence
atgtctggcaatggaaacgctgcggcgaccgctgaagagaactcgccgaaaatgcgcgtgatccgcgtcggaactagaaagtcacaactggccagaatccaaaccgactcggtcgtggctaccctgaaagcgtcctaccccgggctgcagttcgagatcattgccatgtctactacgggtgacaagatcctcgacaccgcactgtcaaagatcggagagaagtcactcttcactaaggaactggagcacgccctggagaaaaacgaagtcgacctggtggtccactctctgaaagacttgccgaccgtgcttcctccaggattcaccatcggagcaatctgcaagcgcgaaaacccccacgatgcagtcgtttttcatccaaagttcgtgggaaagactctcgaaacgctccctgaaaagtcagtggtcggtacctcatccctgagacgagccgcccagctccaaaggaagttcccgcatctcgaattccgctcaatccgaggtaacctcaacacccgcctgcgcaagctggacgaacagcaggaattctccgctatcattctcgctaccgccgggttgcagcggatgggctggcacaacagagtgggtcagattttgcacccggaggaatgcatgtacgcagtgggacaaggcgccctcggggtggaagtgcgggccaaggatcaggatatcttggacctcgtcggagtcctgcacgacccggagactcttcttcggtgtatagcggaacgagcctttctcagacatttggagggaggttgctcggtcccggtggctgttcacactgccatgaaggatggacagttgtacctcactggaggcgtgtggagcttggatgggtccgattccatccaggagactatgcaagctaccatccatgtccccgcccaacatgaggacggccctgaagatgacccgcagctggtgggaatcaccgcccgcaacatcccgagaggaccacaactggccgcccagaacctgggtatctccctcgcaaatctcctgctcagcaagggcgccaagaacatcctggatgtcgcaagacaactcaacgatgcacac

SEQ ID NO: 250522 - DNA, 1083 bp, Artificial Sequence
  Description of Artificial Sequence: Synthetic coding sequence
atgagtgggaatggtaacgcagcagctaccgctgaagagaacagccccaaaatgcgcgtaatcagggtaggaactcgcaaaagccaactggcccggatacaaaccgattcagtggtggccaccctgaaagcaagttaccccggcctgcaatttgagattatcgcaatgtcaaccacaggtgataaaatcctggacaccgctttgagcaagattggcgaaaagagtctgttcaccaaggaactcgagcatgcgctcgagaagaacgaggtggacctggtagtgcactccctcaaggacctgccgaccgtgctgccacccgggttcaccatcggcgcgatctgtaaacgcgagaacccccatgatgcggttgtgtttcaccctaaattcgtgggtaagaccttggagacactgccagaaaagagcgttgtcggaacctcaagcctgcgacgagcggctcagctccagaggaagtttcctcacctggaatttcgctctatcagagggaacctgaacacccgcctcaggaagctcgatgaacagcaagaattttcagcgatcattctggccacagcgggcctgcagcgaatgggttggcacaacagggtgggccagatcctgcatcccgaagagtgcatgtatgccgtgggacagggcgcactgggggtggaagtgagggccaaggaccaggatatcctggatctggtgggagtgctgcatgatccggagactctcctgcgatgcatcgcagagagggcatttcttaggcatcttgagggcggctgttccgtgcccgttgctgtgcacacagccatgaaggacggccagctctacctgaccggcggggtgtggtccctggacgggagtgactcaatacaagagaccatgcaggccactatacacgtgcccgcccaacacgaggacgggccggaagacgatccccagctggtcggaatcactgccaggaatatcccccgaggccctcagctggctgcgcagaatctgggaatcagcctggcgaatcttctgctgtcaaagggagccaaaaatatactcgatgttgcccgacagctgaacgatgcccac

SEQ ID NO: 250523 - DNA, 1083 bp, Artificial Sequence
  Description of Artificial Sequence: Synthetic coding sequence
atgagcgggaatggaaacgcggccgcaaccgcagaggagaattcaccaaagatgcgggtgatacgggtgggaacgagaaagtcacagctggccagaatccagactgacagcgtggtggctaccctgaaggcctcctacccggggttgcaattcgagatcatcgctatgtctacgaccggagacaaaatcctggacactgcgctgtcgaagatcggagagaaatcattgttcactaaagagcttgaacacgcgttggagaaaaacgaggtggatctcgtggtccatagcctgaaagacctgcctaccgtgctgccaccaggattcaccattggagccatctgcaagcgcgaaaatccgcatgacgctgtcgtctttcacccgaagtttgtcggaaaaaccctggaaaccctgccagagaagtcggtggtgggtacttcgtccctgcggcgcgctgcccaactgcaaagaaagttcccccatctggagttccggagcattcgcggaaatctgaacactagactccgcaagctcgacgaacagcaggagttctcggccatcatcctcgcgacggccggtttgcagcgcatgggatggcacaacagagtgggacagatattgcatccagaagagtgtatgtacgcggtcggccaaggcgcgctgggtgtagaagtgagagctaaagaccaggacatcctcgacctcgttggagtgctgcatgatccggagactctgctgcggtgcattgcagaaagagcgttcctgcgccacttggagggaggctgcagcgtcccggtggcagtgcacaccgccatgaaagatggccagctctatctgaccgggggcgtttggtcacttgacggtagcgactccatccaggaaactatgcaagcgaccatccatgtcccggcgcaacacgaagatggacccgaggacgaccctcaattggtcggaatcactgcaagaaacatcccacgggggccgcaactggccgcacagaacctcggaatttcacttgcgaacctgctgctgagtaagggtgcaaagaatattctcgacgtggcccgccagctgaatgacgctcat

SEQ ID NO: 250524 - DNA, 1083 bp, Artificial Sequence
  Description of Artificial Sequence: Synthetic coding sequence
atgagcggcaacggtaacgctgcagcaaccgcagaggaaaactcgccaaaaatgcgggttattagggtgggaacgcgaaagtcacagttggcgaggatccagactgattccgtggtcgctaccctgaaggcatcctaccctgggctccagtttgagatcattgctatgtcgaccactggagataagatactggataccgcactgagcaagattggcgaaaagtccctctttaccaaggaacttgaacatgcactggagaagaacgaggtggatctggtggtgcattccctgaaagacctccctacggtgctgccccccggcttcactattggagctatttgtaagcgcgagaatcctcacgatgcagtcgtgtttcaccctaagttcgtgggaaagactctggaaactctcccggaaaagtcggtggtggggacctcctcattgcggcgggcagcacaacttcagcggaaattcccacacctggaattccgtagtattcgcggtaatctgaacacccggctgcggaagctggatgaacaacaggaattttcggccattattctggcaactgcgggactccagcgcatggggtggcataacagggtggggcagattctccaccccgaggaatgcatgtacgccgtgggccagggcgcacttggagtggaggtgagggcaaaagatcaagatattctggatcttgtcggagtccttcatgaccctgaaaccctgctgcgatgtattgcagaaagagcctttctccgtcatctggaaggtggttgttcggttccagtggcagtccacactgccatgaaagacggacaactttacctcaccgggggcgtgtggtcgcttgacggtagcgactcgatccaagaaactatgcaagctaccatccatgtcccagctcaacatgaggatggcccggaagatgaccctcagcttgtgggaattaccgcacgcaatattcctagaggcccccaactggcggcacaaaaccttggtatatcactggcaaatctgctcttgtccaaaggagccaagaatatactcgatgtggcacgccagcttaacgatgcacat

SEQ ID NO: 250525 - DNA, 1083 bp, Artificial Sequence
  Description of Artificial Sequence: Synthetic coding sequence
atgagcggcaacgggaacgccgccgctaccgccgaagagaactcacccaagatgagggtcatccgggtaggtaccagaaagagtcagctagcccgaatacagactgactcagtggtggccacgctgaaagcatcctatccaggcttacaatttgaaattatagctatgtcaaccaccggggataagattctggatacggccctgtcgaagataggagagaagtcactgttcactaaggagctggaacatgctctggagaaaaacgaggtggacctcgtggtgcacagcctaaaggacctgcctacagtattgccaccaggttttacaattggggccatttgtaagcgagaaaatccccacgacgctgtggtgttccaccctaagttcgtgggaaagaccctggagacactgcctgaaaagtctgtcgtcggaacaagctctctacggcgcgccgcgcaactccaaagaaagttcccccatctcgagtttcggagcatccgcggaaacctcaataccaggctgcgcaaactggacgagcagcaagagttttctgcgatcattctagcgacagccggcctccagcgcatgggatggcataacagggttgggcagatcctccaccccgaggaatgtatgtacgctgtgggccagggtgcactgggggttgaggtgagagccaaagatcaggatattttggatctcgtcggtgttctgcacgaccccgaaacccttcttaggtgcatcgctgagcgtgcattcttgagacacctcgaaggaggatgcagtgttcctgtggctgtgcacaccgcaatgaaagatggacagttgtatctcacaggcggtgtgtggtccctcgacggtagcgactcaatccaggaaacgatgcaggctacgatccacgtcccggctcagcacgaagatggcccagaagatgacccacagttggtcgggatcaccgcacggaacattcctcggggcccgcagttggccgctcaaaatctcggtatttcactggctaatttgctactgtccaaaggtgcaaagaacattctcgatgtggccaggcagctgaatgacgcccac

SEQ ID NO: 250526 - DNA, 1083 bp, Artificial Sequence
  Description of Artificial Sequence: Synthetic coding sequence
atgtcgggtaacggaaacgcggcggccactgctgaagaaaactcaccgaaaatgcgcgtaatccgcgtgggaactagaaagtctcaactcgcaagaatccagactgactccgtcgtggctactttgaaggcctcctacccaggactgcaatttgaaatcatcgctatgtcgaccaccggcgataagattctcgacactgccctgagcaagatcggagaaaaatcgctgttcaccaaggagctggagcacgcgctcgagaaaaatgaagtcgacctggtggtgcattcgcttaaagatcttccgaccgtgctcccacccgggttcactatcggagccatctgcaagagggagaatccccacgacgcagtggtgttccacccgaaattcgtcggcaagaccctggagactctcccagaaaagtcggttgtgggtaccagttcgctgcggcgcgcagcacagctgcagcgtaaattcccacacctggagttcaggagcattcggggcaatcttaatactaggctccgcaaattggacgaacagcaggagttttcagccattattctggccacggcagggctgcaacggatgggctggcataatagagtgggacagatcctccatccggaagagtgcatgtacgcagtagggcaaggagccctgggggtggaggtccgggccaaggaccaagatatcctggacctggtgggcgtgctccacgacccggaaaccctcttgcggtgcattgccgaaagagcgttcctgcggcacctggagggaggttgttcggtgcctgtggcggtccataccgcaatgaaagacggccagctgtacctcactggcggcgtgtggtcactcgacggttcggattcaatacaggaaaccatgcaggctaccatccacgtgccggctcaacatgaggacggtcctgaggatgacccgcagttggtgggaatcaccgcgcgcaacattccgaggggaccgcaactggcagcccagaatctgggaatttccctggccaacctgctcctctcaaaaggtgcgaagaacatcctcgatgtcgctcgccaactgaacgatgcacac

SEQ ID NO: 250527 - DNA, 1083 bp, Artificial Sequence
  Description of Artificial Sequence: Synthetic coding sequence
atgtcaggaaacggaaacgccgccgcgaccgctgaggaaaactccccaaagatgagagtcattcgcgtgggcactcggaaatcacagttggcccggatccagaccgactctgtggtggccacccttaaggcttcatacccaggcctgcagtttgaaatcattgccatgtcgaccacgggtgacaagatccttgacactgcgctgtccaagatcggagaaaagtctctgttcaccaaggagttggaacacgccctcgaaaagaatgaggtcgatctggtggtccattcactgaaggacctccctaccgtgctcccacccgggttcacgatcggagcaatctgcaaacgcgaaaatccgcacgacgccgtggtgtttcatccgaagtttgtgggaaagactttggaaaccttgccggaaaagtccgtcgtcggaacttcctcacttcggcgggcggctcagctgcagcgcaagttcccccaccttgagttcagatcgattaggggtaatctgaacactcgtctgcggaagttggacgagcagcaggaattctccgcgattatcctggcgacggccggtctgcaacggatgggctggcataaccgcgtcggacagatcctccacccagaagaatgcatgtacgctgtcgggcagggagcactgggggttgaagttcgcgcaaaggatcaagatatcctggacctcgtgggggtgctccacgacccggaaacgctgttgcgctgcattgcagaacgcgccttcctgagacatctcgagggtggatgttccgtgcctgtggctgtgcacaccgctatgaaagacggacagctgtatctcaccggaggcgtgtggtcgctcgacggatcggacagcatccaggaaacgatgcaggccaccatccacgtccctgcccaacacgaggacggacccgaggatgatccacagctggtcggaatcactgccagaaacatcccaaggggaccccagctggccgcgcaaaatctgggaatcagcctcgccaaccttctgctttcgaaaggagcgaaaaacatcctcgatgttgctcggcaactgaatgacgcccat

SEQ ID NO: 250528 - DNA, 1083 bp, Artificial Sequence
  Description of Artificial Sequence: Synthetic coding sequence
atgtcagggaacggtaatgcagctgcgaccgctgaagaaaactctccaaagatgagagtcatccgagtgggaactaggaagtctcagctggcaaggatccaaaccgatagtgtggtagccacactcaaggcatcatatcctggactccagtttgagatcattgcaatgagcacaaccggagataagattctggacaccgctctgagtaaaatcggtgagaaatccctctttaccaaagagctggaacacgccctcgagaagaacgaagtggacttggtggtccattcactcaaagaccttcccacagtattgccgccaggattcacaatcggcgcgatttgcaaaagagagaaccctcacgacgcagtggtctttcacccaaaattcgtgggaaaaaccctggagactctgcccgagaagtccgtggtgggaacttctagcttgcggagagcagctcagctgcagaggaagtttccgcacctcgagtttaggtctatccggggaaatctgaatacgagactgcggaagcttgatgaacaacaagagtttagcgccattattttggctactgctggacttcagagaatgggttggcacaatcgggtggggcagatcctgcaccctgaggaatgcatgtatgcagtcggacagggcgccctgggcgtggaggtgagagctaaggatcaggatatccttgacttagtgggcgtcctgcatgatcctgagacacttctcagatgtattgccgagcgggcattcttacgacaccttgagggcgggtgtagtgtccctgtggctgtccatacagctatgaaagacgggcagctgtatctcacaggaggagtgtggagtctcgacgggtcagactcaatccaggagacgatgcaggccaccattcacgtgcctgctcagcacgaggatggtcctgaggatgatcctcagttggtgggtatcacagccaggaacatccctcgtggaccgcagctggccgcccaaaacctggggataagcttggctaaccttctgctgagcaaaggagctaaaaacatcctggacgtcgcccggcaactcaatgatgctcac

SEQ ID NO: 250529 - DNA, 1083 bp, Artificial Sequence
  Description of Artificial Sequence: Synthetic coding sequence
atgagcgggaacgggaatgctgccgcaacagctgaggagaattccccgaaaatgagggtcatccgagtcggcactcgaaaaagccagctggcccgtatccagaccgattcggttgtagctactctaaaagcatcataccctggcttacagtttgagatcattgcaatgtcaacaaccggagataaaatacttgatacggccctctctaagatcggggagaagtcactgtttacaaaagagttggagcatgcactggaaaagaacgaggtggatctagtggtacacagtctgaaagatctgcccacagttctgcccccgggatttacaataggagccatttgcaagcgggaaaacccgcatgatgcggtggtcttccatccaaaattcgtcggaaagaccctagagacgctgccggaaaaaagcgttgtcggaacttcctcactgcggcgggccgcccaattgcagcgaaaattccctcacttagagttccggtccatccgaggtaacctgaacactaggttacggaagttggatgaacaacaagagttctcagccatcatcctcgccactgccggccttcaaaggatggggtggcacaatcgcgtgggtcagatactccaccccgaggaatgtatgtacgcagtcggtcagggagctctcggagttgaggttcgcgcgaaggatcaggatattctggatctggtcggagttcttcacgacccagagacactgttgcgctgtattgcggaacgggcgttcttacgacacctcgaaggcggctgctcagttcctgtcgcggttcacacggctatgaaagacggacagctttacctgacaggaggcgtttggtcactcgatggatcagacagcattcaggaaacgatgcaggcaacgattcatgttccagcccagcatgaggacggtcctgaggacgaccctcagctggtgggtattactgcacggaatattcccagggggccccagctggccgcccaaaatctaggcatatccctggcaaatctgctcctgagtaaaggcgcaaagaatattctcgacgtcgccaggcagctcaacgacgcacac

SEQ ID NO: 250530 - DNA, 1083 bp, Artificial Sequence
  Description of Artificial Sequence: Synthetic coding sequence
atgagcggcaacgggaacgccgcggccacggctgaggagaattctcctaagatgcgcgtcattcgggtggggaccaggaaatctcagttggcccgcatccagacggactctgtggtcgcaacacttaaagctagctatcctggtctgcaatttgaaataatagctatgagcaccacaggcgacaagatactggacacagctctcagcaaaatcggcgagaaatctctgttcactaaggaactggagcacgccctcgagaaaaatgaggtggaccttgtggtgcacagcctgaaggacctgcctaccgtcctgcctccggggttcacaataggggctatctgcaagagggaaaatccgcacgatgccgttgtgttccacccaaaatttgtagggaagactctggagaccctgcccgagaagagcgtggtgggaactagttctttacggcgcgccgcccagcttcagaggaagttcccacacctagagttcagatcaatccgcggcaacctgaatacaagactgcgtaagctggatgagcagcaggagttctctgctataatactcgccactgctggcttgcagcggatggggtggcacaatcgcgtggggcagattctgcaccctgaagaatgcatgtatgccgttggacagggcgctcttggagtagaagtccgggccaaagaccaggacatcttggatttggtcggggtactgcacgatcccgagacgcttctgcgctgcattgcagaaagagcctttctgcggcacctggaaggcggctgttctgttcctgtcgcagttcacaccgccatgaaagatgggcagctctatctgacaggtggcgtgtggtccctagatggcagcgactctatccaggagaccatgcaggccacaatccatgtgcctgcccagcacgaagatggaccggaggacgacccacagttggtcggcattaccgccaggaacataccacgggggcctcagttagccgcccaaaatctagggatttccctcgccaatctattactgtctaaaggagccaagaatatactggacgttgcacgtcagctgaacgatgcacac

SEQ ID NO: 250531 - DNA, 1083 bp, Artificial Sequence
  Description of Artificial Sequence: Synthetic coding sequence
atgagcggaaacgggaatgcagccgctaccgctgaggagaacagccccaaaatgagggtgatccgcgtgggtacccgtaagagtcagttagcccgcatccagactgattctgtcgtagccactcttaaggcctcttatcccggtttgcaattcgagatcattgctatgtctactacaggagacaagattctagacactgcattgtctaagataggagaaaagagccttttcaccaaggaactggagcatgccctggaaaagaatgaagtagacctggttgtccacagcctgaaggatctaccaacagtgcttcctcctggattcacaatcggtgctatatgtaagagagaaaacccacacgatgccgttgtgttccaccctaagtttgtgggaaagacactggaaaccctccccgagaaaagtgtggttggtacatcgtcattacgccgggccgcccagttgcagcggaaatttcctcatcttgaattcagaagtatccggggcaatttgaatactaggcttcggaagctggatgagcagcaggaatttagcgccattattcttgccaccgctggcctgcaacgcatgggttggcacaatagagtgggacaaatcttgcaccccgaggagtgcatgtacgccgttgggcaaggtgccctcggtgttgaagtgcgggcgaaggatcaggatattctggacttggtgggtgtattacatgacccggaaactctcctgagatgcatagccgaacgtgcctttcttagacatctcgaggggggctgcagcgtgccagtagccgtgcacacggctatgaaggacggacaactgtacctgactgggggcgtgtggagcttagatggatcagatagtatccaggaaactatgcaggctactatccatgtgccagcacagcatgaagacggtcctgaagacgatccacagctggtgggaatcacagcacgtaatatcccccgaggtccccagctggcggcccaaaacctgggaatcagtcttgccaatctgttgctgtctaagggcgcgaaaaacatcctcgatgtggctcggcaactcaatgatgcccac

SEQ ID NO: 250532 - DNA, 1083 bp, Artificial Sequence
  Description of Artificial Sequence: Synthetic coding sequence
atgagcggaaacggaaacgcggccgctacggcggaagagaattcgccgaagatgcgcgtcatcagagtcggcactcggaagtcgcagctggctcgcattcagaccgactccgtcgtcgccactctgaaggcctcttaccctggcctgcagtttgaaattatcgccatgagcactactggagacaagatccttgacaccgctctctctaaaataggcgagaagtccctgttcacgaaggaactggagcatgccctcgagaagaatgaggtggatctggtcgtgcactcactcaaggacttgcctactgtgctcccgccgggatttaccatcggagccatctgtaaacgggaaaacccgcatgacgccgtggttttccatccaaaatttgtgggtaagaccctggaaactctgccggagaagtcagtggtgggaacctcgtccctgcgccgcgcggctcaactccagaggaagttcccccaccttgaattccgctccattcgcggaaatctgaacactcgcctgcgcaagctcgatgaacagcaggaatttagcgcgatcatcctggcgacggcgggactgcaacggatgggatggcataaccgggtgggacagatcctccatccggaggaatgtatgtacgctgtcggacagggagcgctgggagtggaagtcagagccaaggaccaagatatccttgatctcgtgggcgtgctgcacgatcctgaaaccctgctcagatgcatcgctgaacgcgcctttctcaggcacctggaaggaggatgctcggtgccagtcgctgtgcacactgcgatgaaggatgggcagctgtacttgaccgggggagtgtggtccctggacggcagcgactcgatacaagaaactatgcaagcaactatccacgtcccagctcaacatgaggacggtcctgaagacgacccccaattggtggggatcaccgcgcggaacatcccgcgcggaccgcagctggctgcccaaaatctcggcatctcacttgcgaatttgctcctgagcaaaggtgccaagaatatcctcgatgtcgcccggcagctcaatgatgctcat

SEQ ID NO: 250533 - DNA, 1083 bp, Artificial Sequence
  Description of Artificial Sequence: Synthetic coding sequence
atgagtgggaatggaaacgctgccgctacagccgaagaaaattcacccaaaatgagggtgatacgggtggggactcggaaatcgcagctggctagaatccagactgacagtgtagtggccacattgaaagcctcttatcctgggctccagtttgagatcatcgcaatgtccactactggagataagatcctcgatactgccctttctaagattggagagaaatctttattcactaaagagcttgagcacgcactggaaaagaatgaagtagacctggttgtccatagtcttaaagatctgccaactgtacttccccctgggttcactataggagcgatttgtaaacgggaaaacccgcacgatgccgtggttttccatccaaaattcgtagggaaaacactcgaaacacttcctgagaaatccgtagtgggaacttcctcactaaggagggccgcgcagctccagcggaagttcccacatttagaattcaggagtattcgaggaaatttaaacacaagattacgcaaactcgatgagcaacaggaattttcagccatcatactcgccacagctgggctccagcgaatggggtggcataatcgggttggacaaattctacatcctgaagaatgcatgtatgccgtcgggcagggagcacttggggttgaagttagggcaaaagatcaggatatactggatctggttggagtgctacacgatccagaaacattacttagatgtattgctgaacgcgcctttctcagacacctagaaggggggtgttccgtccctgtggctgtgcatacagcaatgaaggacgggcagctttacctcactggaggagtgtggtctctagatggatctgattccatccaggaaacaatgcaggctacaatacacgtccccgctcagcatgaagatgggccagaagatgatcctcagctggtagggattactgcaagaaatatccccaggggaccccagcttgctgcccagaacctggggatcagtctggcaaaccttctgctaagtaaaggagccaagaatatcctcgacgtcgcacggcagcttaatgacgctcac

SEQ ID NO: 250534 - DNA, 1083 bp, Artificial Sequence; identical to SEQ ID NO: 250486
  Description of Artificial Sequence: Synthetic coding sequence

SEQ ID NO: 250535 - DNA, 1083 bp, Artificial Sequence
  Description of Artificial Sequence: Synthetic coding sequence
atgtcgggaaatggaaacgccgctgccacggccgaagagaattcacctaaaatgcgggtgatccgggtagggacgcgcaagtcccagctggcacggattcagactgactccgtggtggccactctgaaagcgtcgtacccgggtctgcaattcgagatcatcgctatgtcaaccactggcgataagattctggacaccgctctgtccaagatcggagaaaagagcctgttcactaaggaactcgagcatgctcttgagaaaaatgaggttgatctggtggtccactctctcaaggatctgccaaccgtacttccgccgggattcactatcggtgccatttgcaagagggagaacccacacgacgccgtggtgttccaccccaaatttgtgggcaagacgctcgagactcttcccgaaaagagcgtcgtgggaaccagctcactgagacgggctgcacagcttcaacgaaaattcccacatctcgagtttcgttccatcaggggtaatctgaacacccgcctgcgcaaacttgacgaacaacaggaattctctgcgatcatcctggccactgcgggactccagcgcatgggatggcacaacagagtcggacaaatcctgcatccggaggaatgcatgtacgccgtggggcagggcgctctgggcgtcgaagtgcgggccaaagaccaggacatcctcgacctggtgggagtcctccacgaccccgaaactttgctcagatgcatagcggagcgtgctttcctgcgacacctggaaggagggtgttccgtcccggtggccgtccataccgccatgaaggacggtcagctttaccttaccggaggcgtgtggagcctggatggatcggattcgatccaggaaacgatgcaggccacgatccatgtccccgcacaacatgaggatggccctgaggacgatccacagctggttggcatcaccgctagaaacatcccccggggtccgcaattggcggcccaaaacctcggaatcagcctcgcgaaccttctgctctcgaagggtgcgaaaaacattctggatgtggccaggcaattgaatgacgcgcac

SEQ ID NO: 250536 - DNA, 1083 bp, Artificial Sequence
  Description of Artificial Sequence: Synthetic coding sequence
atgtcgggcaatggaaatgccgcagctactgctgaggaaaactcacctaagatgcgcgtgatccgggtgggaacaaggaaatctcagctcgcaagaatacaaactgacagcgtcgtcgctactctcaaggccagctatccgggcctacagttcgaaatcatagcgatgagcacgacgggagacaagattctggatactgcactcagtaagatcggcgagaagagcctgttcacaaaggagctggagcacgcgcttgaaaaaaatgaggtcgatctggttgttcactcattgaaagacctacccactgtccttccaccaggttttaccatcggcgccatctgtaaacgagaaaaccctcacgatgctgttgtgttccaccctaaattcgttggcaagactctggaaacacttccagaaaagagcgtggtgggaacatcaagtctcaggagagccgcacaactgcagagaaagtttccacatttagaattccgcagcattcgcgggaacctgaataccagactgcgcaagcttgatgagcagcaggagttttccgctatcattctggcaacggcaggcttacagcggatgggttggcacaaccgagtaggccaaatcctccacccagaggagtgtatgtacgccgtcggccaaggggcccttggggtcgaggttcgcgccaaagatcaggacatcctcgacctggtgggtgtcctgcacgatcccgaaacattgcttagatgcatagcggagcgcgcgttcctccgtcacctggaaggcggttgctccgtgcccgtggcagtgcatactgcaatgaaagatggtcagctctatttaaccggcggtgtctggagcctcgatggctcagattctattcaggaaacaatgcaggcaaccattcacgtgccagcccagcacgaagatggccccgaggacgatcctcaactggtgggcatcacagcaaggaacatcccgaggggaccacagctggccgcccaaaacctgggtattagccttgcaaatttgctcctctcaaaaggggccaaaaatattcttgacgtcgcaagacagcttaatgatgcacac

SEQ ID NO: 250537 - DNA, 1083 bp, Artificial Sequence
  Description of Artificial Sequence: Synthetic coding sequence
atgtcgggcaatggtaacgctgcagcaaccgcggaggaaaactcaccgaaaatgagagtgatccgggtcggaacgcgcaagagccagcttgcacgcatccagaccgatagcgtcgtggcaaccttgaaggcaagctaccctgggctgcagttcgagattatagccatgtcgaccactggcgacaagatacttgataccgccctcagcaaaatcggtgaaaagtcactcttcaccaaagaacttgaacacgcactggagaagaacgaggtggatctggttgtgcattcacttaaggacctccccaccgtgcttcctcctggattcaccattggagcaatttgtaagagagagaatcctcacgatgccgtggtgttccatcctaagtttgtagggaaaacgctcgaaaccctgccagagaaatcggttgtgggaactagctcccttcggcgcgcggcacaactgcagcgtaagttcccccatcttgaatttagatcgattagaggaaatcttaatacccgtctgcgaaagctggatgagcagcaagaattcagcgcaattatcctggccaccgcaggtctgcaacgcatgggatggcacaacagagtgggccagattctgcatccagaggaatgtatgtacgcggtgggtcaaggggcactgggggtggaagtgagagcgaaggaccaggatatcctcgatttggtcggagtcctgcatgatcccgaaaccttgctgcgctgtatcgcggagcgggcatttttgcggcatctggaaggcggatgcagcgtgccagtggcggtccatactgcaatgaaggatggacagctttacctgactggtggggtctggtcgctggacggtagcgattccatccaggagactatgcaggcgaccatccatgtcccggcccagcacgaagatggaccagaggacgatccccagctggtggggattaccgcacgcaacataccccgcgggcctcaacttgcagcacaaaacctcggcatttcccttgcaaatctgctgctgtcaaagggagcaaagaacatacttgatgtcgcaagacaactgaatgacgcccat

SEQ ID NO: 250538 - DNA, 1083 bp, Artificial Sequence
  Description of Artificial Sequence: Synthetic coding sequence
atgtcaggaaacgggaacgcagcagcaaccgcagaagaaaactcaccaaagatgcgggtgatccgagtgggcaccagaaaatcacaactggcacggatccagaccgattccgtggtggccaccctgaaagcaagctacccgggcctgcaattcgaaatcattgccatgtcgaccactggtgataagatcctggacaccgccctgagcaagatcggggaaaaatcactgtttaccaaggaacttgaacacgctcttgaaaagaacgaagtggaccttgtggttcacagcctcaaggatcttcctaccgtcttgccacccggatttactattggagcaatctgtaagcgtgaaaacccacacgatgcggtggtgtttcatccaaaattcgtgggaaagactctggagactcttcctgagaaatcggtggtgggcaccagctccctccgaagagcagcacagcttcaaaggaagtttccacatctggaatttcgctcaattcggggtaatcttaacacgagactccggaagctcgatgaacaacaagagttctcggccattattctggcaaccgcagggctgcagcgtatgggatggcataatagagtgggtcagatacttcatcccgaagagtgtatgtacgccgtcggtcaaggagcacttggtgtcgaagtgcgggcaaaggaccaagatattctggacttggtgggtgtgctccatgatccagaaaccttgttgagatgtatcgcagaacgcgcattcctgaggcatctcgaaggcgggtgctcggttcctgtggcggtgcacaccgctatgaaagacggacaactgtacctgaccgggggtgtctggagcctggatggatcggattccatccaagaaactatgcaagccactatccatgttcccgctcaacatgaggacggtcctgaggatgaccctcaactggtgggtatcaccgcaaggaacatcccacgcgggccacagctggcagcacagaatctgggaatttcgcttgccaaccttctgctctccaaaggtgcaaagaatatcctggacgtggcgaggcaactgaatgatgcacat

SEQ ID NO: 250539 - DNA, 1083 bp, Artificial Sequence
  Description of Artificial Sequence: Synthetic coding sequence
atgtcgggaaacggtaacgcagccgccaccgcagaagaaaatagccctaagatgagagtgattcgggtcggcactcggaagtcacagctcgcgcggattcaaactgattccgtcgtcgcaaccctgaaggcatcttatccaggacttcaatttgaaatcatcgcaatgtccaccaccggtgataagattcttgatactgcactgtcgaagattggtgagaagtcactgttcacgaaggagctggagcacgctcttgagaaaaacgaggtggatctggtggtgcatagcctcaaggaccttccaaccgttttgccacctggttttaccatcggagcaatttgcaaaagagagaacccgcatgatgctgtagtgttccaccccaaatttgtgggaaaaacccttgaaaccctgcccgagaagagcgtggtcggcacttcaagccttagacgcgcagcacaacttcaacgaaaattcccccatcttgagtttagatcaattaggggtaatttgaacacccgactgaggaagttggatgaacagcaggaattctcggcaataatcctcgccaccgcaggtttgcagcgaatgggctggcacaaccgcgtggggcagatcctccacccagaagaatgtatgtatgcagtgggtcagggagcacttggcgtcgaggtgagagcgaaggaccaagacattcttgatttggtcggagtgctccatgacccagagactctcctgagatgtatcgcggaaagggcatttctgaggcatctggagggcggttgtagcgttcctgtggccgtccacactgccatgaaggacggacagctttaccttactggtggagtgtggtccttggacggttccgattcgattcaagaaaccatgcaagcgactatccatgtgcccgcccaacatgaggatggacctgaagatgacccccaacttgtcgggatcactgcaaggaacattccacgtggaccacaattggcagcacaaaatctgggtattagccttgcaaatctgcttctgtccaagggagccaagaatatcctcgacgtcgcacgccaactcaacgacgctcat

SEQ ID NO: 250540 - DNA, 1083 bp, Artificial Sequence
  Description of Artificial Sequence: Synthetic coding sequence
atgtcggggaacggtaatgccgcggccaccgcagaggaaaactcacctaaaatgagggtgataagggtgggaaccagaaagtcgcaactcgcacgtattcaaactgattcggtggtggcaaccctgaaagcctcataccctggactccaatttgaaatcatcgcaatgagcactactggcgataagattctggatacggccctctccaaaatcggagagaagtccctctttaccaaggaacttgaacacgcactcgaaaagaacgaagtggaccttgtcgtccattctctcaaggacttgcctactgtgttgcccccaggtttcactattggtgccatttgtaagcgggaaaaccctcatgacgcagtcgtattccatccaaagttcgtcggtaaaactctggaaacccttccggagaagagcgtggttggcaccagtagcctgcgccgagcagcacagctgcagcggaaatttccacatctcgaattccgctccatacgcggcaacctcaataccagactgagaaagctggatgaacaacaagaattttcggctatcatccttgccactgcgggtttgcaaagaatggggtggcacaatcgggtgggccagatccttcatcccgaggaatgcatgtacgctgtgggtcaaggggcactgggggtggaggtccgggcaaaggatcaggacatcttggatctcgtgggagtcctgcacgatccagaaacgcttctgcgttgtatcgcagaacgtgcgtttttgcgccatctggaaggtggatgctccgttcctgtggctgtacataccgcaatgaaggatggacaactgtacctgactggaggtgtgtggagcctggatggatcagattcgatacaagagactatgcaggcaaccattcacgtgccagcacagcatgaggacggaccggaggacgatccccagcttgtgggcattaccgcgaggaacattcctagagggccacagttggcggcacagaacctgggcatttcccttgcgaatctgcttctgagtaaaggagccaagaatattctggatgttgcgcgacaacttaacgacgcccac

SEQ ID NO: 250541 - DNA, 1083 bp, Artificial Sequence
  Description of Artificial Sequence: Synthetic coding sequence
atgtccggaaacggtaacgccgccgccaccgctgaagaaaactccccaaagatgagggtgatcagagttggcacgcgtaaatctcagctcgcaaggatccagactgactccgtcgtcgctaccctcaaagctagctacccagggctgcagttcgagattattgctatgtccaccaccggagacaaaatcctggatacggccttgtctaagataggcgagaagtcgctcttcactaaggaattggaacatgcgctggagaaaaacgaggtcgaccttgtcgtccactcattgaaagacctgcctacagtgctgcctcccggctttacaataggagccatatgcaagcgggagaacccacatgacgctgtcgtgttccatcccaagtttgttggcaaaaccctggaaactctgcctgaaaagtccgtagtcggtacctcgtctttgcgaagagcagctcagctgcagcgcaaattcccacacctggagtttcgtagcatccgcggaaatcttaacactagactgaggaaactggatgaacagcaggaattttctgccattattcttgccaccgccgggttacagagaatgggatggcataatagggtgggccagatcctgcatcccgaggaatgtatgtatgctgtgggccagggcgctctgggtgtagaggtcagggctaaggatcaggacatactcgacttggtgggtgtgctgcatgaccctgagaccctgcttcggtgcatcgccgagcgagcttttcttcggcacctggaggggggttgctccgtacccgtggcagtacacacagcaatgaaggatggccagttgtacctgaccgggggggtctggtcactcgacggctcagattctattcaggagaccatgcaggccactattcacgtccccgcccagcatgaggatggccccgaagacgatcctcagctggtgggcatcacagctagaaacatccccaggggaccccagttggccgcccagaacctcgggatctcgctggctaaccttctcctgagcaaaggagccaagaacattctggacgtggccagacagctaaatgacgcccat

SEQ ID NO: 250542 - DNA, 1083 bp, Artificial Sequence
  Description of Artificial Sequence: Synthetic coding sequence
atgtcagggaacgggaatgcagccgccacagccgaggagaattcccctaaaatgcgagtgattagggtgggtacaagaaaatcacagctggccaggatccagaccgactcagtggtggctactctcaaggcctcctatccgggactgcagttcgaaattatcgccatgagtacaacaggcgataaaatacttgatacagccctgagcaagataggagaaaagtcactgttcacaaaggagctggagcacgcgctggagaagaacgaagtggatctggtggttcactcactgaaggacttgccaacagttctgcctccgggcttcaccattggcgccatctgtaagcgcgagaacccccacgacgctgtggtcttccatcctaagttcgtcgggaaaacactcgaaacgttgcccgagaaatccgtcgtggggacctcaagcctgaggagggccgcccagctgcagaggaagtttccacatctggagtttagatccattagggggaacctgaatacccgcctgcgcaagctcgacgaacagcaggaattctctgccatcatcttggccactgccgggctgcagcgcatgggttggcacaaccgggtggggcagatcctgcatcctgaagagtgtatgtacgcagtcggacaaggggccttgggggtggaagtgcgggcaaaagaccaggatatcctggatctggtcggtgtgctgcatgatccagagacactgctgcgatgcattgccgagagagcctttctccggcacctcgaaggcgggtgcagcgtaccagtcgccgtgcacactgcgatgaaggatggacaactgtacctgactgggggggtgtggagtttggacggatctgattctattcaggagacaatgcaggctaccatccatgtcccagctcagcatgaggatgggccagaagatgatcctcaactggtcgggatcacggctcggaacattccaaggggaccacagctggccgcccagaacctgggtatctccctggctaatctcctgctgagtaagggcgccaagaatatcctggacgtagcaaggcagctcaacgatgcgcac

SEQ ID NO: 250543 - DNA, 1083 bp, Artificial Sequence
  Description of Artificial Sequence: Synthetic coding sequence
atgagtgggaatggaaacgccgcagccactgcagaggaaaactctccaaaaatgagggtaataagggtcgggactcgcaaatcccagcttgctcggatacagactgactctgttgtggcaacacttaaagctagttatcctggacttcagttcgaaattatcgctatgtccacaactggagataaaattctcgacacagcactgtcgaagattggggaaaaatctctgtttacaaaagaactcgaacacgctctggagaaaaacgaagtggatcttgtggtgcatagtttaaaagatttaccaactgttctaccccccggatttacaattggagctatctgcaaacgggaaaatccccacgacgccgtagtgtttcatcctaagtttgtaggaaaaacgctggagactctccccgaaaagtctgtggtgggaacttcctctcttaggagagcagctcagcttcagcgaaaattcccccatctcgaatttaggagtatccgcgggaaccttaacacaaggctccggaaactagatgaacagcaggagttctccgccatcatactggcaactgctgggctgcagcgcatgggatggcacaacagggtggggcagatcctgcatcctgaagaatgcatgtacgccgtcggacagggggctcttggggttgaagtccgagccaaagatcaagatatactcgatcttgtcggagtcctgcatgatccagaaacactcctcaggtgtattgctgagcgggcattccttcggcacctagagggggggtgcagtgtccctgtggcggtccacacagccatgaaagatgggcagctatatctcactggaggagtctggagtctggatggatccgatagtatccaggaaactatgcaggctacaatccacgtacccgcccagcatgaggacggacccgaagatgatcctcagcttgttgggatcactgcccggaatatacctaggggaccccagctcgccgcccagaacctgggaattagtctcgcgaatctactcctttccaaaggagctaaaaatatccttgatgtagcccgccagttgaatgatgcccac

SEQ ID NO: 250544 - DNA, 1083 bp, Artificial Sequence
  Description of Artificial Sequence: Synthetic coding sequence
atgtctgggaacggaaacgccgcggcaacagccgaggagaactctccaaagatgagagtcatacgggttgggacgcgaaagagccagcttgcccggatccagacagattccgtggtggccaccctcaaagcatcataccccggactgcagtttgaaattatcgcgatgagcactaccggcgacaaaatcttagataccgccctgagcaaaatcggagaaaagtccctcttcacgaaggaactggaacacgcgctggaaaagaatgaagtagacctggtggtacactcactcaaggatctgcccaccgtgctgcctcctggattcaccattggcgctatatgtaagcgagaaaaccctcatgatgccgttgtgttccacccaaaatttgtcggcaagacgcttgagactcttcctgagaagtctgtagtgggtacatcgagtctacgccgagccgctcaacttcaacgtaagttcccacacctagagttccgaagcataaggggcaacctcaacacccgacttagaaagctggatgagcaacaggaattctcggccatcatccttgccactgcaggactgcagcggatgggctggcacaacagagtgggacagatcttacaccccgaagagtgtatgtatgctgtgggccagggggccctgggagtagaggtgagggccaaggatcaagacatcttagatctcgtgggcgtgctgcatgaccccgagacgctgctgcgctgtatcgcagagcgggctttcctgaggcatctcgaagggggatgctccgtccctgtggctgttcatactgcgatgaaggatggccaactctatctcaccggcggcgtgtggtcattggacggatccgactctatccaagaaacaatgcaggcaacaatacacgtacccgcgcagcacgaagacggccctgaggacgatccgcagttggtgggcatcacggcccgtaacatcccccgtgggccgcagctggccgcgcagaacctaggcatctctctcgccaacctcctgctatcaaagggtgcgaaaaatatcttggatgtggcccgccagttaaatgacgctcat

SEQ ID NO: 250545 - DNA, 1083 bp, Artificial Sequence
  Description of Artificial Sequence: Synthetic coding sequence
atgtccggaaacggtaatgcggcggctaccgcggaggaaaactctccgaagatgcgggttatcagggtcgggactcgaaaaagccaactggctcgtatccagacggacagcgtggtcgcgaccctgaaggcatcctatccaggtctgcaatttgagataatcgcgatgagcaccacgggtgacaaaatcctcgataccgccctctcgaaaattggcgagaagagcctgttcacgaaggagctggaacatgctctagaaaagaatgaagtggacctggttgtgcattctctaaaagatcttccgaccgtacttccgcccggctttaccatcggcgctatttgtaagcgcgaaaaccctcacgatgcggttgtgtttcatccaaagtttgtgggtaagacgcttgaaaccttgcctgagaagagcgttgttggtacctcctctttgcgccgagctgctcaattgcagaggaagttcccgcaccttgaattccgctccatccggggaaatctcaataccagactgcgcaagctggatgaacagcaggagttcagcgccattatcctggcaaccgcgggtcttcaaagaatgggttggcacaacagggtcggacaaatacttcaccctgaggagtgcatgtacgccgtcggtcaaggggcactgggtgtcgaggtgcgagccaaagatcaggacattctggatctggtcggagttctccacgaccccgaaactctgctacggtgcattgccgagagagcgttcctaagacatctggagggtgggtgctccgttccagtggcagtgcacactgcaatgaaggatggccagctgtatctgactggtggcgtgtggagcctggacggcagcgattctattcaagagaccatgcaagcgaccattcacgttcctgcgcagcacgaggatggaccagaggacgatccacaacttgttggcattacggctcggaatataccacgaggtccgcaactggccgcccagaacttggggatctctttggccaacctgctgctctcaaagggggcaaagaacattctggacgtcgcacgccagctaaatgacgcccac

SEQ ID NO: 250546 - DNA, 1083 bp, Artificial Sequence
  Description of Artificial Sequence: Synthetic coding sequence
atgtccggtaacggtaacgcggcagcaacggcagaggagaactcacctaagatgcgggtcattagagtgggaaccagaaagagccagctcgcaaggatccagaccgatagcgtggtggcaactctcaaggcctcttaccccggtctgcaatttgagattatcgcaatgagcaccaccggggacaaaatcctggataccgcactgtccaagattggcgaaaagagcctgttcactaaggaactcgaacacgcgctggagaagaatgaagtggatttggtcgttcattcccttaaggatctgcctaccgtcctcccacctggtttcaccattggcgcaatttgcaaaagagaaaacccacatgatgctgtggtgtttcacccaaagtttgtgggcaaaactcttgaaaccttgcccgaaaaatcggtggtcggtacttcttcgctgcggcgggcggcccaactccaacgaaagtttccgcatctcgagttccggtccattcgcggaaatctgaatactaggctgaggaagctggatgaacagcaggaattttccgctatcattctcgcgaccgcgggacttcaaagaatgggttggcataaccgagttgggcagattctgcatcctgaggaatgtatgtacgcggtggggcagggagcattgggcgtagaggtgcgtgccaaagatcaagatattcttgatcttgtcggggtccttcacgacccagaaaccctgcttcgatgtatcgcggagagagcgtttcttagacacctcgaaggtggctgctcggtccctgtggccgtgcataccgctatgaaggacggtcaactctacttgactggcggagtgtggtccctcgatggctccgatagcatacaagaaactatgcaagcaacgatccacgtcccggcgcaacatgaagatggacccgaggatgatcctcaactggtgggtataaccgcacgcaacatccctcggggacctcagctcgctgctcaaaaccttggtatcagcctggctaacctgcttctctcaaaaggtgccaagaacattcttgatgtggccaggcagctgaacgacgcacat

SEQ ID NO: 250547 - DNA, 1083 bp, Artificial Sequence
  Description of Artificial Sequence: Synthetic coding sequence
atgagcggaaacggtaacgcggcggcaaccgcggaagagaattcacccaagatgcgtgtgatccgagtcggtaccaggaaatcccagcttgcccgcatacagactgactcagttgtggctacgttgaaggccagctaccccggactgcagttcgaaatcattgcaatgtcgactaccggcgacaaaatcttggacactgctctctccaagatcggagaaaagtcactgttcaccaaggagctggagcacgcgctggagaaaaatgaggtggacctggttgtccactctctcaaggacctcccgaccgtgctgccacctggattcaccatcggagccatctgtaagcgggaaaacccacatgacgccgtggtgttccatcccaagtttgtgggcaaaactctggagactctcccagagaagagcgtcgtgggcacctcctctctgagacgtgccgcgcagcttcagcggaagttcccgcatctggagttccgctcgatccgcgggaacctgaatactcggcttagaaaactcgacgaacagcaagaattttcggcgattatcctcgcgactgcgggactgcagcgcatgggatggcacaaccgggtgggacaaatcctgcacccggaagaatgcatgtacgccgtgggacaaggggcattgggtgtggaggtgagagccaaagatcaggatatactggatctcgtgggcgtcctccacgatcctgagactctgctgcgctgcatagcagaaagggctttccttcgccatctggaagggggttgctccgtgccggtcgcggtccacacggccatgaaggatggtcaactgtacctgaccggaggagtctggagcctggacggatcggactcaatccaagaaactatgcaagcgaccatccacgtgccggctcagcacgaggacggcccggaagatgatcctcagcttgtgggcatcaccgcccggaacatcccacgcggcccacagttggcggcacaaaatctgggaatttccctcgccaacttgctgctgtcgaagggtgccaagaatattctcgacgtcgcccgccagcttaatgatgcccat

SEQ ID NO: 250548 - DNA, 1083 bp, Artificial Sequence
  Description of Artificial Sequence: Synthetic coding sequence
atgagcggtaacggcaacgctgccgccacagctgaagagaactctcccaaaatgagggtcatacgtgtcggaacgcgcaaatctcagctggctaggatccagaccgatagcgtagtggctactcttaaagctagttatcctggcctgcagtttgaaatcatagccatgtccaccacaggcgacaaaatcttggatacagccttatctaagataggagagaagtccttgttcactaaggagctggagcacgcactcgagaagaatgaagtagaccttgtggtccatagcttgaaggatcttcccacagtgcttcccccaggctttacaatcggggcaatttgcaaacgcgaaaacccacacgacgccgtggtcttccatccgaagtttgtagggaaaacccttgaaacactgccggagaagagtgtggtgggtacctctagtctcagaagagctgcacaactgcagagaaagtttccacacctcgagtttagaagcatcagagggaacctcaacactagattgagaaaacttgatgagcagcaggaattttcagcgattattctggccaccgctggacttcaacgcatggggtggcataacagggtcggtcagatcctccatccagaggaatgcatgtacgccgtgggacagggagcactcggggtggaagtgagggctaaggatcaggacatcctggacctggtgggagtgttacacgatccggagacactgttgcgatgtatcgccgagagggcttttctgagacacctcgaagggggctgcagtgtgccagtggcagtgcacacagccatgaaggacggacagctgtacttaacaggaggagtttggagtctggatgggagcgactctattcaggagaccatgcaagccacaatccacgttccagctcagcacgaggatggccctgaggatgatcctcagcttgtgggcattacagcgaggaacatcccccgcgggcctcagcttgctgcacaaaatctcggtattagcctggccaaccttttgctcagcaaaggtgccaagaacatcctcgatgtggcccgtcaactgaacgatgctcat

SEQ ID NO: 250549 - DNA, 3132 bp, Artificial Sequence
  Description of Artificial Sequence: Synthetic coding sequence
atgaagcccggatgtgcagctggttcacctggcaacgaatggatcttcttttctaccgacgaaatcactacccgttacagaaatactatgtcaaacggtggtctgcagcggtcggtgatcctgagcgcccttatacttctgagagcggtcaccggcttttccggagacgggcgtgccatatggtccaagaatccaaactttacgccagtgaatgaaagccagctgttcctgtacgatacgttcccaaagaactttttctggggaattgggactggcgccctgcaggtggaaggttcctggaagaaagatggcaaggggccttccatctgggaccacttcatccatactcatcttaagaacgtgtcatcgaccaacggttcctccgatagctacatattccttgagaaggatctttcagcactggatttcatcggtgtctcgttttaccaatttagtattagctggcctcgactgttccctgacggcattgtgaccgtggcaaacgcaaagggtctgcaatactattcgacccttttggacgcactggtgcttcggaatatcgagcctattgtgaccctgtaccattgggaccttcctttggcactccaggagaaatacggaggatggaagaacgacactataatcgatatctttaatgattacgccacctactgtttccaaatgtttggagatagagtgaagtactggattactatccataatccttaccttgtggcatggcatggatacggaactggaatgcacgccccgggtgagaagggaaacctggcggcagtctacaccgtgggccataatctgataaaagcgcatagcaaggtgtggcacaactataacacccactttaggcctcaccagaagggatggctctcaattaccttgggttcgcattggattgaaccaaatcgctccgaaaacaccatggacattttcaagtgccagcaatcgatggtgtcggtgcttgggtggttcgcaaatcctatacacggcgacggagattacccagaaggaatgaggaagaaactgtttagcgttttgcctatattctcggaagcagaaaagcacgagatgcgaggtacggcagatttcttcgctttctcatttggcccaaacaatttcaagcctttgaatactatggccaaaatgggtcagaacgtgtcactgaacctgcgcgaagcactcaactggattaagctcgagtacaacaacccacgcatactcatcgcagaaaacggctggtttacggactcccgggtgaaaaccgaggacaccactgcgatttacatgatgaagaactttctttcgcaggtcctgcaagccattcgcctggacgaaatccgggtgttcggatataccgcatggtccttgcttgacggatttgaatggcaggacgcgtatactattcgtcgaggcctgttctacgtggatttcaacagcaaacagaaggagcggaaaccaaaatcatcggcacattactacaaacaaatcattcgtgaaaacggattctcgctgaaggaaagcaccccagatgtgcagggtcaatttccatgcgatttttcatggggcgtcaccgaatcggtgcttaaaccagagagcgtcgcctcctctcctcaattttctgatccccacctgtacgtttggaacgcaaccgggaaccgtcttttgcatagggtggaaggtgtcagactgaaaactcggcctgcacaatgtaccgactttgtgaacattaagaagcaactggaaatgctcgcacggatgaaggtgacccactaccgttttgcactggattgggcgtccgtgctgccaactgggaatctttcggccgtgaacagacaagcactgagatattacagatgtgtcgtctctgaaggtcttaagctcgggatatcggcaatggtgacgctgtactaccctacgcacgcacaccttggattgcccgaaccgctgttgcacgcagatggatggcttaacccttccactgcagaagcatttcaggcgtacgcgggcctgtgcttccaagaactgggggatcttgtcaaactgtggatcactatcaacgagcctaacaggctgtcggacatatacaaccgctccggcaatgatacttacggtgcagcacataatctcctcgtcgcacacgccctggcctggagactgtacgaccgccagtttcgcccgtcacagaggggcgcagtgtcactttcactgcacgcagattgggcggaaccagcaaatccttacgcagactcgcactggcgcgcagccgaacgctttttgcagtttgagatagcatggtttgccgaacctctctttaagaccggagactaccctgcggcaatgcgagagtacatcgcatcaaagcatcgtagaggactttcgagctccgcacttccaaggctgaccgaagctgaacgcagactgctcaagggcactgtcgacttctgtgcactcaatcactttactacgaggtttgttatgcatgaacaacttgccggttcacgatacgatagcgatcgggacattcagttcctccaagatattacccggctgtcgtcgcctactagactggccgtgattccctggggtgtccgcaaacttttgcggtgggttcgaaggaattatggggatatggacatctacataactgcgagcggaattgatgaccaagccctggaagatgatagactgcgaaagtactacttggggaagtaccttcaagaagtgcttaaggcctaccttatcgacaaagtccgtatcaaaggttactatgcctttaaacttgcagaagaaaagtccaagccacggtttggcttcttcacctcggatttcaaggcaaagtcatccattcagttttacaacaaggtcatctcgtctaggggatttccatttgaaaactccagctcaagatgttctcaaacccaagagaacaccgagtgtactgtgtgtctttttctcgtccaaaagaagcccctgatcttccttggatgctgcttcttctccaccctcgtgctgcttctcagcatcgcaatcttccaacgacagaagcgccgcaagttctggaaggcaaagaaccttcagcatataccgctgaagaaaggaaaacgcgttgtctca

SEQ ID NO: 250550 - DNA, 3132 bp, Artificial Sequence
  Description of Artificial Sequence: Synthetic coding sequence
atgaagcccggctgtgccgcaggaagccccgggaatgaatggatatttttcagcactgatgaaatcacaactcgttatcgtaacacaatgagcaacgggggcctccagagatctgtgatcttatcagctcttatattgttacgagcagtgaccggattcagtggggatggacgcgccatatggtctaaaaatcctaatttcacaccggtgaacgaaagccagctgttcctatatgacacttttcctaagaatttcttttggggcattggaactggcgcgctgcaggttgaggggtcatggaaaaaagatggcaaaggcccaagcatctgggatcacttcatccacactcacctcaagaatgtgagctcaaccaacgggtcctcggactcttatatcttcctggagaaggacctgtcggctctcgatttcatcggagtatctttctatcaattttccatttcttggcctaggttgttccctgatggcatcgtgaccgtggcgaatgccaaagggctccagtactactcaacattgcttgacgccctcgtgctgagaaatatcgaacccattgtgaccttgtatcactgggatctgccactggctctgcaggagaaatatgggggttggaagaacgataccattatagatatattcaacgactacgcaacgtactgttttcagatgttcggggacagagttaaatactggatcaccattcataatccttatttggtggcgtggcatggctacggaacaggtatgcacgccccgggcgagaaggggaacctggccgccgtgtatacagtgggccacaatctaatcaaagcacacagcaaagtctggcacaactataacacccatttcagaccccaccagaagggatggctctctattactctaggttcacattggattgagccaaacaggagcgaaaataccatggacatttttaaatgccagcagtcaatggtgagtgtcttgggctggttcgcaaaccccattcacggtgatggggattacccagaggggatgcgcaaaaagctgttcagcgtactgccgattttttccgaagccgagaagcatgaaatgagagggacggcagacttcttcgcctttagctttggacccaacaatttcaagccactgaatacgatggcaaaaatgggacaaaatgtttccctgaacctgagagaggctctcaactggatcaagttggagtataataatccacgtatactgatcgccgagaacggctggttcacagactcaagagtgaaaacggaggatactactgccatctatatgatgaagaattttctgtcacaggtgctccaggctattaggctggatgaaattcgggtttttgggtacacggcgtggagtctgctagacgggttcgagtggcaggacgcttataccatccggagagggctgttctacgtcgacttcaatagcaagcagaaggagcgtaagcccaagtcctcagctcattactacaaacagatcatcagggagaatggcttctcactgaaggagtctactcctgacgtgcaaggccagttcccctgcgacttcagttggggcgtcactgagtcagtgcttaagccagagtcagttgcttctagccctcaattcagcgatccacatttgtacgtgtggaacgccacaggaaatcgcttgctgcaccgagtggaaggcgtccgactcaaaacaaggcccgcacagtgcaccgacttcgtgaacataaagaagcaactggaaatgcttgcccgcatgaaggtcacacattaccggtttgctttggattgggctagtgtcctgcccacgggcaatcttagcgctgtcaatagacaggctctacgttattatcgttgtgttgtgtctgagggcttgaagctcgggatcagtgccatggtgacgctgtattaccctacacacgcacacttgggcctgccggaaccgctgttgcacgcggatgggtggctgaatccttccaccgcggaagctttccaagcttacgctggcctgtgcttccaggagctgggcgatctggtgaaactctggataaccatcaatgaacccaacaggctgtcagacatttacaatcggagtggcaacgacacatatggtgcagcccacaaccttctcgttgcacacgccctcgcttggcggctgtatgaccgccagttccgaccctcccagcgtggagcagtttctttatctctccatgccgactgggccgagcccgcgaatccctacgccgactcccattggcgggctgcggaaagattccttcagttcgagatagcttggtttgctgagccattgttcaagactggcgactaccctgccgccatgagagagtacattgcctcaaagcatagacggggcttaagcagctccgcacttccacgactgaccgaggccgagaggcgtttgctgaagggcaccgtagacttttgcgctctgaaccacttcactaccagattcgtcatgcatgagcagctagcagggagtcgctacgacagtgatagggacattcaattcctccaagacatcactagactatcttcccctactcgtctggcagtgattccatggggagtgaggaaactactgcgatgggtgcgccgcaactacggagacatggacatctacataacagcttcgggcatcgatgaccaggccctggaagatgaccgtctgcgaaaatattacctcggtaagtatttgcaggaggtactcaaggcttatctcattgataaagtcaggattaaaggatattacgctttcaaactggctgaagaaaagtccaaacctcggttcggcttttttacgtccgactttaaagcaaagtcgtcgattcaattctataacaaggtgatcagctctcgggggttcccttttgaaaactctagtagcaggtgttcccaaacacaggagaataccgaatgcacagtttgcttgtttctggtccagaagaaacccctcatcttcctcggctgctgcttttttagtaccctagtgctgttgctctcaatcgctatcttccagcgtcagaagaggagaaagttttggaaggcaaagaaccttcagcacatccctcttaagaaaggaaaacgcgtcgtcagt

SEQ ID NO: 250551 - DNA, 3132 bp, Artificial Sequence
  Description of Artificial Sequence: Synthetic coding sequence
atgaagccaggatgcgctgcaggatcgcctgggaacgagtggatcttcttctcgactgacgaaatcaccactagataccggaacaccatgtccaatggagggctgcagcggtccgtgattctgagcgcgctgatcctcctccgggccgtcaccgggttctcgggagacggaagagccatctggtcgaaaaacccaaatttcactcctgtgaacgaatcgcagctctttctgtacgacacgttcccgaaaaacttcttttggggaatcggcaccggagccttgcaggtggaaggctcctggaaaaaggacgggaagggaccttccatttgggaccacttcatccatacccacctgaaaaacgtcagctcaactaacggatcgagcgatagctacatcttcttggagaaagatttgtcggcactcgatttcatcggagtgtccttctaccagttttcgatctcctggccgcggctcttcccagacggaattgtgaccgttgcgaatgcaaagggcctgcagtactactccactctcctcgatgcgctggtccttcggaacatcgaaccgatcgtgaccttgtaccactgggacctgccattggcattgcaggagaaatacggagggtggaagaatgacactatcatcgatatcttcaacgactatgcgacgtactgctttcagatgttcggtgacagagtcaagtactggataaccatccataatccatacctcgtcgcttggcatggctacggcaccggaatgcatgcgccaggtgagaagggcaatttggccgccgtgtacaccgtgggacacaacctgattaaggcacactccaaagtctggcacaactacaacactcacttccggccgcaccagaagggatggctgtctattactttgggctcgcactggatcgagccaaaccggagcgagaacaccatggatatcttcaaatgtcagcaatcaatggtgtcagtgctcggatggtttgccaaccctatccatggtgacggagattatcccgaaggaatgagaaagaagttgttttcggtgctcccaattttctcggaagcagaaaaacacgaaatgcgcggaactgccgatttcttcgcgttttcgtttggaccaaacaactttaaaccgctgaataccatggccaaaatgggacaaaatgtcagcctgaacctccgcgaagcgctcaactggatcaagctggaatacaacaaccccagaatactgatcgccgaaaatggatggttcacggactcacgggtcaagaccgaagatacgactgccatttacatgatgaagaactttctctcccaggtgctccaggcaatccgactggatgaaatccgggtctttggatacactgcctggagcctgctcgatgggttcgaatggcaagacgcttacactatccgccgcgggctcttctacgtggatttcaactcaaagcaaaaagagcgcaagccaaagtctagcgcgcattactacaagcaaatcattcgcgaaaatggtttctccctgaaggagagcacccctgacgtgcaaggacagttcccatgtgatttttcatggggagtcaccgaaagcgtactcaaaccggaatcggtcgcatcgtccccccagttctccgacccgcacctgtatgtgtggaacgctaccggcaaccggctgctgcatcgcgtggagggggtgagactcaagacccgccctgcgcaatgcactgatttcgtcaacattaagaagcagctggaaatgcttgcacgcatgaaggttactcactaccgcttcgccctggattgggcctcagtgctgcccacgggaaacctgtcggcggtgaaccggcaggcgctgaggtactacagatgcgtggtatcggagggactcaaacttggaatctcagctatggtcaccttgtactatccaacccacgctcatctgggacttcccgaaccactgcttcacgccgatggttggctgaacccctccactgctgaggcctttcaggcttacgcgggactttgctttcaagaactcggggacttggtcaagctgtggatcactatcaacgagccgaatagactgtcggacatctacaaccgctctggaaacgacacctacggggccgcccataacttgctggtggcccacgcgctggcatggcgcctctacgatcgccagttccggccaagccagagaggagctgtctcgctttcgctgcacgcagactgggcggagccggcaaacccgtacgcagatagccactggcgcgcggcagaacggtttttgcagttcgagatcgcatggttcgccgaacctctcttcaaaaccggcgactacccagccgcgatgcgtgaatacatcgcatcgaagcatcggcgcggcctgtcctcttcggccctcccgcggcttactgaagctgaacgccggctcctcaagggaaccgtggacttctgcgcgcttaatcacttcactacgcgcttcgtgatgcatgaacagttggccggatcgcgctacgatagcgatcgggatatccaattcttgcaggatatcacccgcctgtccagcccgacgagattggcggtgataccgtggggtgtccgcaaactgcttagatgggtccgccgcaactacggcgacatggatatctacatcactgcgtccggcatcgatgaccaagcattggaggacgacagactgagaaaatactacctgggtaagtacctgcaagaagtgctcaaagcctatctcatcgataaggtgcggatcaagggttactacgccttcaaactggctgaagaaaagtcgaagcctcgctttgggttctttacctcagacttcaaggcgaagtcatccattcaattctacaataaagttatttcaagccgcggatttccctttgagaacagctcatcccgttgttcgcaaactcaggagaacaccgagtgcaccgtctgccttttcctcgtccaaaagaagccgctgatcttcctcggatgttgcttcttcagtactctggtgctgctcctcagcatcgcaatctttcagagacaaaagcgcaggaagttctggaaagccaagaacctgcaacacatccctctgaagaaaggcaaacgggtcgtgtcc

SEQ ID NO: 250552 - DNA, 3132 bp, Artificial Sequence
  Description of Artificial Sequence: Synthetic coding sequence
atgaaacctggctgtgcggcaggctcccctgggaacgagtggatattcttctcaaccgacgagataaccaccagatacaggaataccatgtcgaatggcggtttgcagcggtccgtgattctgagcgcactgattctgctgcgcgcagtcactggttttagcggtgacggccgcgcaatctggagcaaaaatccaaatttcactcctgttaacgagagccagctgttcttgtacgacaccttccctaagaatttcttttggggaattggaactggcgcgctccaagtggaaggatcctggaaaaaggatggtaagggtccgtcaatatgggatcactttatccacacccatctcaaaaacgtgagctccactaacggctcatcagactcgtacatttttcttgagaaagacctgtcggctcttgacttcataggagtcagcttttatcagttcagcatttcctggcctcgcctgttcccggatggtattgtgaccgtggcaaacgcaaagggcttgcaatactacagcacgctcctcgacgcactggtccttcgaaacatcgagcccatagtgaccttgtatcactgggatctgcctctggccctgcaagaaaagtacggaggctggaaaaatgataccataatagacatctttaacgattacgccacctactgtttccagatgtttggtgatagggtcaaatactggatcactattcataacccttacctcgtggcatggcatggttacggaaccggtatgcatgctcctggtgagaagggaaaccttgcagccgtgtacactgtgggccacaatttgattaaggcacattcgaaggtctggcataactacaacacccattttagacctcaccaaaaaggctggctgtcgattaccctgggatcgcattggattgagcccaaccgctcggagaacactatggacatattcaaatgtcaacaatcgatggtcagtgtcctggggtggtttgcaaatccaatccatggagacggagactacccagaaggaatgaggaaaaaacttttttcggtccttccaattttcagcgaggcagaaaagcacgagatgaggggaactgctgatttcttcgcattcagctttggtcccaacaactttaaacccctgaacaccatggcgaagatggggcaaaatgtgagcctgaatcttagagaggcgcttaactggatcaaactggagtacaacaaccctcgaattttgattgccgaaaatggatggttcaccgacagccgggtgaaaaccgaagatactaccgcaatttacatgatgaagaacttcttgagtcaagtgctccaagcaattaggctggatgagattagggtgtttgggtacaccgcatggtcgcttctggatgggtttgaatggcaggatgcatataccattcgcagaggcctcttctacgtggatttcaactccaagcagaaggaacgcaagccaaagtcctctgcgcactactacaaacagatcattcgcgaaaacgggttttcactgaaggaatccacgcctgatgtgcaaggacaatttccatgcgatttctcgtggggagtcaccgaaagcgtgctcaagccggagtcggttgcctcgtccccacaattctcggaccctcacctttatgtgtggaatgcgactggtaatagactcctgcatcgggtggaaggcgtgcggcttaagacgcgcccggcacaatgcacggattttgtgaacataaagaagcaactggaaatgcttgcaagaatgaaagtgacccactacagattcgcactggattgggcatccgtgctccctactggcaacctgagcgccgtgaatcgacaggctctgcggtactacagatgcgtggtgtccgaaggcctgaagctgggaatctcggcaatggttacgttgtattacccgacccatgcacatctgggattgcctgagccactcctccatgctgatggatggctgaatccctccaccgcggaagcgtttcaggcttacgcaggtctgtgttttcaagaactgggagatctcgtcaagctgtggattaccataaatgaacccaaccgtctctccgatatctacaacaggtcgggaaacgatacctacggagcggcacacaaccttctcgtggcacatgcactggcctggagactgtacgatcggcagtttcgaccttcccaacgaggggctgtgtcgctttcgcttcacgcagattgggccgaacctgcgaacccatacgcagactcacactggagagcagcggagaggtttctccaatttgaaattgcatggttcgcagaaccgctcttcaaaactggcgattaccctgccgctatgcgcgaatacattgcatcgaagcataggcggggactttcctcgtctgcactccctcgactgacggaggcagagcggcggctgctcaagggtacggtcgatttttgcgcacttaaccactttactactagatttgtgatgcatgaacaactcgccggatcgcggtacgattcggaccgcgatattcagttccttcaagacattaccagactttcttcccctacccggctcgctgtcataccatggggagtgagaaagctgctccggtgggtcagacgtaattacggagacatggatatctacatcaccgcaagcggaattgacgaccaagctcttgaggatgatagactgcggaagtattaccttggaaagtacctgcaagaagtgctgaaggcgtaccttattgacaaagtgcggattaaggggtactacgccttcaagctggcagaagagaagtctaagccacgatttggctttttcacctcggactttaaggccaagtcgtcgattcagttctacaacaaggtgatttcctccagaggattccccttcgaaaactcctcgtcgcgatgctctcagacccaagaaaacactgaatgtactgtgtgtctgttcttggtccagaagaagcccctgatctttctgggatgttgctttttctcgaccctggtccttcttctctcgattgccatttttcaaagacagaagcggcgcaagttttggaaggcgaagaacctgcagcatatccctctgaagaagggcaagcgtgtggtgtca

SEQ ID NO: 250553 - DNA, 3132 bp, Artificial Sequence
  Description of Artificial Sequence: Synthetic coding sequence
atgaaacccggctgcgccgccggttccccagggaatgagtggatctttttctcaacagatgagataacaactcgctaccgaaacacaatgagcaatggcggtctccagagatctgtcattctcagtgcactgatcctcctgagggcagtcactgggttctctggtgacggtcgggccatctggtcaaaaaatcctaacttcacaccggtcaatgagagtcagttgttcctgtacgacacatttcccaagaatttcttttgggggattggcacaggggcactgcaggtggaggggtcctggaagaaggacggcaaagggccaagcatttgggaccacttcattcatactcatcttaagaacgtttcctcaaccaatggatctagtgatagctatatcttcctcgaaaaagacctttccgccctggactttattggggtttccttctatcagttcagcatctcatggccaaggctgttcccagacggaattgttacagttgcaaacgcaaaagggttgcagtattactctacgttgcttgatgccttggtgctcagaaacattgagcctattgtgacgctctatcattgggatctcccactggccctccaggagaagtacggtgggtggaagaacgacacgatcatagacatcttcaacgattacgccacttattgctttcagatgtttggcgatagagtaaagtattggatcacgatacacaatccctacctcgtagcctggcatgggtacggcaccggaatgcacgcgcccggcgaaaagggaaatctggccgcagtctatacggtgggtcacaacctcatcaaggcacattcaaaggtgtggcataattataacacacacttccgccctcatcaaaagggatggttgagtatcacgctgggaagccactggatcgagccaaatagatcagaaaataccatggacatttttaagtgccaacagtctatggtttctgtcttgggctggttcgcaaacccaatccacggcgatggggattatccagaggggatgcgcaaaaagctgttcagtgttctgccaatctttagcgaagcagagaagcacgaaatgaggggaacggctgatttcttcgccttctctttcgggccgaacaatttcaagcctctgaataccatggccaaaatggggcagaatgtgtctcttaatctgagggaagcccttaattggataaaacttgaatacaacaatcctaggatcctcatagcggagaatgggtggtttacggattctagagtgaagacagaagatactacagccatctatatgatgaagaacttcctgtcccaagtgctgcaggctatacggctcgacgagattagagtttttggctataccgcatggtccctgctcgacgggtttgaatggcaggacgcatatacaatcaggcgagggctcttttatgtggatttcaattcaaaacagaaagaaagaaaaccgaagagttccgcacactattacaaacagatcatcagagagaacggcttcagcctgaaggaatcaacccccgacgtccagggccagttcccctgcgatttcagttggggcgtgacggaatcagtgctgaagccagagtctgtggcatcctcacctcagtttagtgatccccacctgtatgtctggaacgccaccggcaacaggctgctgcacagggtggagggtgtgaggcttaagacacggcccgctcagtgcactgattttgtgaacattaaaaagcagctggagatgctcgccaggatgaaagtgacgcattacaggtttgcgctggattgggcatctgtgctgccgaccggcaatctgtctgccgtgaatcgccaggcccttaggtactaccgatgtgtggtttccgagggcctcaagctgggaatttcagctatggtgactctgtactatcccactcacgcccatctcggactgccagagcctctgctccacgcggatggatggctcaatcccagtacggcagaggcctttcaagcctatgccggactctgttttcaggagctgggcgaccttgtcaagctctggataaccatcaatgagccaaacaggttgagcgacatttataacagatccggtaatgacacatatggagctgcccacaacttgctggttgcacacgccctcgcctggagactgtacgatcgccagtttagacccagccagcggggcgccgtcagtctgagtcttcacgccgattgggctgagcccgctaacccttatgccgactctcattggcgggccgcagagcgatttctgcaattcgaaattgcttggttcgccgagcctttgttcaagacaggggattatccagccgcaatgcgggagtacatcgcttctaagcacaggagagggctcagttccagcgccctgcctcgcttgaccgaggctgagcggaggctcttgaagggtacagtggacttttgcgctctgaatcatttcaccactaggtttgtcatgcacgagcagctcgctggtagccggtacgactcagatcgggacatccaattccttcaggacatcactcgactgagtagccctactagactggccgtgataccttggggcgttagaaagctgttgcggtgggtccgacgcaactatggggacatggacatctatattactgccagcgggattgacgatcaggccctggaagatgatcggcttcgcaagtactatttgggaaagtatctgcaggaagtgctgaaagcctaccttatcgataaggtgcgcatcaagggctactacgcctttaagttggctgaagagaaatcaaagcctcggtttggtttcttcacatctgactttaaagcaaagagctcaatccagttttacaataaggttatatctagtcgaggctttcccttcgagaacagctccagtcgctgtagtcagactcaggagaacacagaatgtacggtctgccttttccttgtgcagaagaaacccctgatctttcttgggtgttgtttcttctcaaccctcgtcctcctgctgtccatcgcaatttttcagagacagaaacggcggaagttttggaaggccaagaacctccagcacatccccctgaaaaaaggcaagcgggttgtgagt

SEQ ID NO: 250554 - DNA, 3132 bp, Artificial Sequence
  Description of Artificial Sequence: Synthetic coding sequence
atgaaaccgggttgtgcggcgggttcgccgggtaatgaatggatatttttttcgacggatgaaataacgacgcgttatcgaaatacgatgtcgaatggtggtctacaacgttcggttatactatcggcgctaatactattacgtgcggtaacgggtttttcgggtgatggtcgagcgatatggtcgaaaaatccgaattttacgccggttaatgaatcgcaactatttctatatgatacgtttccgaaaaattttttttggggtataggtacgggtgcgttacaagtagaaggttcgtggaaaaaagatggtaaaggtccgtcgatatgggatcattttatacatacgcatttaaaaaatgtatcgtcgacgaatggttcgtcggattcgtatatatttctagaaaaagatttatcggcgttagattttataggtgtatcgttttatcaattttcgatatcgtggccgcgactatttccggatggtatagtaacggtagcgaatgcgaaaggtctacaatattattcgacgctattagatgcgctagtattacgaaatatagaaccgatagtaacgttatatcattgggatttaccgttagcgctacaagaaaaatatggtggttggaaaaatgatacgataatagatatatttaatgattatgcgacgtattgttttcaaatgtttggtgatcgtgttaaatattggataacgatacataatccgtatttagtagcgtggcatggttatggtacgggtatgcatgcgccgggtgaaaaaggtaatttagcggcggtatatacggtaggtcataatctaataaaagcgcattcgaaagtatggcataattataatacgcattttcgaccgcatcaaaaaggttggttatcgataacgttaggttcgcattggatagaaccgaatcgttcggaaaatacgatggatatatttaaatgtcaacaatcgatggtatcggtactaggttggtttgcgaatccgatacatggtgatggtgattatccggaaggtatgcgaaaaaaactattttcggttttaccgatattttcggaagcggaaaaacatgaaatgcgtggtacggcggatttttttgcgttttcgtttggtccgaataattttaaaccgttaaatacgatggcgaaaatgggtcaaaatgtatcgttaaatttacgagaagcgttaaattggataaaattagaatataataatccgcgtatattaatagcggaaaatggttggtttacggattcgcgtgttaaaacggaagatacgacggcgatatatatgatgaaaaattttctatcgcaagtattacaagcgatacgtctagatgaaatacgtgtatttggttatacggcgtggtcgttattagatggttttgaatggcaagatgcgtatacgatacgtcgaggtctattttatgtagattttaattcgaaacaaaaagaacgtaaaccgaaatcgtcggcgcattattataaacaaataatacgagaaaatggtttttcgctaaaagaatcgacgccggatgtacaaggtcaatttccgtgtgatttttcgtggggtgttacggaatcggtattaaaaccggaatcggtagcgtcgtcgccgcaattttcggatccgcatttatatgtatggaatgcgacgggtaatcgactactacatcgagtagaaggtgttcgtctaaaaacgcgaccggcgcaatgtacggattttgttaatataaaaaaacaattagaaatgttagcgcgaatgaaagtaacgcattatcgatttgcgctagattgggcgtcggtactaccgacgggtaatttatcggcggttaatcgacaagcgttacgatattatcgttgtgtagtatcggaaggtttaaaattaggtatatcggcgatggttacgttatattatccgacgcatgcgcatttaggtctaccggaaccgctattacatgcggatggttggttaaatccgtcgacggcggaagcgtttcaagcgtatgcgggtctatgttttcaagaattaggtgatttagttaaactatggataacgataaatgaaccgaatcgtctatcggatatatataatcgttcgggtaatgatacgtatggtgcggcgcataatctactagttgcgcatgcgctagcgtggcgattatatgatcgacaatttcgtccgtcgcaacgaggtgcggtatcgttatcgctacatgcggattgggcggaaccggcgaatccgtatgcggattcgcattggcgagcggcggaacgatttttacaatttgaaatagcgtggtttgcggaaccgttatttaaaacgggtgattatccggcggcgatgcgtgaatatatagcgtcgaaacatcgacgtggtttatcgtcgtcggcgttaccgcgtctaacggaagcggaacgacgtttactaaaaggtacggtagatttttgtgcgctaaatcattttacgacgcgttttgttatgcatgaacaattagcgggttcgcgatatgattcggatcgtgatatacaatttctacaagatataacgcgattatcgtcgccgacgcgactagcggttataccgtggggtgttcgaaaactattacgatgggttcgacgaaattatggtgatatggatatatatataacggcgtcgggtatagatgatcaagcgctagaagatgatcgtctacgtaaatattatctaggtaaatatctacaagaagttctaaaagcgtatttaatagataaagtacgtataaaaggttattatgcgtttaaattagcggaagaaaaatcgaaaccgcgttttggtttttttacgtcggattttaaagcgaaatcgtcgatacaattttataataaagttatatcgtcgcgaggttttccgtttgaaaattcgtcgtcgcgatgttcgcaaacgcaagaaaatacggaatgtacggtttgtctatttttagtacaaaaaaaaccgttaatatttctaggttgttgttttttttcgacgctagtattactactatcgatagcgatatttcaacgacaaaaacgacgaaaattttggaaagcgaaaaatctacaacatataccgctaaaaaaaggtaaacgtgtagtatcg

SEQ ID NO: 250555 - DNA, 3132 bp, Artificial Sequence
  Description of Artificial Sequence: Synthetic coding sequence
atgaagccagggtgcgccgctggaagccctggaaatgaatggattttcttctcgacagatgaaatcactactagatatcgaaatacaatgtccaatggaggtcttcaacggtcggtgatccttagcgcacttatccttttgcgagcagtcaccgggttttcgggggatggaagggctatttggtctaagaatcctaattttactccagtgaacgaatcacagttatttttgtatgatactttcccaaagaattttttctgggggattggtactggggctctgcaagtcgagggtagttggaagaaagacggaaagggtccttccatttgggaccatttcattcatacgcatttgaagaacgtgtctagcactaatggatcctctgactcgtatatttttcttgaaaaggacctttcagccctcgacttcatcggagtctctttttatcagttcagcatctcgtggccccgtttgtttccagacggtattgttactgttgcaaacgccaagggcttgcagtattattctaccttactggatgctctcgttctaagaaatatagagcccattgttactctctatcattgggacttgccacttgcacttcaagagaagtacggtggttggaaaaatgataccattattgatatttttaatgattatgccacctattgctttcagatgtttggagacagagtgaagtattggatcaccattcacaacccatacctagtggcctggcatggatacggaacaggaatgcatgctccgggagaaaaggggaacctcgctgcagtttatactgtgggccataatttgataaaggcacatagtaaagtctggcacaactataatacgcactttaggcctcatcaaaagggctggttgagcattaccctcggaagtcactggatcgaacctaataggagcgaaaacactatggatatatttaaatgtcaacaatcgatggtttcggtacttggatggtttgctaacccaatccatggagatggagattaccctgaaggtatgagaaaaaaattgtttagtgttttgcccattttttctgaggccgaaaaacacgaaatgagaggcaccgctgattttttcgctttttcgttcggaccaaacaatttcaagcctctaaatactatggcaaaaatgggacagaatgtttccctaaatttaagagaagcactgaactggatcaaactcgagtataacaaccctcgaattttgattgcggaaaacgggtggtttacagactccagggttaaaactgaggatacgacagctatttacatgatgaaaaatttcctatcacaagtgctgcaagcaattagacttgacgaaatccgtgtattcggatatacggcctggtccctgttggacggtttcgagtggcaagatgcatatacaataaggaggggactgttctatgtcgatttcaattctaaacagaaggaacgtaaacccaagtcgtctgcacactattataagcaaatcataagagaaaacggtttttctcttaaggagtctacaccagatgtgcaaggtcaatttccttgcgatttctcttggggggttacagaatcggtgttgaaaccggagtcggttgcttcgtccccacagttctctgatcctcatctatatgtttggaacgctaccgggaaccggctcttacaccgtgttgaaggtgtgagattaaagacacgtcctgcacaatgtactgatttcgtaaacattaaaaaacaactggagatgctggcgaggatgaaagtgacccattatagattcgctctcgactgggcatccgttctgccaactggaaacctctcagccgttaataggcaagccttgaggtattatagatgtgtagtatctgagggtttaaaacttggtatttcagctatggtcacattgtactacccaacgcatgctcatctaggtctcccagaaccacttcttcatgcagacggttggctgaatccttccacagctgaggcttttcaggcttatgctgggctctgttttcaagaattgggagatctcgtgaagttgtggatcactattaacgagccaaaccgtttatcagacatctataatagatctggaaacgacacctatggtgctgcacataacttacttgtggcgcatgcattggcctggcgactttatgataggcagttccgcccgtcccaaaggggtgctgttagtttgtcgctccacgcggattgggccgagcctgcaaacccctatgctgactcacattggcgagctgctgaacggttcttgcagttcgagattgcctggtttgccgaaccactttttaagacgggtgattacccagcggctatgagagagtacattgcttccaagcatagaagaggactgagctcaagtgcactgcctagattgactgaagcagagagaagattgcttaaaggtacggttgatttctgcgctttaaatcattttaccactcgttttgttatgcacgagcaactagctggatcgagatatgattcggatagagatattcaattccttcaggatataactagactgtcgagcccgactcgtctcgctgtcattccatggggagtgagaaagttgttgcgttgggttcgcaggaactatggtgatatggacatttacattacagcatctggcatcgatgatcaggctcttgaagacgacagactccgaaagtactaccttggtaaatatttgcaagaggtcttgaaggcatacctcatagataaggtgagaattaaaggctattatgctttcaagcttgcggaagagaagtctaagccgaggttcgggttcttcacaagcgattttaaggctaagtcttcaatccaattttataacaaggtaatcagtagtagggggttcccattcgaaaattcctcttcgaggtgttcgcagacacaggagaatacagaatgtaccgtttgcctttttttggttcaaaaaaaacccttaatctttcttggctgttgttttttttctacgctcgttctacttttgagtatcgcaattttccaacggcagaagcgaaggaaattctggaaagctaagaatcttcagcacatccctcttaaaaaggggaagagggtcgttagt

SEQ ID NO: 250556 - DNA, 3132 bp, Artificial Sequence
  Description of Artificial Sequence: Synthetic coding sequence
atgaaacctggttgcgcggccggatcgccaggaaacgaatggatctttttctcgacggacgaaatcacgaccagatatagaaataccatgagcaacggaggacttcaacggtcggttattctgtctgcgctgattttgcttcgagccgtgactggtttctcgggggatggccgcgcaatttggtcgaaaaatccaaacttcaccccagtgaacgaatcgcagctgttcctgtacgataccttccctaaaaactttttctggggaattggtaccggagccctccaagtcgaaggatcgtggaagaaggatggtaagggaccttccatctgggatcatttcattcatacccatcttaagaatgtctcaagcaccaacggatcgtcagactcctacatttttctggaaaaggacctttcagcactggactttatcggcgtgtcgttctaccagttttccatctcttggcctaggctctttcccgatggcattgtcaccgtggctaacgccaaaggtttgcagtactactcaaccctcctggatgcactggtgctccgaaacattgagcctatcgtgactctttaccattgggacctgccactcgcactccaggaaaagtatggcggatggaaaaacgatactatcatagacatattcaatgactacgctacctactgctttcagatgtttggggatcgcgtgaagtattggattaccattcataacccatacctggtggcgtggcatggatacggtactggtatgcacgcaccgggggagaagggaaatcttgccgccgtgtacactgtggggcacaatctgatcaaggcccatagcaaggtgtggcacaattacaacacgcattttagacctcatcaaaagggttggctttcgatcactctgggatcccattggattgagccgaatcgcagcgaaaacactatggacatattcaagtgtcaacaatcgatggtgtccgtcctcggctggtttgcgaacccaattcatggtgatggcgattacccggaaggcatgcgtaagaaactgttctccgtgctgcccatctttagcgaagccgaaaagcacgaaatgcgcggtaccgcagatttcttcgcgttcagtttcgggcctaacaatttcaaacctctgaacactatggctaagatgggacagaacgtttccctcaacctgcgcgaggcacttaactggattaagttggaatacaataatcctcgcatactcattgctgaaaacggatggtttaccgactcgagggtgaaaactgaagataccaccgccatctacatgatgaagaattttctgtcacaggtgctccaggcaataagattggacgaaattagagtgtttggatacactgcctggtcgctgttggatggatttgaatggcaagatgcttacacgattagacgggggctcttttacgtagacttcaactcaaaacaaaaggaaagaaagccgaaatcatcggcccattactacaagcaaatcattagagagaatgggttttcgcttaaagagagcactcccgacgtgcagggtcagtttccatgtgattttagctggggtgtgaccgagagcgtgttgaaaccagaatccgtggcgtctagccctcaattttcagatccacatctttacgtctggaacgccaccggaaatcgtttgcttcatcgggtggagggagtgagacttaagacccgccccgcacaatgtactgatttcgtgaacattaagaaacaacttgaaatgctcgcaagaatgaaggtaactcattaccggtttgcacttgattgggcatcagtgctcccgactggcaacctgtccgcagtgaatagacaagcgctcaggtactaccgctgtgtcgtgtcagaaggcctcaagctcggcatctccgcaatggtcactctttactaccctacgcacgcgcatctgggacttcctgaacctctgctgcatgcggatggatggctgaatccatccactgcagaagccttccaagcctacgcaggactctgtttccaagaattgggtgaccttgtgaagctctggatcactatcaatgagcccaacaggctgtccgacatttacaatagatccggaaacgatacctacggagcggcccataaccttctcgtcgcacatgcattggcttggagactttatgacagacaatttagacctagccagcgtggtgcagtctcgttgtctttgcatgcggactgggcagagcctgccaatccctatgcggattcccattggagagctgcagagaggttccttcaattcgagatcgcctggtttgcagaaccactgttcaaaaccggtgattaccctgctgccatgcgcgagtacatcgcatctaagcatcgcagaggactttcctccagtgccctccccagactcactgaagcagaacgccggctgcttaagggtactgtggacttttgtgcccttaatcactttactactcgatttgtgatgcatgagcaactggcaggttcgcgctacgattcagacagagatattcaatttctccaagatataactagattgagcagccccactcgactggccgtgattccatggggagtgaggaaactccttcgatgggtgcgaagaaactacggggacatggacatttacatcaccgcctcgggtattgatgaccaagcactcgaggatgataggcttagaaagtactacctgggaaagtaccttcaagaagtcctgaaggcatacctgattgataaagtgcgcataaagggatactacgcgtttaaactcgccgaagagaagtccaagccacgttttgggttctttacttcggatttcaaggcgaaaagcagcattcagttttacaacaaggtcatctcatccaggggatttccatttgaaaacagctcctcgagatgttcgcagacccaagagaatactgaatgcaccgtctgtctctttttggtgcagaagaagcccctgatattcctggggtgttgttttttctccaccctggtcctgcttctgagcattgctatctttcagcgacaaaagcgccgtaagttctggaaggccaagaatctccaacacattccgttgaagaaaggaaagagagtggtgagc

SEQ ID NO: 250557 - DNA, 3132 bp, Artificial Sequence
  Description of Artificial Sequence: Synthetic coding sequence
atgaaaccaggctgcgctgctggatctccgggcaatgaatggatcttcttctcgacagatgagattacaacccggtatcggaataccatgagtaatggtggattgcaaaggtccgtgatactgtccgccctgattctcctccgagctgttacgggcttctccggcgacggccgcgccatttggtcaaaaaatccgaacttcacgcccgtgaatgaaagtcagctgttcctgtacgatacttttcctaagaacttcttctggggcatcggtacaggagcactgcaggtcgaggggagctggaagaaggacgggaaaggaccatccatctgggaccactttattcacactcacttaaagaatgtgtcttccactaacgggtccagtgattcttacatttttttggagaaagatctgagtgccctggatttcattggagtgagtttctaccagttttccattagctggccccgcttgtttcccgacgggatcgtgactgtggcaaacgctaaagggctacaatattattcaaccctgctggacgcgcttgtgctgcggaatattgaaccaatcgttactctgtatcactgggacctgccactggctttgcaggaaaaatacggcggctggaaaaatgataccatcattgatatatttaacgactatgccacatactgcttccagatgtttggcgacagggtcaagtattggattaccatccataacccttacctggtcgcctggcacggttacggcactggaatgcacgctccaggggagaaaggaaatctcgcagctgtgtataccgtgggacacaatttgatcaaggcccactccaaggtctggcacaattacaacactcacttccgcccacaccagaaggggtggttaagtatcacactggggtcccactggatcgaacccaacagaagcgaaaacacaatggatatttttaaatgccagcagtcgatggtgagtgtactgggttggttcgctaaccccattcatggcgatggtgactatccagagggaatgagaaagaagttgtttagcgtactgccaattttcagcgaggctgaaaagcatgagatgcgaggcaccgcggacttctttgcgttctcattcggtcccaataacttcaagcccttgaacaccatggccaagatgggacagaacgtgagcctcaatctgcgagaagccttaaattggatcaaactggagtacaacaatcctagaattctcatcgccgagaacggctggttcacggactcgagagtgaaaacggaagatacgacagccatctatatgatgaagaactttttgagccaggtactccaagccatcaggctggacgagatcagagtgtttggttacacagcctggtcactccttgatggctttgagtggcaagacgcatatactattcggaggggtctcttctacgtagattttaatagtaagcagaaggagcgcaaacccaagagttccgcccattattataagcagatcatcagggagaacggcttcagccttaaggaaagcacccctgacgtacaagggcagtttccctgtgacttttcttggggcgtgacggagtccgtcctgaagccagagtccgtagccagcagcccacagttctccgaccctcatttatacgtctggaacgccactggcaaccggctgctccaccgggttgagggtgtgagactcaaaacacgcccagcacagtgtacagacttcgtgaatatcaagaagcaacttgaaatgcttgcccgaatgaaggttacccactaccggttcgccttggactgggctagcgtcctccctacaggcaacctgtccgccgtcaatcgtcaggctctcagatattatcgttgcgtggttagcgaggggcttaagctcggcatcagcgcgatggtgaccctgtattacccaacccacgcccacctggggttacccgagcccctgctacatgccgacggatggctgaacccctccaccgctgaggcttttcaggcatacgctggactgtgcttccaggagttgggcgatttggtcaagctttggataaccatcaacgagcctaacagactgtccgacatctataatcggtccgggaacgatacatacggagcggctcacaacctcctcgttgcccacgctctagcctggcgcttgtacgacaggcagtttaggccttcgcaacgtggtgccgtgagtctctctctgcacgccgactgggccgaacccgctaacccgtacgccgattcacactggcgcgccgctgaacggtttctgcagttcgagatcgcctggtttgccgagcctctgtttaagaccggcgactatcctgctgccatgcgggagtacatagcgtcaaagcatagaagaggccttagcagcagtgcccttccccggttaactgaggccgagaggagactgcttaagggcacagttgacttctgcgctctaaaccatttcacaaccagatttgtaatgcatgagcagctggccggatccaggtatgatagcgaccgcgatatccaattccttcaagatatcacacgcttatccagccctacacgcttagctgtgatcccttggggagttcgtaagctgcttcgttgggtaaggagaaactacggggatatggatatctatattacagcttctgggatcgacgatcaggccctggaggatgaccgcctacggaagtactacctcgggaagtatctgcaagaggttctcaaagcctacctgattgacaaggtgcggatcaagggttactatgcttttaaattggcagaagaaaagagcaagccgcggttcgggttcttcaccagcgatttcaaggcgaagtcgtccatccaattctataacaaggtgataagctctcgcggtttccctttcgagaactcatcctccaggtgttcccagactcaggagaataccgaatgcacggtgtgtctgttccttgtgcagaagaaacctttgatttttctggggtgttgtttcttcagtactttagtacttttgttgtcaatcgccatatttcagagacaaaagcggcgcaagttttggaaggccaaaaacttacagcacatcccacttaaaaaaggaaagagagtcgtgtcg

SEQ ID NO: 250558 - DNA, 3132 bp, Artificial Sequence
  Description of Artificial Sequence: Synthetic coding sequence
atgaaaccaggatgtgctgccggatcaccggggaatgagtggatcttcttctcaaccgatgagattactacgcgttatcgtaacaccatgagtaatggaggactccaaagatccgtcatattgtctgcactaatcttgcttagagctgttacaggattttcaggcgatggccgagctatttggtcgaaaaatccaaatttcacaccagtgaatgaatctcaacttttcttgtatgatacgtttcctaagaatttcttctggggaatcggtactggagctctccaagttgagggatcatggaaaaaagatggtaaaggaccatcgatctgggaccactttattcatacacacctaaagaacgtctcatccactaatgggtcatcggattcttatatcttcctcgaaaaagatctgtctgcgcttgattttatcggcgtgtccttctatcaattctccattagttggccgagactatttccggacgggattgttacagtagctaatgccaagggattgcaatactactctacgcttttggatgccctagttctacgtaacatcgagccaattgtcactttgtatcattgggatttaccattggcactgcaagagaaatacgggggatggaaaaatgatactataatcgatattttcaacgattatgctacctattgttttcaaatgtttggagatcgtgtcaagtattggattacaattcacaacccttacctcgttgcctggcatggatacggaactgggatgcacgcacccggagagaaggggaaccttgctgctgtttacacggtgggacataatttgatcaaagcccacagcaaggtttggcataattacaatactcattttaggccgcatcaaaagggttggctctctattaccttgggatcacattggatagagccaaatcgttcagaaaatacgatggacatcttcaagtgtcaacaaagcatggtcagcgtcctcggatggtttgccaatcctattcatggtgatggagattatccagaaggcatgaggaaaaaacttttctccgtattaccaattttctctgaggctgaaaaacacgagatgaggggaacagctgacttctttgctttctcatttggaccaaacaactttaagccccttaacactatggcaaaaatgggccaaaatgtctctctgaatcttagagaggctctgaattggattaaactggaatataataatcctagaattcttatagcagaaaacgggtggttcacggattcacgtgtcaagactgaagatactacagccatttatatgatgaaaaacttcttgagtcaagtgcttcaggcaatacggctagatgaaattcgggtttttggatacactgcatggtcgttattggacggatttgaatggcaagatgcttatactattcgaagaggcttattttatgtcgatttcaattccaaacaaaaagaaagaaaacctaaaagcagtgctcattattacaagcagattatcagagagaatggattcagtctcaaggaaagcacacctgatgtgcaaggacaatttccttgcgatttctcgtggggtgtaactgagtcagtccttaaaccagaatcagtagcctcttcgccacaattttctgatccccatctttatgtctggaatgctacagggaacagacttctacatagagttgaaggcgttagattgaaaacacgacctgcacagtgcaccgactttgtaaacattaaaaaacagctcgagatgcttgctcgtatgaaggtaacccactatcgatttgctctagattgggctagtgtattgccgacagggaatttgagcgcagtaaaccgacaggctttgagatactacagatgtgtcgtttccgagggactcaaactgggtataagtgcgatggtcactctttactaccctacgcatgctcatttgggacttccagagccacttttgcatgctgatggatggctgaatccatcgactgctgaagccttccaggcgtatgctggattgtgctttcaagagttaggagatctggttaaattgtggattacgattaatgaacctaatcgactttctgacatttataacaggagtggaaatgacacttatggggccgctcacaacttacttgtcgcacatgcgcttgcttggagattgtatgatcgacaattccgaccttctcaacgcggagccgtatctctttcactccatgcagattgggcagagcccgcaaatccatatgctgattctcattggcgagccgccgagcgctttttacaatttgaaatcgcttggttcgctgaaccattatttaaaactggtgattatccagctgctatgcgagagtatatagcctcgaaacaccgtcgtggtctctcgagcagtgcgttaccaagattgactgaagccgagagacggttgcttaaaggaacagttgacttctgcgctctaaaccacttcacgacgcgttttgttatgcacgaacagttggcaggatcacgctacgattcagatcgagatatacagttcttacaagatattactagactgagttcaccaactagattggctgtaatcccatggggagtccgaaaacttctgcgttgggtgaggagaaattatggtgatatggacatttatattaccgcctccggcattgatgatcaggctttagaagacgatagactccgtaaatactatcttggaaaataccttcaagaagtcctcaaggcatatctcattgataaggtgaggattaaaggttattacgcatttaagctggcagaggaaaagtcgaagccacgtttcggattttttacctctgatttcaaagcaaaaagctctatccagttttacaacaaagtcatttcaagcaggggattcccatttgaaaattcatcctcccgttgctcccagacgcaagaaaatacagaatgcacagtgtgcttatttctggtccagaaaaaaccgcttatttttctcggttgctgctttttctcaactttggtacttttactatccatcgctatttttcagcggcaaaagagacgtaaattttggaaagctaagaatcttcagcatattcctttaaaaaaaggaaagcgtgtggtgtcc

SEQ ID NO: 250559 - DNA, 3132 bp, Artificial Sequence
  Description of Artificial Sequence: Synthetic coding sequence
atgaagccaggctgcgcagctggttcccctggcaacgaatggattttcttctccaccgacgagatcaccacgcgctaccggaacaccatgtcaaacggaggactccagcgtagcgtcatcctgtctgccctcatcctgctgcgagccgtcacgggtttctccggagatggtcgcgccatttggtcgaaaaacccgaattttaccccagtcaacgaatcccagctctttctgtacgacaccttccccaagaacttcttctggggcattggtactggcgctctccaggtcgagggaagctggaaaaaggacggcaagggcccatctatctgggaccacttcattcacacccacttgaagaacgtctcttccaccaacggctcctccgactcttacatcttcttggaaaaggacctatctgccttggacttcatcggtgtctcgttctaccagttctccatctcctggcctcggttgtttccggacggcatcgtcacagttgccaacgcaaagggacttcagtactacagtactctcctcgatgccctagtcctgcggaacatcgagcccatcgtgactctctaccattgggatctgcccctcgccctgcaagaaaagtacggtggttggaagaacgacacgatcattgatatcttcaatgactacgccacctactgcttccagatgtttggcgacagagtgaagtattggattacaatccacaacccttacctggtggcctggcatggctatggcaccgggatgcatgcccctggcgaaaagggaaacctggccgcagtttacaccgtgggccataacctgataaaagcacacagtaaagtttggcataactacaatacccacttccgcccccatcagaagggttggctgtccatcactctaggttcgcattggatcgaaccaaaccgctccgagaataccatggacatcttcaagtgccaacagtccatggtgtccgtgttgggttggttcgccaaccccattcacggcgacggcgactaccccgagggcatgcggaagaagctcttctctgtcctgcctatcttctctgaggcagagaagcacgagatgcgtgggactgccgatttcttcgctttctcatttggtccgaacaacttcaagcccttgaacactatggccaagatgggccaaaacgtctctctgaacctccgtgaagcgctcaactggatcaagttggagtacaacaacccccgtattctgatagcagagaacggatggttcaccgacagccgggtcaagacggaggacaccaccgccatctatatgatgaagaacttcctgagtcaggtcttgcaggccatccgcttggacgaaatccgtgtattcggctacaccgcctggtccctacttgatggtttcgagtggcaggacgcttacacaattcggcgcggattgttctacgtcgatttcaacagcaagcagaaggagcgcaagcccaagtcctccgcccattattacaagcagatcattcgtgagaatggtttctcgctgaaggagagcactccagacgttcagggtcagttcccctgtgattttagctggggcgttaccgagtcggttctcaaacctgagtccgttgcatcgtccccgcagttctccgatccccacctgtacgtgtggaatgcgaccggtaaccggctgctgcaccgggtcgagggtgttcgtctgaagacccgcccagcacagtgcactgactttgtgaacatcaagaaacagcttgagatgttggcccgcatgaaggtaacccactaccggttcgcgttggactgggcttccgtgctgcccaccgggaatcttagcgcggtcaaccgtcaggccctgcggtactaccgttgcgtggtcagcgaaggccttaagctcggcatcagcgccatggtcaccctttactaccccacccacgcccatctgggactgcccgagccgctcttgcacgctgacggctggcttaacccttccaccgctgaggccttccaggcttacgccggcctttgttttcaggagcttggagatctcgtcaaactatggatcacgatcaacgagcccaataggctctctgacatttacaaccggtctggtaacgacacctacggcgccgcgcacaaccttcttgtggcccatgcactcgcttggcgcctttatgatcgtcaattccgcccttctcagagaggcgccgtgtcgctgagcctgcatgcggattgggcggagccagcgaacccttacgcagactcccactggcgtgcagctgaacgtttcctgcaatttgagatcgcgtggttcgcagagccgttgttcaagaccggtgattacccggctgccatgcgcgagtacattgccagcaagcatcggcgcggcctgtcgtcaagtgcccttccccgcctcactgaggctgagcgtcgcctgctcaagggtaccgtcgacttttgcgccctcaaccactttactacccgcttcgtcatgcacgaacagctcgctggcagccgttacgattcggatcgcgatattcaatttctccaggacatcacgagactttccagtcccactcgcctggccgtgatcccctggggagttcgtaagctgctgcgttgggtgcggcgtaactacggtgatatggatatctacatcaccgcttccggtatagatgaccaggctctagaggatgacagactgcgcaagtattaccttggcaagtatctgcaggaagtcctgaaggcctaccttatcgacaaggttcggattaaaggctactatgcattcaagctggctgaggaaaaatcaaaaccgagatttggcttctttacctccgactttaaggccaagagttccatccagttttacaacaaggtcatctcttcgcgcggttttcccttcgagaactccagttcgcgatgctcgcaaacccaagagaatactgagtgcaccgtgtgcctcttcttagtccagaagaaacccctgatcttcctaggctgctgcttcttctccacactagttcttctgctctcgatcgctatcttccagcgtcagaagcgccgcaagttctggaaggcgaaaaatctccagcacatcccccttaagaagggcaaacgtgtcgtatcg

SEQ ID NO: 250560 - DNA, 3132 bp, Artificial Sequence
  Description of Artificial Sequence: Synthetic coding sequence
atgaaacccggttgtgcagcagggtctcctgggaatgagtggattttcttttccaccgacgaaatcaccacacgctaccgcaatacgatgtcgaacggaggcctccaacgaagcgttatactctctgcgctgatccttctgcgagctgtgacaggcttctccggggatgggcgcgctatctggtctaagaatcctaatttcaccccagtgaatgagagccaacttttcttgtatgacacattccccaaaaattttttctggggaatcgggactggcgcacttcaggtcgaggggagttggaagaaggacggtaagggaccatcaatatgggatcactttatccacacccacttaaaaaatgtaagcagtacaaacggatcatctgactcatatatattcctggagaaagatttgtctgccctcgacttcatcggtgtgagtttctaccagttttctatttcttggcctcgactatttcccgatggaatagtcaccgtagccaacgcgaaaggcttgcagtattatagcacattactcgatgctctggtgctgcgcaacatcgaaccaatagtgaccctttatcactgggacctgcccctggcactacaagagaagtacggggggtggaagaacgacactattatagatatctttaatgactacgctacctactgcttccaaatgttcggtgaccgggtgaaatactggatcacaattcacaatccctatttagtggcctggcatggatacggtactggcatgcatgcgcctggtgagaaggggaacttggctgctgtttatacggtcggccacaacttgatcaaagcccactccaaagtttggcataactacaacacccacttccgccctcaccagaaaggatggctgtccataacccttggctcccactggatcgagccaaaccgcagtgagaacaccatggatatttttaaatgtcagcagtccatggtctcagtgctggggtggttcgctaatcctattcacggcgatggtgattatcccgaaggaatgcgtaaaaagcttttctctgtgttaccaatcttctcagaggccgagaagcatgaaatgaggggaacggctgacttcttcgcatttagtttcgggcccaacaatttcaaaccattgaacacgatggcaaaaatggggcagaacgtctccctgaacctgagagaagccctgaactggatcaaactggagtataataaccctcgcattttaatcgcagaaaacggctggttcaccgacagtagagtgaaaaccgaagacactaccgccatatatatgatgaagaatttcctgagtcaagtgctccaggctattcgccttgatgaaataagggtgtttggttataccgcctggagtctacttgacggcttcgagtggcaagacgcctatacaatcaggagggggctgttttacgttgattttaactcaaagcaaaaggaacgcaagcctaagtcctctgcccattattacaaacagattatccgagagaatgggttctcgctgaaagaatctacacccgatgtgcaggggcagttcccctgcgacttttcttggggggtgaccgaaagtgtgctcaagcccgaatcagtcgcaagctctccccagttttctgatccacatctctatgtgtggaacgcaacagggaaccggctcctccatcgggttgaaggcgtgcgtctaaagactagacccgcacagtgcaccgattttgtcaacatcaagaaacagttggagatgttagctcggatgaaggttacccattatcgttttgccctagactgggcaagcgtcctgccaaccggaaacctgtctgctgtaaatagacaagcactccgctactatcggtgtgtggtaagcgagggactgaagttaggaatcagcgcgatggtgacactctattacccaacacacgcgcacttgggcctgcctgagcctctattgcatgcagacggctggcttaatcctagcaccgcagaagctttccaagcctatgcaggactttgtttccaggagctcggcgacctcgtaaagttgtggatcacgatcaacgaacccaaccgactctctgacatctacaacaggtcagggaatgatacatacggagcggctcataatcttctcgtggcgcacgctttggcatggcggctatacgatcggcaattcaggccgagccagaggggggccgtgtctttgagtctccatgccgattgggcagagcctgcgaacccctatgctgattctcattggcgtgccgctgaacgcttcctgcagttcgagattgcatggtttgccgagcccctattcaaaaccggggattacccggcagctatgcgcgaatatatcgcgagtaagcatcgccggggtttgagtagttcagccctccccaggttgacagaagctgagcgtaggctactgaagggcactgtcgacttctgtgcacttaatcacttcacgacacgcttcgttatgcacgaacaacttgccgggtctcgctatgattcagacagggacattcagttcttgcaggatatcacaagacttagctcgcctactagattggcggtcattccttggggggtacgaaaactgctccgttgggtgcggcgtaactatggagacatggacatatatatcactgccagcggtatcgacgatcaggcacttgaggacgatagacttagaaaatactacctcggaaaatacctgcaggaggtcctaaaagcgtacttgatcgataaggtgagaataaagggttactatgcctttaagttagccgaagagaagagtaaaccacgatttggcttctttacttctgacttcaaagctaagtcaagcattcagttttataacaaggtgatctcctctagaggctttccttttgagaacagttccagccggtgcagccagacccaagaaaatacggagtgcactgtttgcttgttcctcgtgcaaaagaagcccctgatttttctggggtgttgcttcttcagcactctcgtgttgctgctgagtatagccatttttcaaaggcagaagcgacggaaattctggaaagccaagaatttgcagcacataccgttgaaaaaagggaaaagagttgtgtcg

SEQ ID NO: 250561 - DNA, 3132 bp, Artificial Sequence
  Description of Artificial Sequence: Synthetic coding sequence
atgaaacccggctgtgctgccgggtccccaggcaacgagtggatcttctttagtacagatgagattaccacccgatatcgtaacaccatgagcaacggaggtctccaaagaagcgtcattctgtcagcgctcattctgctcagggctgtgaccggatttagcggagatggacgcgctatttggtcaaaaaaccccaactttaccccagtcaatgaaagccaactctttctctatgacacatttcctaaaaacttcttttggggaattgggaccggcgcacttcaggtggagggaagctggaaaaaagacggtaaaggaccatctatatgggatcactttatccacacccatcttaaaaatgtgagcagcaccaatggttcatctgattcgtacatcttcctggaaaaagacctctccgctttagactttataggggttagtttttatcaattttcgatctcatggccaaggttattcccggatgggatagtcacggtggcgaatgctaagggattacagtactattctacactgctggatgcactcgttttacggaacattgagcctatagtgaccctgtaccactgggatcttcctttagccctgcaggagaagtacgggggttggaaaaacgacactatcatcgacatctttaacgattatgccacttattgctttcaaatgtttggcgacagggtgaagtattggatcacaatacataacccatacttagttgcctggcatggctacggtacaggcatgcatgctcccggtgagaaagggaacctggcagctgtctacactgttggacacaatcttatcaaagcccattccaaggtctggcacaattacaacactcattttagacctcaccaaaaagggtggctgtcgatcactttggggtcacattggatcgaacccaaccgatccgaaaacactatggacattttcaagtgccaacagagtatggttagcgtactgggctggttcgccaacccaatccacggggatggcgactatcctgaaggaatgcgcaagaagctcttctcagtgctaccaatcttcagcgaggcagaaaaacatgaaatgaggggcaccgccgattttttcgccttcagctttgggcccaacaacttcaagccactgaacacaatggccaagatgggacaaaacgtctctttgaacttgagggaggcactcaactggatcaaattggagtacaataatccaaggattctcattgccgaaaacggttggtttacagatagccgtgttaagacggaggatactaccgccatctacatgatgaagaactttctgtctcaagtgcttcaggcaatcaggctggacgaaattagggttttcggctatacagcctggtcgttgctcgatggctttgaatggcaagacgcctacacaatccgtcgaggattgttttatgttgactttaactctaagcagaaggaaaggaaaccgaaatcaagcgctcattactacaagcaaattattagggagaacggtttttctctgaaggagagcactccagatgtccagggacaatttccctgtgatttttcctggggcgtgaccgagtccgttcttaagccggagagcgttgccagtagcccccaattttcagaccctcatctgtatgtctggaacgcaacaggcaacagacttcttcaccgagttgaaggcgttaggctcaaaactcgcccggcccagtgcacagatttcgtgaacataaaaaaacagctcgagatgttagcgagaatgaaagtgacccactataggttcgcactcgattgggcctctgtcctgccaaccggtaacctttctgccgtaaatcggcaggcccttcgttactataggtgcgtcgtgtctgaaggattaaaacttggcattagcgctatggttactctgtactaccccactcatgcccacttgggactgcccgagccgcttctgcacgctgatggctggcttaaccccagcaccgctgaagcttttcaggcctacgctggcttgtgctttcaggaactgggggacctcgtgaaactctggattaccatcaatgaacccaaccgtcttagtgatatttacaaccggagtggtaacgatacatacggcgcggctcacaatttgctcgttgctcacgccttagcctggcggctctacgatagacagttcaggcccagtcaacgtggagcagtttctttgagcttgcatgccgactgggccgaacccgctaatccatacgccgactcgcattggcgcgctgccgagcggttcctacagttcgagattgcatggttcgcagagccactgttcaagaccggcgattacccggctgcaatgcgggaatatatcgcgtcaaaacacagacgcgggctctcatcctcagcactgcctcgcctcaccgaagccgaaaggcgcctcttgaaagggacagtggatttctgcgccctgaaccactttaccacccgatttgtgatgcatgaacaacttgccggaagcaggtacgactccgacagagacatccagttcctgcaggatattaccagacttagcagtcccactagacttgctgtgatcccttggggagtgaggaaactgttgaggtgggttaggcgcaactatggggatatggacatctacatcacggcatcggggatcgatgaccaagccctggaagatgacagactgaggaaatactatctgggtaagtacctgcaagaggtccttaaagcgtacctgatagataaggtcaggattaagggctattacgccttcaagctggctgaggaaaaaagtaagccaaggtttggttttttcacatctgactttaaagccaaatcatctatacagttctataacaaagtgatcagttctcgtgggttccccttcgagaactcttccagccgatgcagtcagacccaggaaaacacagagtgcaccgtgtgcttgttcctggtacagaagaaacctctgatattcctgggatgctgttttttctctaccctggtgcttttactctccattgctatctttcagcgccaaaagcgccggaagttttggaaagctaaaaatctccaacacatcccactcaagaagggtaaaagggttgtgagt

SEQ ID NO: 250562 - DNA, 3132 bp, Artificial Sequence
  Description of Artificial Sequence: Synthetic coding sequence
atgaagcccgggtgtgccgcagggtctcccggtaacgagtggattttcttttcaacagacgaaataacaaccagataccgcaacaccatgtccaacgggggcctgcagaggagcgtgatcctcagcgccctgattttgctgcgtgccgtgactgggttctcaggagacggaagagctatttggtctaagaaccctaacttcacgccagtcaacgagtctcagctatttctctacgacacttttccaaagaactttttctgggggattggaacaggagcccttcaggtggaaggaagctggaaaaaggatggcaaggggccatcgatctgggaccacttcatacacacccatttgaaaaacgtgtcttctacaaacggatcgtctgactcctacatctttctggaaaaggatttaagtgccttggacttcattggggtctcattttaccagtttagcatcagctggcccagacttttcccagacgggatcgtaacggtggcaaacgccaaaggcctccagtattactcaacccttctggatgccctggtcctgcgcaatattgagccaattgtgaccctttatcactgggatcttccactagcgttgcaggaaaagtatggaggatggaagaacgacacaatcatagacattttcaatgattacgcgacatattgctttcagatgttcggagacagggtgaaatattggataaccatacataacccatatctcgtggcgtggcatggttatggcacaggcatgcacgcccctggagagaagggtaatcttgcagcagtctacaccgtgggacacaatctaatcaaggcccactccaaggtttggcataactataacactcatttccgcccgcatcagaagggttggttgtccatcacactgggcagccattggatcgagccgaacagatcagaaaataccatggacatcttcaagtgccagcagtctatggttagcgtcctggggtggttcgcgaatccaatacatggtgacggagattaccccgagggcatgcgcaaaaagctcttcagcgtcctcccaatctttagtgaggctgagaaacatgagatgcgggggacagctgattttttcgcctttagttttgggcccaacaattttaaacctctgaatacaatggctaaaatgggacagaatgtgtccttgaacttaagagaagcccttaactggattaagcttgaatacaataacccccggatcctcatcgcagagaatggctggttcactgattctcgggtaaagacggaagacaccaccgccatttatatgatgaagaattttctgtctcaggttttgcaggccatccggctggacgagattcgcgtattcggatatacggcatggagtttattggatggattcgaatggcaagacgcatatactatccggagggggctgttctacgtggacttcaatagcaagcaaaaagagcgcaagccaaaatccagcgcccactactacaagcagatcataagggagaacggctttagcctcaaggaaagtacccctgatgttcagggccaattcccttgcgacttctcttggggtgtaaccgagtctgtcttgaaaccagaatccgtagcttcatcaccgcagttttccgaccctcacctgtacgtgtggaatgccaccgggaatagactgctacatagggtggagggagtgcggctgaagacaaggccagcacagtgcaccgactttgtgaatatcaagaagcagcttgagatgctggcacgcatgaaggtgacgcattatagatttgccctggactgggcatctgtgctgcctaccgggaacctttccgcagtgaatcgccaagctctccgttattatcggtgcgtcgtttctgaggggctgaaactcggcatctccgcaatggtgaccctgtactaccctacgcatgcgcacctggggttacccgaacccctgctccacgccgatgggtggctaaacccatccacggccgaagcctttcaggcctacgctgggctctgttttcaggagctgggtgacctggttaagctgtggatcactattaatgaacctaatcggctatcagacatctataatcgatctggaaatgacacttatggcgcagctcacaatctgctggtggcccacgccctagcatggaggttgtatgacagacaatttcgcccctcacaacgaggtgctgtgtctttgtctctgcacgcggactgggcggaacctgctaatccttatgccgactctcactggagggccgcggaacgctttctgcagtttgaaatcgcttggttcgcggagcccctattcaaaactggcgattatccagccgctatgagagaatatatcgcgagtaagcaccggcggggactgagtagctctgccctgcctaggctgaccgaggcggaaagaagattgcttaaaggaaccgttgacttttgcgctctgaatcatttcacgactcggttcgttatgcatgaacagctggcggggtcccgatatgactcagaccgcgatattcagtttctgcaggatatcactcggttgtcttctcccacacgtctggccgttattccttggggtgtccgcaaactgctgcgctgggtgaggcgtaactacggagacatggacatctacatcacagcctccggtatagacgatcaggcactggaagacgatagacttagaaaatattatcttggcaaatatctgcaagaagtgctcaaggcatatcttatcgataaagtcaggattaaaggatactatgctttcaagctcgcggaggagaagtctaaacccaggttcggtttcttcacgagtgactttaaagccaagagcagcatccaattctataacaaagtgatcagctctagaggcttccccttcgaaaatagttcaagtagatgttcccaaactcaggaaaataccgaatgtactgtttgtctgttcttagttcagaagaaacccttgatcttccttggctgttgctttttttcgaccctggtgctgctcctgtctatcgctatttttcagaggcagaagcggcggaagttttggaaagccaagaaccttcaacacataccgctgaaaaaagggaaaagagtggtgtcc

SEQ ID NO: 250563 - DNA, 3132 bp, Artificial Sequence
  Description of Artificial Sequence: Synthetic coding sequence
atgaagccgggatgcgcagcgggaagcccgggcaacgagtggatatttttttccacagatgaaatcactacgcgataccgaaatacaatgagtaacgggggcttacaacgcagtgttattttgtcagcattaattctgttacgcgcggtaaccggcttttctggcgacggcagagctatatggagcaaaaaccctaacttcacgcctgttaacgaatctcagctttttctgtatgacacctttcctaaaaatttcttttggggcattgggacaggagcacttcaagtagaaggttcttggaagaaggatggtaaaggcccgtctatctgggatcactttatccatacgcacttaaagaacgtatcatccacaaatggtagttccgactcctatatttttttagaaaaggacttgagcgctctggactttataggcgtctccttttaccaattttctatctcatggcccagattatttccggatgggattgtaacggttgcaaatgcaaaagggctccagtattattcgacacttctggacgcactggtactcagaaacatcgagccgattgtgactctgtatcattgggatcttccgttagcacttcaagaaaaatatggcggatggaaaaacgacacgattattgatatctttaacgattatgctacatattgcttccaaatgtttggcgatcgcgtgaaatactggattacaatacataacccttacctggttgcgtggcatggatacggcacgggaatgcatgcgccgggagagaaaggtaaccttgcagccgtttacaccgtaggacataatctcattaaagcgcacagcaaagtgtggcataattacaatacgcattttcgcccgcatcaaaagggctggttgtctatcacattaggatcgcactggattgagccaaatagatcagaaaatacaatggacatttttaagtgtcagcagtcaatggtgtcggtcttgggatggttcgcaaatcctattcacggagatggtgattacccagaaggcatgagaaagaaacttttttccgttttgccgattttctcggaagcagaaaaacacgaaatgcgcggaactgcagatttttttgcattctcctttggaccaaataattttaagccgttaaatacaatggcgaaaatgggtcagaacgtctcacttaatttgcgagaagccctgaattggatcaaattagaatataacaatccaaggattttaatcgctgaaaacggatggtttacagacagccgcgttaagaccgaagatacaacggctatttatatgatgaagaactttttatctcaggttttgcaggctattagacttgacgaaatccgggtgtttggatatacagcttggtctttgttggacggttttgagtggcaggatgcatacacaatcagacgtggattattttatgtggacttcaacagcaaacagaaggagagaaaaccaaagtcgtctgcccattattataaacagattatacgggaaaatggtttctcattaaaagaaagcacaccggatgttcagggacaatttccatgcgacttttcttggggcgttacagaatccgtactgaaaccggaatcagttgctagcagcccacaattttcagacccgcatctttacgtctggaatgcaacgggaaatcgtctcctgcatcgggtcgaaggcgtccggctgaagacgcgtccggcccagtgtacagattttgtaaacatcaaaaaacagcttgagatgctggcgagaatgaaggtaacccattacagattcgccctggattgggcttctgtcttgccgacgggcaatctttcagcggtaaacagacaggctctacgttattacaggtgtgttgtcagcgaaggcctgaaattgggcatttcggcaatggtcacgttatattatccgacacatgcgcaccttggcctgcctgaaccgcttctgcatgcggatggatggcttaatcctagcaccgcagaagcatttcaggcgtatgcaggattgtgtttccaggaattgggcgatcttgtgaaactttggattacaatcaacgaaccaaacaggctgtccgatatatataacaggtcaggaaacgatacctatggcgcagcgcataaccttcttgtggctcatgcgctagcctggaggttgtacgacagacaatttcggccttctcaacggggcgctgtgtccctttcgttgcacgcggattgggccgagccggccaatccatacgccgattctcactggcgagcggccgaacgctttctgcagtttgaaatcgcctggttcgctgaacctttatttaaaactggagattatcctgcggcaatgcgggaatatatagcgtcaaaacaccgccgtggcctcagttcaagcgccctgccaagactgacagaggctgaaagacgcctgctgaaaggtactgtggatttttgcgctctgaatcattttacgacaagatttgttatgcacgaacaattagcaggatcacgctacgattcggatagggacattcaatttctgcaagatataactagattgagttcaccgacgcgcttggctgtaatcccgtggggggttcgtaaactcctgagatgggtcaggagaaattatggagatatggatatctatataactgcctcaggcatcgacgatcaggcgttggaagacgaccgtttgcggaaatactatctcggcaaatatttacaagaggttctaaaagcctatttgattgacaaagtacgcatcaagggatattatgcatttaagctcgctgaggaaaaatctaaaccgcggttcgggtttttcacgagcgattttaaagccaaatcgagtattcagttctacaacaaagtcatttcctcaaggggcttccctttcgaaaattcttctagccgttgctctcagacacaagaaaatacggaatgtactgtttgcttatttttggtgcagaaaaaaccattaatttttttagggtgttgcttttttagcacgttggtccttctattgagcattgctatctttcagagacagaagcgcagaaaattctggaaggccaagaatcttcagcatattcctctcaaaaaaggtaaacgggttgtatcc

SEQ ID NO: 250564 - DNA, 3132 bp, Artificial Sequence
  Description of Artificial Sequence: Synthetic coding sequence
atgaagcccggatgcgctgcaggatctcccggcaacgagtggattttttttagcaccgacgagatcacaactaggtacaggaatacaatgagcaacggaggcctgcaacgcagcgtgatcctgtctgctctcatcttgctgagggctgtgacaggcttctcaggtgacggacgcgctatttggagtaagaacccaaatttcacacctgtaaacgagagccagctgttcctttacgacactttcccaaagaactttttttggggcatcggtacgggcgctttgcaagtggagggcagctggaagaaagacggaaaaggcccttctatatgggaccattttatccatactcaccttaaaaacgttagttctaccaacggctcatctgactcttacatttttctcgaaaaggatctttctgccctcgatttcatcggagtgagcttttatcaattctctatcagctggcccaggctcttccccgacggtatagtgacggtggccaacgctaagggacttcagtactactctacgctgctcgacgccctcgtgctccgcaacatagaacccatagtgacactgtaccactgggacttgcctctggccctgcaggagaaatacggcggctggaagaacgataccataatcgacatatttaacgattatgcaacctactgtttccaaatgttcggtgatagagtcaagtattggattacgatacataacccttatctcgtggcctggcacggctacggtactggcatgcatgcacctggtgagaaaggaaatctggcagctgtctacaccgtgggccataatttgatcaaggcgcattctaaagtgtggcacaactacaacacccatttcagaccccaccagaagggctggttgtccattactctcggcagccactggatagaacctaataggtccgagaataccatggatatttttaaatgccagcagagtatggtgtcagttcttggatggttcgctaacccgatacacggagacggcgattacccagagggaatgaggaagaagctgttctcagtgctgcccattttttccgaggcagagaagcatgagatgagaggaactgccgactttttcgctttctcatttggacctaataacttcaagccattgaacactatggccaaaatgggccagaatgttagtctgaacctgagagaggcgctcaactggatcaaattggagtacaacaatccaagaatactcatcgccgagaatggttggtttaccgactctagggttaaaaccgaagatactactgccatctacatgatgaagaacttcttgagccaggtgttgcaggctatcagacttgacgagatcagggttttcggatataccgcctggtctttgctggatggtttcgaatggcaggacgcatacacgattaggaggggtctcttctacgtcgattttaattcaaagcagaaagaaagaaagccgaagagttctgcccactactataagcagataatccgcgaaaacggattcagccttaaagaatcaaccccagatgtccagggtcagtttccgtgcgatttttcctggggagtcactgagtctgtcttgaagcccgagtccgtagccagctcccctcaattctctgaccctcacctctatgtttggaatgctaccggtaatagattgctgcacagagttgagggcgtcagactgaaaacgagacccgcccagtgcaccgacttcgttaacatcaagaagcagttggagatgcttgccaggatgaaagtgactcactacaggttcgcactggactgggcttctgtgcttccgacaggaaacctgtccgccgtgaatagacaggctctgaggtactatagatgtgtcgtgtcagaaggcttgaagcttggtatctccgccatggtaaccctttattaccctacccacgcacacctcggcctgcctgagcccctgttgcacgccgacggctggctcaacccctcaaccgcagaagccttccaggcgtacgccggactttgcttccaagagcttggagacctggtaaagctttggatcaccattaacgagcccaacaggctgtccgatatctataaccgctcaggaaatgacacttacggagctgctcacaatttgctggtggcccacgccctggcttggagactgtacgacagacagttcaggcctagtcagagaggcgccgtctccctgagccttcacgccgattgggctgaacccgcaaacccttacgctgattcacactggagagcggccgagaggttcttgcagttcgagatcgcttggttcgctgagccattgtttaagaccggagattacccagccgccatgagggaatacatagccagcaaacacagaaggggtctcagttcctccgctctcccaagactgaccgaggccgagcgcaggctccttaagggtacagtagacttctgtgctttgaaccatttcaccaccaggttcgtgatgcacgagcagttggcaggatccaggtacgactctgacagggatatacagtttcttcaagatatcactaggctgtctagtccaacaaggcttgctgtaatcccttggggagtgagaaagctcttgaggtgggtgaggagaaactatggtgacatggatatatacatcaccgcaagcggcatcgacgatcaggcgctggaggatgaccgccttcgcaaatactatctgggaaagtacctgcaagaagtgttgaaggcttaccttatcgataaggtgcgcattaagggctactatgcattcaagcttgcagaagagaagagtaaaccaaggttcggtttcttcacttccgactttaaggccaagtcttccatccagttctacaataaagtgatatccagtaggggatttccctttgaaaattccagttctaggtgctcccagacacaggagaacactgagtgcaccgtctgcctctttctggtgcaaaagaagccccttatcttcctgggttgctgtttcttctctactttggtactgctgctctccatcgccatcttccaaagacaaaaacgcaggaagttctggaaagcaaagaacctgcagcacattccactgaagaaaggtaagagagtcgtttct

SEQ ID NO: 250565 - DNA, 3132 bp, Artificial Sequence
  Description of Artificial Sequence: Synthetic coding sequence
atgaagccgggctgtgccgccggttcccctggcaacgaatggatctttttctcaaccgatgaaattacgaccagatacagaaacactatgtcaaatggcggcctgcagagatcggtcatcctcagcgctctgatcctcctccgcgcggtcaccggattctcgggggacggccgagcaatctggtccaagaatcctaacttcacgccggttaacgaaagccagctgttcctgtacgataccttcccaaagaactttttctggggcatcggtactggagcactgcaagtcgagggcagttggaagaaggacgggaagggaccatcgatctgggatcactttatccacacccatctgaagaacgtgtcctcaactaacgggtcaagcgatagctatatcttcctggagaaggacctcagtgcccttgatttcatcggtgtgtcattctaccagttctccatctcatggccacgcctctttcccgacggcattgtcactgtggcgaacgctaaaggacttcagtactacagcaccctgctggacgctcttgtgctcagaaatatcgagcccattgtcactctgtaccattgggaccttccccttgctctccaggaaaagtacggcggatggaaaaatgacaccatcatcgatatcttcaacgattacgcaacctactgcttccagatgtttggcgatcgggtcaagtactggatcaccatacacaatccgtacctggtggcatggcatggatacggaaccggaatgcatgcaccgggagagaagggcaatcttgcggccgtgtacactgtggggcacaatctgatcaaggcacatagcaaggtctggcacaactacaacacccatttccgcccgcaccaaaagggttggctgagtattaccctcggaagccattggattgaaccgaaccgatccgaaaataccatggacatcttcaagtgccaacagtccatggtcagcgttctcggatggtttgccaatccaatccacggagatggggactatcctgaggggatgagaaagaaactcttttctgttctcccgatcttcagtgaggcggagaaacatgagatgagaggaactgccgacttcttcgccttctccttcggacccaacaatttcaagccgctgaataccatggcgaaaatgggacaaaatgtgtcccttaatctgcgagaagccctgaactggataaagctggaatacaacaatccgcggatcctgattgcggagaatggttggttcactgactctcgcgtgaaaactgaggataccactgccatttacatgatgaagaacttcctgtcgcaagtcttgcaggccatccgcctcgacgaaatcagagtattcggctacaccgcatggagcctgctcgatggattcgaatggcaggatgcctacactatccgcaggggactgttctatgtcgactttaactccaagcagaaggaacgcaagccgaaatcatcggcacattactacaagcagatcatcagagagaacggattttcgttgaaggaatcaacgcccgacgtgcaagggcaatttccctgtgacttctcatggggagtgactgaaagcgtgctgaaaccggagtccgtggcgtcatcaccgcaattttctgaccctcacttgtacgtgtggaatgcaactgggaaccgactgctgcaccgcgtggagggagtccggctgaaaacccgtccggcccagtgcactgacttcgtgaacatcaaaaaacaactcgagatgctggcgcggatgaaggtaactcactatcggttcgctctggattgggcctcggtcctgccgaccggaaacctgagcgctgtgaaccggcaggcgctgcggtactaccgctgtgtggtgagcgaagggctcaagctgggaattagcgccatggtcactctctactacccgacccacgcccacctcgggcttcctgaacctctgctgcacgctgatgggtggctgaacccctccaccgcggaggccttccaggcctacgctggactgtgttttcaagaattgggcgacctggtcaagctctggattactatcaacgaacccaaccgcctctcagacatctataacaggtcgggaaacgacacgtatggggccgctcacaaccttctggttgcccatgctctggcgtggcggctctacgaccgccagtttcggccttcgcaaaggggagcagtctcgttgtcgctccacgccgactgggccgagccagcgaacccgtacgcagactcccactggcgcgccgcagaaaggttcctgcagttcgagattgcttggttcgcagaacccctgttcaaaaccggcgactacccagctgccatgagggagtatatcgcgtcgaagcaccgtagaggcttgagctccagcgcactcccgcgcctcacggaggccgaacgccggttgctgaagggaactgtggacttctgcgccttgaaccactttactacccggttcgtgatgcatgagcaactcgccggatcacggtacgactccgatcgcgatatccaattcctgcaagatataacccgcctgtcgtcaccaacgcggttggcagttatcccttggggtgtgcggaagttgcttcgctgggtgaggaggaactacggcgacatggacatctacatcaccgcgtcaggcattgacgaccaggccctggaagatgacagactgcggaagtactacctgggcaaatacctgcaagaagtgcttaaagcgtatctgatcgataaagtccggatcaaggggtactacgcgttcaagctggccgaagagaaatccaaaccacgcttcggttttttcacttcggactttaaagcaaagagctcaatccagttctacaataaggtgatttccagccgcggatttccttttgaaaattcgagctcgcggtgctcccagacccaggagaacaccgaatgtacggtgtgccttttcctggtgcagaagaagccgttgatcttccttgggtgctgctttttctccacgcttgtcctcctcctgagcatcgctatcttccagcgccagaagcggagaaagttctggaaagctaagaatctgcagcatatcccgttgaaaaaaggcaagagagtggtatcg

SEQ ID NO: 250566 - DNA, 3132 bp, Artificial Sequence
  Description of Artificial Sequence: Synthetic coding sequence
atgaagcccgggtgcgctgccggtagtcccgggaatgaatggatctttttctctaccgatgaaataactacgcgttatagaaatacaatgagtaatggcggcctacagagaagtgttatattgtctgcactcattctcctccgcgcagtgaccggattttctggtgatggacgggccatctggtccaagaaccccaatttcacgcctgtgaatgagagccagctgttcctgtatgataccttccctaaaaatttcttctgggggataggcactggagccctgcaggtcgagggtagttggaaaaaggatgggaaaggtccttcgatctgggaccacttcatccatacgcatctaaagaatgtcagcagcaccaatggctcttccgactcctatatattcctggagaaggatctgtcggccctcgattttattggcgtctccttctaccagttcagcattagctggcctagactgttccctgatgggattgtgaccgtggctaatgccaagggtctccagtattattctaccctactggacgccttggtgctcaggaacatcgagcccattgtcacactgtaccactgggacctacctctagcattgcaggaaaagtacggcgggtggaagaacgatactattatcgatatttttaacgactacgcaacatactgtttccaaatgtttggggacagagtgaagtactggatcaccattcacaacccgtacctcgtggcgtggcacggatacggtacgggaatgcatgcccctggggagaagggaaatcttgctgccgtatacacggtcggtcacaatttaataaaggcccacagcaaagtgtggcacaattataacactcacttcaggccccatcagaagggatggctctcaataacacttggaagtcactggatcgaaccaaaccggagtgagaataccatggacatcttcaagtgccagcaaagtatggttagcgttctcggatggttcgccaatccaatccacggggatggcgattacccagaagggatgagaaagaagctgttcagcgtactgcccatctttagtgaagccgaaaaacacgaaatgagggggactgctgactttttcgctttctccttcggaccaaataacttcaaacctcttaataccatggccaagatggggcagaacgtgtccctgaacctgcgcgaggctcttaactggatcaagctagagtataacaacccgcggatactcatcgcagagaacggctggttcacagacagccgggttaaaactgaggatactacagctatctacatgatgaagaacttcctctcccaggtacttcaggcaattagactggatgaaattcgggtgttcggctatacagcttggagcttgctggacggatttgaatggcaagatgcatatactataaggcgcgggctgttttacgtcgattttaacagtaagcagaaggagagaaagccaaagtccagcgcacactattataagcagataatcagggaaaacgggttctcactgaaggagagtacccccgatgttcagggtcaattcccctgtgattttagctggggcgtgaccgagagtgtcctgaagcctgagtccgtagcctcttcaccccagttttcggatcctcatctgtatgtctggaatgccaccggaaaccgactacttcaccgagtggaaggagtgcgcctcaagactagaccagcccaatgcaccgacttcgtgaatattaagaaacagcttgagatgctggctagaatgaaggtgacccattatcggttcgccctggattgggcgtccgtcctacctacgggtaatctgtcagctgtgaatcgccaggcgttacggtactatagatgcgttgtgtctgaaggcctcaagctggggattagcgcaatggtgaccttatactatcctactcacgcacatctgggacttccggagcccttactgcatgctgacggctggctgaatccatctaccgcagaggcctttcaggcatacgcggggctctgtttccaggagttgggggatctcgtgaaattgtggattactattaacgagccgaatcgccttagtgacatttacaaccggtctggaaatgacacttatggcgcggcccacaacctgctagtcgcccatgccctggcctggaggctttatgacaggcagttccgccctagccaacggggggcagttagcctctctctgcatgctgactgggccgagccagccaatccctacgccgatagccattggagggcagccgagcgatttctccagttcgaaatcgcttggttcgcggagcccctgtttaagacaggggactatccagccgcaatgagggaatatatcgctagtaaacatcgaaggggcttatcttcgtccgctctacctcggctcaccgaagccgaacgtaggctgctaaaaggcacagtggacttctgtgctctgaatcattttacaacaagatttgttatgcatgagcagctggccggaagtcggtacgactcagatagggatattcaattcctccaggatattacacggctgtcatcaccaaccaggctcgccgtcattccttggggggtccgaaagctgctccgctgggtgcggcgaaactacggagacatggacatctacatcaccgcctctggcatcgatgaccaagcgctagaagacgatcgtctccgtaaatattatcttggtaaatatctgcaggaagtgcttaaggcatacctaatagacaaggtgcgcatcaagggatattatgcattcaaactcgcagaggaaaaaagcaagcccagatttggcttcttcacaagcgactttaaggccaagtcaagtatccagttctacaataaggtgatctcaagtcgtggctttccttttgaaaactcctctagtcgctgttctcagacccaggaaaatacagaatgcacagtgtgcctgtttctggtacaaaagaaaccgctcattttcttgggttgctgcttcttttccacattggtcctgttactatccattgccatcttccagagacagaagagaagaaaattttggaaagccaaaaatctgcagcacattcctcttaagaagggcaagcgcgtggtgtcc

SEQ ID NO: 250567 - DNA, 3132 bp, Artificial Sequence
  Description of Artificial Sequence: Synthetic coding sequence
atgaagcctggatgcgcagcgggtagcccaggaaatgagtggatctttttcagcaccgatgaaatcaccacccggtaccgcaacactatgtcgaatggcggactgcaacggagcgtcattctgtcggctctcatcctgcttcgcgccgtgaccgggttcagcggtgacggccgcgccatttggtcaaagaacccgaatttcactccagtgaacgagtcccagctgttcctctacgataccttcccgaaaaacttcttttggggcatcggcactggagcgctgcaggtggagggttcatggaaaaaggacggaaagggaccgtccatctgggaccactttatccacacccacctcaaaaacgtctcatcgaccaacggatcgtcagacagctacatcttccttgagaaagacctgtcagcgcttgactttatcggggtcagcttttaccagttttccatctcatggccgcgcctgttcccggatggcatcgtgaccgtggccaatgcaaagggactgcaatactattctactttgctggacgcactcgtgctccgaaacattgaacctatcgtgactctgtaccactgggacctccccctcgctctgcaagagaaatacggaggatggaagaatgacaccattattgacatattcaatgactacgcaacctactgctttcagatgttcggcgacagggtgaaatactggattaccatccataacccgtacctggtcgcttggcacggatacggcactggcatgcacgccccgggagagaaaggaaacctggcggctgtgtacactgtgggacataacttgattaaagcacactccaaggtgtggcacaattacaacacccactttagaccccaccagaaggggtggcttagcatcaccctgggatcacactggattgaaccgaacagaagcgaaaacactatggacatctttaagtgccagcagtcaatggtgtccgtgttgggttggttcgcaaatccgatccacggagacggtgattacccggaagggatgcgaaagaagctcttctcggtgctgcccatcttttcggaggcggaaaagcatgaaatgagaggaaccgctgacttcttcgcattctcgttcggacccaacaacttcaaaccactgaatacgatggccaaaatgggacagaacgtctccctgaacctccgggaagcgctgaactggatcaagctggaatacaacaatccgcgcatccttatagctgaaaatggatggttcacggactcaagagtgaaaactgaggatactactgccatctacatgatgaagaactttctctcacaagtgctccaggcgatccgcctggatgaaatcagggtgtttggatacacggcttggtcgctgctggatggattcgaatggcaggatgcttacaccatcagacgcggtctgttttacgtggactttaactccaagcagaaggagcggaagccgaagtcctccgctcattactacaagcaaatcattcgggaaaatgggttttccctcaaggaatccacccctgatgttcagggacagttcccatgcgacttctcttggggagtcaccgagtccgtgctgaagcctgaatcggtggcgtcctcgccgcaattctcagaccctcacctgtacgtctggaatgctacgggtaatcgcctcctgcatagggtggagggagtcagattgaaaacccggccggcgcagtgcactgatttcgtgaacattaagaagcagcttgagatgctggcacggatgaaggtgacccactatcgcttcgctctggattgggcgtcagtcctcccgaccggtaatctttcggctgtgaatagacaagcactgcgctactaccgctgcgtcgtgtccgaagggctgaaactgggaatctccgcgatggttactttgtactaccctactcatgcccatctgggactgccagaaccgcttctccatgccgacgggtggctcaacccgtcaaccgctgaggcgttccaagcctacgccggattgtgctttcaagaactgggagatctggttaaactgtggatcaccatcaacgaaccgaacaggctgtccgacatctacaatagaagcggcaacgatacttatggggcggcccacaacctgcttgtggcccacgcgcttgcatggcgcttgtatgaccggcaattccggccatcgcagcgcggcgccgtctcgctgtcgctccacgcggactgggcagagccagcgaacccctacgccgatagccactggagggctgcagagcgattcctgcagttcgagatcgcatggttcgccgaaccactgttcaagaccggagactaccccgccgctatgcgcgaatacatcgcctcaaagcatcggaggggcctgagctcatcggctctcccgcgtttgaccgaggccgaaaggagactgcttaaaggcacggtggacttctgcgccttgaaccattttacgacccgcttcgttatgcatgagcaactggcaggaagccgatacgactcagatcgcgatatccagttcctccaagacatcactcggctgagctcgcctactaggctcgcggtgatcccttggggcgtccggaagttgctgaggtgggtgcggcgcaactatggtgatatggacatatacatcaccgccagcggcatagacgatcaggcgctggaggacgacagactgcgcaaatactacctgggtaaatacctccaagaggtcctcaaagcctacctgatcgacaaagtgcggatcaaaggatactacgcattcaagctcgcggaggagaagtccaagccgagatttggtttcttcacctcggacttcaaagccaaatcatcgatccagttctacaataaggtgatctcctcacgcggcttcccgtttgaaaactcgtccagcagatgttcccagacccaggagaataccgaatgcaccgtctgtctcttcctggttcagaagaaacctctcatcttcctgggatgttgcttcttctcgaccctggtgctgctgcttagcatcgcaattttccagcgacagaaaagaaggaagttctggaaggcgaagaacctgcagcacatccctttgaagaaaggcaagcgggttgtctcg

SEQ ID NO: 250568 - DNA, 3132 bp, Artificial Sequence
  Description of Artificial Sequence: Synthetic coding sequence
atgaaaccaggttgcgcagcaggatcgcccggcaacgagtggattttcttctcgaccgatgaaattactactagatacagaaataccatgtcgaacggtgggctgcaaaggagcgtgattcttagcgccttgattctcctccgcgcagtcaccggattttcgggggacggaagagctatttggagcaagaaccccaacttcactcctgtcaatgagtcacaactgttcctgtacgatacctttcctaagaactttttctggggtatcggcacgggggcacttcaggtcgagggaagctggaaaaaggatgggaagggaccttcgatttgggatcactttatccacacgcatctcaagaacgtctcctcgacgaacggctcctccgattcgtatatctttcttgaaaaagatctcagcgcccttgatttcatcggagtgtcgttttaccaattctcgatctcatggccgagactgttccctgacggtattgtgaccgtggccaacgcaaagggcctgcagtactactcgacgctgctcgacgccctggtcctgcgcaacattgaaccaatcgtgaccctgtaccattgggatctgcctcttgcacttcaggaaaagtacggaggatggaagaacgacactatcatagacatctttaatgattacgcaacctactgtttccagatgttcggtgatcgggtgaaatactggatcaccatccataacccatacctggtggcttggcatgggtacggaaccggtatgcatgcaccgggcgaaaagggtaatcttgctgccgtttacaccgtgggtcacaacctcattaaagcacactcaaaggtgtggcataactacaacactcactttcgcccacatcagaaagggtggctttccatcactctgggttcccactggatagaaccaaatagaagcgaaaatactatggacatattcaagtgccagcaatcgatggtgtcggtgctgggttggtttgccaaccctattcacggagatggggactacccggagggcatgcgaaagaagttgtttagcgtgcttcctattttctcggaggcagaaaagcacgaaatgaggggaaccgcagacttcttcgcgttttcgtttgggcctaacaatttcaaaccactcaacactatggccaagatgggtcaaaacgtgtcgcttaacctgcgtgaagcgcttaactggattaagttggagtacaataatcctagaattcttattgccgaaaacggctggttcaccgattcgcgtgtgaaaaccgaagataccacggccatttacatgatgaaaaacttcctctcgcaagtgctgcaggccatccgcctggatgaaattagagtgtttggttacaccgcctggagccttctggatggcttcgagtggcaagacgcgtacaccatcagacgcggcctcttctacgtggatttcaattcaaaacaaaaggaaagaaagccaaagtcatcagctcactactacaagcagattatacgagaaaatggtttttctctgaaggaatcgacccctgacgtgcagggccaattcccctgcgacttttcgtggggggtgaccgagtccgtgctgaagccagaatcagtggcatcaagcccacaattttccgatccgcatctgtacgtctggaacgccactggaaataggctcctccatagagtggagggagtcagacttaagaccagacctgcacagtgcactgattttgtcaatatcaaaaagcagctggaaatgttggcacgtatgaaagtgactcattacaggtttgcgcttgattgggcatcggtcctgcctaccggtaatctttccgctgtgaatagacaagcactccggtactaccgctgtgtcgtctcggaaggtcttaaactgggaatctcggcaatggtcactctgtactaccctactcatgcgcatttggggcttccagaacctctccttcatgccgatggatggctgaacccctctacggcggaggcatttcaggcatacgcaggtctttgttttcaagaactgggcgatctggtcaaactttggattaccataaatgagcccaacagactgtcggatatctacaatcgctcgggcaacgatacttatggtgccgcgcacaacctgcttgtcgcccatgccctggcatggaggctgtacgacagacagttcagaccttcgcaacgcggtgccgtctccctgtcattgcatgcagattgggcagaaccagcgaatccttatgcggactcacactggcgcgcagcagagcggttcctccaattcgagatcgcatggttcgcagaacctctgtttaagactggtgattaccctgctgcaatgagggaatacattgcgtcgaagcacagacgggggctctcctcgtccgcgctcccaaggcttactgaagcagaacggcggcttcttaaggggacggtggacttttgtgcgctcaaccatttcaccaccagatttgtgatgcatgagcaactggcaggttcccggtacgactccgatcgagatatacaatttcttcaagatatcacgagacttagcagccctactagactggcagtgataccgtggggcgtccgtaaacttcttcggtgggtccgacggaattacggggatatggacatttacattaccgcaagcggaattgacgatcaggcgctggaagatgatagattgagaaagtactacctcggcaagtatctgcaagaggtcctcaaagcgtacctgatcgataaggtgcgcatcaaggggtattacgcctttaagctcgcagaagaaaagtcaaagcctcggtttggttttttcacttccgatttcaaagcaaaatcttcaatccagttttacaacaaagtgataagctcacggggatttccattcgaaaattcaagctcaaggtgctcgcaaactcaggagaacaccgagtgcactgtctgtctcttcctcgtgcaaaagaagcccctcatttttcttgggtgctgtttcttttccactcttgtgcttctcctcagcatagcaatctttcagcgccagaagcggcgaaagttctggaaggctaagaacctccaacacatcccactgaagaagggaaagagggtggtgtcc

SEQ ID NO: 250569 - DNA, 3132 bp, Artificial Sequence
  Description of Artificial Sequence: Synthetic coding sequence
atgaaacctggatgcgcggcgggatccccgggcaatgagtggatcttcttttcgaccgacgagatcaccaccaggtacaggaataccatgtcaaatggaggcttgcaacggagcgtgatcctgtctgctctgattctgctccgggccgtgaccggattcagcggagatggaagagctatctggagcaagaaccctaatttcaccccagtaaatgaatctcagcttttcttgtacgatactttcccaaagaacttcttctggggtatcggaaccggcgcgctccaggtggagggatcgtggaagaaggacggaaagggcccatcgatttgggaccactttatccatacgcacctcaagaacgtctcctccaccaatggatcgtccgattcctacatcttccttgagaaagatctgagcgcgctggatttcatcggggtcagcttctatcagttctcgatctcatggccgcgcttgttccccgatggtatagtgacggtggcgaacgcgaagggactgcagtactactcgactctgcttgatgctctcgtgctgcgcaatatcgagccgatcgtcactctgtaccactgggatctccctctcgccctccaggaaaagtacggagggtggaagaacgacaccatcatcgacattttcaacgactatgcaacctactgcttccagatgttcggagatagagtgaaatactggataaccattcataatccctacctggtggcatggcacggctacggcacgggaatgcacgcaccgggcgaaaagggaaacctcgccgccgtctacaccgttggccacaacctgatcaaggcgcattccaaggtgtggcacaactacaacactcattttaggccacaccaaaagggctggttgtcgattaccctcggatcccactggatcgagccgaaccggtcggagaataccatggatatcttcaagtgtcaacaaagcatggtgagtgtgttgggctggttcgccaatccaatccatggagacggagactaccccgaaggaatgcgtaagaaactgttctcagtgctcccaatcttctccgaggcagagaaacacgaaatgcggggaactgccgacttcttcgcttttagcttcggtccgaacaacttcaagccgctcaacaccatggctaagatgggacaaaatgtgtctctgaacctgagagaggctctcaactggatcaaacttgagtacaataaccccagaatcctgattgcagaaaacggatggtttaccgactccagagtgaaaactgaagatactacggctatctacatgatgaagaacttcctgtcccaggtgctccaggcaatccgcctggacgaaatccgggttttcggatacactgcgtggtcactgctggacggtttcgaatggcaagacgcctacaccatcagacgcggactgttctatgtggatttcaactccaaacaaaaggaacgcaagccgaagtcctccgctcactattacaagcagatcatccgcgaaaacggtttctccctgaaagaatcgactcctgatgtccagggtcagttcccttgtgatttttcctggggagtcactgaatcggtgctgaagccagagtccgtggcctcgtcgccgcagttctccgatccacacctgtacgtgtggaacgccacggggaatcgcctcttgcatagagtcgaaggggtgagactgaaaaccagacctgcccagtgtactgatttcgtgaacattaagaaacaactggagatgctggctcgcatgaaggtgactcactaccggttcgccctcgactgggccagcgtgctcccaactggaaatctgagcgcggtgaaccgccaggcccttcgctactaccgctgcgtggtgtcagagggtctgaagctcggtatctcagctatggtcaccttgtactaccccacgcatgcacacctgggactcccagagccactgctccatgccgatggatggctgaacccgtcgacggcggaggcctttcaggcatacgctggactttgttttcaggagctcggagatctggtcaagttgtggataactatcaatgagccgaacagactctcggacatctacaatcggtcgggcaatgacacttacggcgctgcacacaacctgctggtggcgcacgcactggcctggcgcctctatgatagacagtttcggccctcccaacgaggagccgtcagcctgagcctccacgcggattgggcagaaccggccaacccgtacgccgactcccattggcgggcggccgaacgctttctgcagttcgagattgcgtggttcgctgaaccattgttcaaaaccggtgattacccggcggcaatgcgcgaatacatcgcctctaagcaccgccggggcctcagctcgagcgccctccctcggttgactgaagccgagcggaggctgctcaagggcaccgtggacttctgcgcgctgaaccactttaccaccagatttgttatgcatgaacagctggcaggctcacggtacgacagcgaccgggatatccagttcttgcaggacattacccggctgtcctccccgacccgcctcgcggtcatcccgtggggagtgagaaagttgttgaggtgggtgcggaggaattacggagacatggacatctacatcactgcctcgggaatcgacgaccaggccctggaggatgaccgcctgcgcaaatactacctcggaaagtacctccaagaagtcctgaaggcctacctgatcgacaaggtgcgcataaaaggttattacgcctttaagctggcagaggaaaagtctaaaccacggtttggattcttcacttcggacttcaaagcaaaatcatccatccagttttacaacaaggtcatatcctccagaggattccccttcgaaaactcgtcctcgcgttgtagccaaactcaagaaaataccgagtgcactgtctgcctgttcttggtgcaaaagaagcctctcatcttcctgggatgctgcttcttctcgactctcgtgctgttgctttccatcgccatcttccaaaggcaaaagcggcgcaagttctggaaagcgaagaacttgcagcatattcctctcaagaagggaaaaagagtggtcagc

SEQ ID NO: 250570 - DNA, 3132 bp, Artificial Sequence
  Description of Artificial Sequence: Synthetic coding sequence
atgaagccaggttgtgccgcaggctctcctggaaatgaatggatcttcttttctactgatgaaattacaacccgctaccggaatactatgtctaatggcggcctgcagcggtctgttattttgagcgccctcatcttactgagggccgtgaccggcttttcaggagacggaagggccatatggagcaaaaatccaaactttacacctgtgaacgagtcacagctcttcctctacgacactttccctaagaacttcttctggggtattggcaccggtgctctgcaagtcgaaggatcttggaaaaaagatgggaagggaccatcaatctgggaccatttcatccacacacacctgaagaacgtgagctccaccaacgggagcagcgacagctatatcttccttgaaaaagacttatctgctttggatttcatcggcgtgagcttttatcagttttctatctcctggccacggctgtttcccgatggaatagttacagttgccaatgccaagggactgcagtactacagtactctgctcgacgctctggttctgagaaacattgaacccattgttaccctgtatcattgggatctgcccctggccctacaggaaaaatatgggggatggaagaacgacaccataatagatatctttaatgactacgccacatattgcttccagatgttcggcgacagggttaagtactggataaccattcataatccctacctcgtggcttggcatgggtacgggaccggcatgcatgcaccaggcgaaaaaggaaacctcgccgccgtgtacaccgtggggcataacctcataaaggcccactctaaagtttggcacaattacaacactcattttagaccacatcagaaggggtggctgtccattaccctaggatcccactggattgaacccaatcgcagcgagaataccatggatatatttaagtgccagcaatcaatggtgagcgtgctgggatggttcgccaatccaattcacggggacggcgattacccagaaggcatgcgaaagaagctcttcagcgttttaccaattttctctgaagcagagaaacatgagatgagaggcaccgctgactttttcgcattctccttcggacctaacaatttcaaacctctgaacacaatggccaagatgggccagaatgtgtccctgaacctgcgggaggccttgaattggatcaaactggagtacaataacccacgcatcctgatcgctgagaacgggtggttcacagactctagggtgaaaaccgaagacaccacagcaatctacatgatgaaaaatttcctgtcccaagtgctgcaggccattagattagatgaaattcgggtttttgggtacaccgcttggtcactcctggacggcttcgaatggcaggacgcctataccatccgcagaggcctcttttacgtggatttcaacagcaaacagaaagaacgcaagcctaaaagtagtgctcactactacaagcagatcattcgggagaacgggttcagtctgaaggaaagcactcctgacgtgcagggccagttcccttgtgattttagctggggcgtcaccgaatccgtattgaagcccgaaagtgtcgcctcctctccccagtttagcgatccacacctgtatgtctggaatgctactggaaataggctgctgcatcgggtggagggggtcaggttaaaaacacgccctgcccaatgtactgatttcgtgaatattaaaaagcagttagagatgctagcacggatgaaggttacccactacaggtttgccctggattgggcatcagtactgccaacaggcaacctcagcgctgtgaaccgacaggcactgcgttattacaggtgtgtagtgtctgaaggacttaagctggggatcagcgccatggtcaccctctactacccaacacacgcccatctagggttacctgaaccacttctgcatgccgatggctggctgaatccatccacagccgaagctttccaggcttacgccggcctgtgcttccaagagttaggtgatctcgttaaactttggataaccataaatgaaccaaatagactgtccgacatttacaatcggtccggcaatgatacttacggcgcagcacataatctcctcgtggcacatgccctcgcatggcgcctgtacgatagacagttccgtccaagtcagaggggcgcagtttctctgtcactccatgccgattgggctgagccagctaacccttatgctgacagtcactggcgcgcagcagagagatttctgcagttcgagatcgcttggttcgccgagcctttatttaaaacaggcgactacccagctgcaatgcgcgaatacatagctagtaaacatcgtagaggcctgtcaagcagcgctctgccccggctcacagaggccgagaggagactgctcaagggcaccgtggacttttgtgccttaaatcatttcaccaccagatttgttatgcacgagcagctcgcaggctctagatatgattctgacagagacatccagttcctacaggatattaccaggctgagcagcccaacaagattagctgttataccatggggagttaggaaactgctacgatgggttaggaggaattacggcgacatggatatatacatcacagctagcgggatcgatgatcaggctctggaagatgacaggttaaggaaatactacctaggcaaatacctgcaggaagttctgaaagcctatctgattgataaagtgaggattaaagggtattacgcttttaagctagcagaggaaaagtccaagcctaggtttggtttctttacttccgatttcaaggctaagagttcaatacagttctacaataaggtcatttcttcacgcggctttcctttcgagaattcatcctctcgttgtagtcaaacacaggaaaacacagagtgcacagtgtgtctctttttagttcagaagaagcctctgatcttcctaggatgctgtttcttttccaccctggtgcttctgctatctattgccatatttcagcgccagaaacggcgtaaattttggaaggctaagaatctgcagcacattccactgaaaaagggtaagcgcgtagtatcc

SEQ ID NO: 250571 - DNA, 3132 bp, Artificial Sequence
  Description of Artificial Sequence: Synthetic coding sequence
atgaaacctggttgcgccgcaggatcaccaggcaacgaatggattttctttagtacggacgagattactacccgctatagaaacactatgtctaatggcgggctccaaaggagcgtgatcctttccgcgctgattctcctgagagctgtgaccggatttagcggcgatggacgcgccatatggtccaagaacccaaacttcacgcctgtcaatgaatcgcagctctttctctacgacacctttcccaagaactttttctggggaataggtactggtgctctgcaagtggagggatcgtggaagaaggatggaaagggtccgagcatctgggatcacttcattcatactcatctgaagaacgtgtcctcaactaatggatcctctgatagctacattttccttgaaaaggacctgtcagctctggatttcattggtgtgtccttctatcaattctccatttcatggccccggctgtttcccgatggaattgtgactgttgcaaacgccaaagggctccagtactattcgaccctgctcgacgcccttgtgctgcggaatatcgaaccgatagtgaccctgtaccattgggaccttcctcttgcactccaagagaagtacggcggctggaaaaatgataccatcatagatatctttaatgattatgcaacttactgttttcaaatgtttggggacagagtcaagtattggataaccatccataatccgtaccttgtggcctggcacggttacggtacggggatgcacgcgcctggagaaaagggaaacctggcagccgtgtacaccgtgggccataacctgataaaagcccattccaaggtctggcataactacaacacccacttcagacctcatcagaaggggtggctgagcatcactttgggatcacattggattgaacctaatagaagcgagaacaccatggatatcttcaaatgccagcaatccatggtcagcgttctgggatggttcgcaaatcctatacatggagacggtgactacccggaaggcatgcgtaagaagctcttcagcgtgctgccgatcttctccgaggcagagaagcatgaaatgcggggcacggcagacttctttgcattttcgttcggacccaacaactttaagccacttaatactatggcaaagatggggcagaacgtgagcctgaacctgagagaagcgctcaactggatcaaactggaatacaataatccacgaattttgatcgctgagaacggatggtttaccgattcgcgcgtaaagacggaggatacgactgccatttacatgatgaagaattttctgtcgcaagtgctgcaagcaatacggctggacgaaattagagtctttggatatactgcgtggtcccttctcgatggattcgaatggcaagacgcctacaccattcgaagagggcttttctacgtggatttcaattcgaagcagaaagaaagaaaaccaaagtcgtccgcgcactactacaagcaaatcataagagaaaacggctttagcctcaaggaatccacccccgatgtccagggccaattcccctgcgattttagctggggtgtcaccgagagcgtgctgaaacctgagagcgtggcatcctcgccccaattctcggacccgcacctttacgtctggaatgcaactggaaatcggctgctgcatagagtggagggagtgagactcaaaactagacctgcacaatgtacggactttgtcaacatcaagaaacaactggagatgcttgctagaatgaaggttacccactaccgcttcgcactggattgggcatcggtgctcccaactggtaacctctcagcagtcaatcgccaagccctccgatactacagatgtgtggtttccgagggacttaaactgggaatcagtgcaatggttactctttactaccctacccacgcacatctgggcctgccagaacctttgctgcatgctgacggctggctgaacccttcgactgcagaagccttccaggcatacgcagggttgtgttttcaggagctgggtgaccttgtgaaattgtggattactatcaacgagccaaatcgactgagcgacatctataacaggtctggcaatgacacgtacggagctgcccacaacctgctcgtcgcacacgctctggcatggcggctctacgatagacaatttagacccagtcagcgtggggccgtgtcgctctcactccacgcagattgggccgaaccagccaacccttacgcagattcgcattggagagcagccgaacgcttcctgcaatttgaaattgcatggttcgcagaacctttgtttaagactggtgactacccagcagcaatgagagaatacatcgcgagcaaacacagaagaggattgagctccagcgcgcttccacgacttactgaagcagagcgcagacttttgaaggggactgtggacttctgtgctcttaaccacttcactactaggtttgtgatgcatgaacagctggcaggcagcaggtacgacagcgatagagacatccaatttctgcaggatattactcggctgtctagccccacccgccttgcagtgattccttggggagtccgaaaactgctgcgatgggtgcggaggaactacggtgacatggacatttacatcactgcatcaggtatcgatgatcaagcactcgaagatgatcgactcagaaagtactacctcggcaagtaccttcaggaagtgctgaaggcatacctgatcgataaagtgcgcataaagggttactacgcatttaagctggcggaagagaagtcgaagccacggtttggtttctttacctcagactttaaggccaaatcatccatccagttttacaacaaggtaatttcctcccgtggattcccattcgaaaacagcagctcgcgatgttcccagacccaggaaaataccgaatgcaccgtgtgtttgtttcttgtgcagaagaaaccactgatttttctcggttgctgtttcttttccaccctggtcctccttttgtcgatcgcgatttttcaaaggcaaaaaagaagaaagttctggaaagccaagaacctgcaacatatcccacttaagaaggggaagcgggtggtgtcc

SEQ ID NO: 250572 - DNA, 3132 bp, Artificial Sequence
  Description of Artificial Sequence: Synthetic coding sequence
atgaaaccaggatgcgcggctggcagtccaggcaatgagtggatctttttctccacagatgaaattaccactcgctaccggaataccatgtcaaatggggggctgcaacgcagcgtgatcctgagtgcactgattctgctgcgtgccgtgaccgggttttctggcgacgggagggcaatctggagtaagaatccaaactttactccagtcaatgaaagccagctcttcctgtacgacacctttccgaaaaacttcttctgggggataggtaccggtgccctgcaggtggaaggcagttggaagaaagatggaaagggaccttctatctgggatcactttatacacacgcacctgaagaacgttagttcgaccaatgggagctccgattcctacatcttcctcgaaaaggacttgtctgctctggactttatcggggtatcattttatcaattctcaatcagttggccaaggctctttcccgacggtatcgtgactgtcgccaatgctaaggggctgcagtattatagcactctactcgatgcactggtgctccgaaatatcgagccaattgtgaccctgtaccactgggatcttccactcgcccttcaggagaaatacggcggctggaaaaacgataccattatcgatatcttcaacgactacgctacttattgttttcagatgttcggagatagggtgaagtactggatcaccattcacaatccgtacctggtggcctggcatggttatggcaccggaatgcatgcacctggcgaaaagggaaatctggctgctgtttacactgtcggtcacaaccttatcaaagcgcacagtaaagtttggcataactataacacacacttcaggccacatcagaaaggatggctttccatcactctcgggtctcattggatcgagcccaatcgatccgagaatacaatggacatttttaagtgccagcagtcaatggtgagtgtgctcggttggttcgctaaccctatccatggtgatggcgactaccccgaaggtatgagaaagaaattgttttccgttcttccaattttcagcgaggctgaaaaacacgaaatgagaggcaccgccgatttttttgccttctctttcgggcccaataactttaagccactgaataccatggcgaaaatggggcagaatgtttccctcaatctcagggaggctctgaattggattaagctggaatataacaaccctcgtatcctcattgccgagaacggatggtttaccgacagccgagtaaagactgaggacacaaccgctatttacatgatgaaaaactttctttctcaagtgcttcaggctatcagattagacgaaatccgagtgtttggctatactgcttggtccttgctggatgggttcgagtggcaggacgcttacacaattaggcggggcctgttttatgttgactttaactcgaagcaaaaagagcggaagcccaagtcatcagcacattactataagcagattatccgtgaaaacggcttttcactcaaggagagtacaccagacgtccaggggcaatttccctgcgatttctcttggggtgtgaccgagtcagtcctcaaaccggagtctgtggcgagcagtccccagttttctgacccccatctgtatgtgtggaatgctacggggaaccgactgctccacagagttgagggagtccgactgaagacgaggcctgcccagtgcaccgacttcgtgaatataaaaaaacagcttgagatgctagccaggatgaaggttactcactatagatttgcactggactgggctagcgttctaccaaccggaaatctttcggccgtgaaccggcaagccttacgttactaccgttgcgtggtgagtgaggggttaaagcttggcatcagtgcaatggtgactctgtattaccctacacatgctcatctcggtttgcccgagccactgttacacgcggacggatggctgaatccgtccaccgcagaggccttccaagcctacgccggcttgtgcttccaagaattgggcgacttagtgaaactgtggattaccataaacgagcccaacaggctaagcgacatttacaaccgttcgggtaacgacacctatggcgcggctcacaaccttctcgttgcacatgcactcgcttggcggctgtatgatcggcagtttcgacccagtcagcgaggggccgtctcattgtcactgcacgctgactgggcagaaccagccaacccatatgctgattcacactggagagcagctgaacgatttctgcagtttgagatagcttggtttgccgagcccctgttcaagacaggtgactaccctgcagccatgagagagtacattgcgagtaaacatagacgaggcctgtcaagcagtgctctcccacgactgacagaggccgagcgaaggctcctgaaagggacagtcgacttctgtgccctgaaccattttactacccggttcgtgatgcatgagcagctagctggttccaggtacgactctgatagagacatccagtttctgcaggatatcacccgactatcttctccaactcgattggcagtgataccctggggcgtgcgaaaactgctgagatgggtcaggcgaaactatggcgatatggacatctatatcactgcaagcggaatcgatgaccaggctctggaggatgatagactccgtaaatactacctcggaaagtatttgcaggaagtgttgaaggcctatctcatcgacaaagttcgaatcaagggatattatgcgttcaagctggcagaagagaaatccaagccacgattcggattctttacctcagactttaaggcaaaaagtagcatccagttttacaacaaggtgataagctcacgtggattccccttcgaaaactccagctctcgatgtagtcagacccaggagaataccgaatgtaccgtatgtctcttcctggttcagaagaaaccactgatcttcctgggctgctgtttcttcagcactcttgttctgctgctgtccattgcaatatttcaacgtcagaaaaggagaaagttttggaaagcgaagaatctccagcacatccctctcaaaaaaggcaagcgagtggtcagc

SEQ ID NO: 250573 - DNA, 3132 bp, Artificial Sequence
  Description of Artificial Sequence: Synthetic coding sequence
atgaaacccggctgtgcagccggaagcccaggtaatgaatggatcttcttcagcactgacgagattacgacccggtacagaaataccatgtccaatggagggctccagcgttcagtgatcctgagcgcgctgatcctcctccgcgccgtcaccggatttagcggggacggcagggccatttggtcgaaaaacccgaatttcaccccggtgaacgagtcgcagctgtttctttacgatacctttccgaagaacttcttctgggggatcggaaccggagcgctgcaggtggagggatcgtggaagaaggacggcaagggaccgtcaatctgggaccatttcatccatacgcatcttaagaatgtgtcgtcaaccaatggctcgtcggattcctatatcttcctcgaaaaagatctgtcggccctggacttcatcggagtgtcattttaccagttctcaatcagctggccgcgcctgtttcctgacggaatcgtcaccgtcgccaacgccaagggactgcagtactactctacccttctggacgccttggtcctccgcaacatcgaacctattgtgacgctctatcactgggatttgcctctggcactgcaagagaagtacgggggatggaagaacgacactatcatcgacatcttcaatgactacgcaacctactgcttccagatgtttggggaccgcgtgaagtattggattactatccataacccctacctggttgcttggcacggatacggaaccggaatgcatgccccaggcgaaaagggaaatctggcagcagtgtacaccgtaggtcacaatctcatcaaggcacacagcaaggtctggcataactataacactcacttccgccctcaccagaaagggtggctcagcatcaccctggggagccactggatcgaaccgaacagatccgaaaacactatggatatcttcaagtgccaacaatccatggtgtccgtgctgggctggttcgccaatcctatccacggagacggcgactacccagagggaatgcgcaagaagctcttcagtgtcttgccgatcttctccgaggcggagaagcacgagatgcgggggacggctgacttcttcgctttttcgttcggtcctaacaatttcaaaccgctgaacactatggcaaaaatggggcagaacgtttctctgaaccttagggaagccctcaactggatcaagctggagtacaacaacccgcgcatcctgattgcggaaaacggatggtttaccgatagccgcgtcaagaccgaggacacgactgctatttacatgatgaagaacttcctgtcgcaggtcctgcaggctatccgcctggatgagatcagggtctttggatacactgcctggtcgctgctcgacgggttcgaatggcaggatgcctatactatccgcagaggactcttctacgtggactttaactctaaacagaaggagcgcaaaccgaagtcgagtgcccactactacaagcaaatcatccgtgaaaacggattctcactcaaggagtcaacgccggatgtccaagggcaattcccgtgcgatttttcctggggagtcaccgagtccgtattgaagccggagtcggtggcctcttctcctcaattcagtgaccctcatctttatgtttggaacgccactggcaaccgcctgctgcatagagtggaaggggtgcggcttaaaaccagacctgcacaatgcaccgacttcgtgaacatcaaaaagcagctcgaaatgctggccagaatgaaggtgactcactaccgctttgcgctggattgggcttccgttctgccaacgggtaatctgagcgccgtcaatcggcaggccctccgctactaccggtgtgtcgtctccgaaggacttaagctgggaattagcgcgatggtgaccctttactaccccacccatgcgcacctcggcctgccggaaccgctcctccatgctgatggatggctgaacccgtccaccgcagaagcgttccaggcctacgctggactttgcttccaggaactgggggatctggtcaagctgtggatcacgatcaatgagcccaacaggctgtcggatatctacaatcggtccggcaacgacacctatggcgctgctcataatctgctcgtggcccacgctctcgcttggcggctttacgatcgccaattcagaccgagccaacggggcgctgtgtcgctctcacttcacgcagattgggcggaaccggcaaacccctacgcagattcgcattggcgcgcggcagaaagatttctgcagttcgagatcgcctggttcgccgaaccactgttcaagactggggactaccctgccgcgatgcgcgagtacatcgcctcaaaacatcgccggggactctcgtcatccgccctgccgcgcttgactgaagccgagaggcggctgctgaagggaactgtcgatttctgtgcattgaatcacttcaccactcggttcgtcatgcatgaacagctcgccggatcaagatacgacagcgaccgggatattcagttcttgcaagatatcactagactgtcgtcgccgactcggctggctgtgatcccttggggggtgcggaaactgctgcgctgggtgaggcggaactacggcgatatggacatctacatcaccgcctccggcatcgacgaccaggcacttgaggacgacaggctgagaaagtactacctgggaaagtacctccaggaagtcctgaaagcctacctgatcgacaaggtgcgcatcaagggatactacgctttcaaactcgcggaagagaaaagcaagccaaggttcggattcttcaccagcgactttaaggccaagtcatcgatccagttttacaataaggtgatctcatcgagaggctttccattcgagaattcgtcgtccagatgctcacagacccaggagaacaccgaatgcactgtgtgtctgtttctggtccaaaagaagccgctcatcttcttgggatgctgcttcttctcgactctggtgctcctcctgtcgatcgcaatcttccagagacaaaagcgccggaagttttggaaggcaaagaatctgcagcatatcccgcttaagaaaggaaagcgggtggtgtct

SEQ ID NO: 250574 - DNA, 3132 bp, Artificial Sequence
  Description of Artificial Sequence: Synthetic coding sequence
atgaaaccaggttgtgcagctggatcaccaggaaatgagtggattttttttagtacagatgaaattacaacacgttatcgaaatactatgtctaatgggggacttcaaagatcagttattttatcagctttaattttattacgagcagttactggattttcaggagatggaagagctatatggtctaaaaacccaaattttactccagttaatgaaagtcaattattcttatatgacacttttccaaagaattttttctggggaattggaacaggagctcttcaagtcgaaggttcatggaaaaaggacggaaaaggaccatccatttgggatcatttcattcatactcatttaaaaaatgttagttcaacaaatggttcttctgattcatatatttttcttgaaaaagacttatcagctttagacttcattggagtttcattttatcaattctcaatttcttggccacgtcttttccctgatggaattgtaactgttgcaaatgctaaaggattacaatattattctacattattagatgctcttgtacttagaaatattgaacctatagttaccctttatcattgggatcttccattagcattacaagaaaaatatggaggatggaaaaatgacacaattattgatatttttaatgattatgcaacttattgttttcaaatgtttggagatagagtaaaatattggattacaatacacaatccatatcttgttgcttggcatggttatggtactggaatgcatgctccaggagaaaaaggaaatcttgctgctgtttatacagttggacataatttaattaaagcacatagtaaagtttggcataattataatactcattttagaccacatcaaaaaggatggctttctattactcttggatctcactggattgaacctaatagaagtgaaaatactatggatatctttaagtgtcaacaatctatggtctctgtgcttggatggtttgctaatccaattcatggagatggagattatccagaaggaatgagaaaaaaattattttcagtattaccaattttcagtgaagctgaaaaacatgaaatgagaggtacagcagatttttttgcattttcatttggaccaaataattttaaaccattaaatactatggctaagatgggacaaaatgttagtcttaatttaagagaagctttgaattggattaaattagagtataataacccacgaattttaattgctgaaaatggttggttcacggactctagagtcaaaacagaagatactactgctatttatatgatgaaaaattttctttctcaagttttacaagcaataagacttgatgaaataagggtttttggatacacagcttggtctcttcttgatggatttgaatggcaagacgcttatactattagacgtggattattctatgtagattttaattctaaacaaaaagaaagaaaaccaaaaagttctgctcattattataaacaaattattcgtgaaaatgggtttagcctaaaagagtcaactccagatgttcaaggacaatttccttgtgatttttcatggggagttactgagtcagtgttgaaaccagaatcagttgcaagtagtccacaattctcggatccacatctatatgtatggaatgcaactggaaatcgtttacttcacagagtagaaggagtaagattgaaaacaagaccagcacaatgtacagattttgttaatataaaaaagcaattggaaatgcttgcaagaatgaaagttacacattatcgattcgctttagactgggcatcagttttaccaacaggaaacttatcagccgttaatagacaagccttaagatattatagatgtgttgttagtgaaggattaaaattggggattagtgcaatggttactttatattatccaacacatgctcatttaggattaccagaacctttgttacatgcagatggatggttaaatccttctacagcagaagctttccaagcttatgcaggattatgttttcaagaattaggtgatttagttaaattatggataacaattaatgaaccaaatagattaagtgatatttacaatcgttctggaaatgatacttatggagcagctcataaccttctagttgcacatgctttagcttggagattatatgatcgtcaatttagaccttcacaaagaggggctgtatcattatcacttcatgcagattgggcagaacctgctaacccttatgcagattcacattggagagctgctgaaagatttttgcaattcgaaattgcttggtttgccgaaccattatttaaaactggagattaccctgctgctatgagagaatatattgcaagtaaacatagaagagggttaagtagttcagctttaccaagacttactgaagcagagagaagacttcttaaaggaacagtagatttctgtgctttaaatcatttcacaacaagatttgttatgcacgaacaattagcaggatctagatatgattcagatcgtgatattcaattccttcaagatattacaagactttcatcaccaacacgtttagctgttattccatggggagttagaaagcttttacgatgggttagacgtaattatggtgacatggacatttatataacagcatccggtattgatgaccaagctcttgaagatgatcgacttagaaaatattatcttggaaagtatttacaagaagtccttaaagcttatttaattgataaagttagaattaaaggttactatgcatttaaattagcagaagaaaaatcaaaaccacgttttggtttttttaccagtgatttcaaagctaaaagttctattcaattttataataaagttatttcttcaagaggatttccatttgagaattcatcatcaagatgtagtcaaactcaagaaaatactgaatgtacagtttgtttattccttgttcaaaaaaaacctcttattttcttgggttgttgttttttttctacccttgtcttattacttagtattgctatttttcaaagacaaaaaagaagaaaattttggaaagcaaagaatcttcaacatattcctttaaaaaaaggtaaaagagttgtttca

SEQ ID NO: 250575 - DNA, 3132 bp, Artificial Sequence
  Description of Artificial Sequence: Synthetic coding sequence
atgaaacctggctgcgccgctggtagtccaggaaatgagtggatcttcttttcgaccgatgaaatcacaacacgttaccggaacaccatgtccaacggcggcctgcagcgatccgtgatattgagcgcactaatactgttgcgggcagtcaccggcttttccggagatggtagagctatttggtccaaaaaccctaacttcacacctgtgaatgaaagtcagctgtttctgtatgacacgttccctaagaatttcttttgggggatcgggaccggagctcttcaagtggaggggtcctggaagaaggacggtaaggggccatccatctgggatcattttattcacacgcacctgaagaacgtatcctcaacaaacggcagctctgactcgtatatattcctggagaaggacctgagcgcccttgatttcataggtgtgtcattttatcagttttctatatcgtggccgaggctttttcccgatggtatcgtgactgtcgccaatgccaagggcctgcagtactacagcacactgctggacgccctagttctgcggaacatcgagcctatagtgactttgtatcactgggacctgccgttggctctacaggagaagtacggcggctggaaaaatgacacaatcatcgacatttttaacgactatgcaacttattgcttccagatgtttggcgatagggttaaatattggattactatccataatccttatctggtagcctggcacgggtacgggaccggtatgcacgcccccggagagaaaggcaaccttgccgctgtgtatactgttgggcataatctgattaaagcacatagcaaggtgtggcataattacaatacacatttccggcctcaccagaaaggctggctctcaattaccctaggctcccattggattgagcccaatcggagcgagaataccatggacatctttaagtgtcagcagtctatggtctctgtgctgggatggttcgcaaacccaatacatggcgatggagattaccctgaggggatgcgcaaaaaactcttttccgtgctgcccatattcagtgaggcggagaaacacgaaatgcggggtactgccgacttctttgctttctcctttgggcctaacaacttcaagccactgaacactatggctaagatggggcaaaacgtgagtctaaatctgcgagaggcgttgaactggatcaagcttgagtacaataatcccaggattctgattgccgagaacggttggtttactgacagccgcgttaagaccgaggataccactgccatctacatgatgaagaacttcttgtcacaggtgctccaagcaatccgcctcgacgagatccgggtattcgggtacactgcctggagtctgctcgatggatttgagtggcaggatgcttacaccattaggagaggactgttctacgtagactttaattccaagcagaaggaaagaaaacccaagagcagcgcccactactacaaacagattattcgtgaaaacggtttctctctcaaagaaagcacaccagatgtacaagggcagttcccatgtgatttttcttggggcgtgactgaaagcgtgctgaaacctgaatcagtggcctccagtccccagttttcagacccacacttgtatgtgtggaacgcgactggcaaccggttgctccatcgggtcgagggcgtgagacttaaaacgaggcccgcacaatgcaccgattttgtgaacatcaagaagcaactcgagatgttggcccggatgaaagtgactcactaccgcttcgcactagactgggcttctgttctgccgaccggaaacctctccgcagttaatcggcaggccttgagatactaccggtgcgtagtaagtgaaggactcaagctgggcatcagcgccatggtgaccctctactaccctacacatgctcatctggggctgccagagcccctactgcacgcagatggctggctgaacccctctaccgccgaggcattccaagcctacgccggcctctgttttcaggaattaggggatctggtgaaactgtggatcacaatcaacgaacccaaccggctaagcgatatttacaatcgctcaggtaacgatacttacggcgccgcgcataacctgctggtggctcatgccttggcctggagactctacgataggcagtttcgacctagccagcggggggccgttagcctttcccttcatgcggactgggccgagcctgcaaacccctacgctgatagccattggcgggccgcagagaggtttctccagtttgaaattgcttggtttgccgagcccctgttcaagaccggggattacccggcagccatgcgggagtacatagcgtccaagcatcggcgtgggctgtccagctccgccctgccgagacttacggaagccgagaggcgcctgctgaaaggcaccgttgacttctgcgccctcaaccactttaccacacgttttgttatgcacgagcagctcgctggtagtagatacgacagcgacagagatattcagtttcttcaggatataactcgactctcatctccaaccaggctggccgtgattccctggggcgttaggaagctgctccggtgggtgcgccgtaactatggcgacatggatatatatattaccgccagcgggatcgatgaccaggcactcgaagacgacaggctacgcaaatattacctgggaaagtatctacaggaagtcctgaaagcgtacctgattgacaaagtgcgcattaagggttactacgcatttaagttagcagaggagaagtcgaaaccaaggtttggtttcttcactagcgattttaaggccaaatcttctatccagttctacaacaaggttatcagcagccggggcttcccgtttgagaatagcagtagccgctgttctcagacccaggaaaacacagagtgcaccgtctgcctgtttctcgtccagaagaagcctctgatattcctgggctgttgcttcttcagcaccctcgtgctcctgctcagcatcgcgattttccagcgtcagaagcgtagaaaattctggaaagcaaaaaacctgcagcacatccccctaaagaaaggcaagagggtcgtttcc

SEQ ID NO: 250576 - DNA, 3132 bp, Artificial Sequence
  Description of Artificial Sequence: Synthetic coding sequence
atgaagcccggatgtgcagccggttcacctggaaacgagtggatctttttctccaccgatgagatcactacccggtaccgtaatactatgtcaaacggaggactccaaaggtcggtgatactttcggccctgatactgctccgtgcggtgaccggattcagcggggatggacgtgcaatctggtcgaagaatcccaacttcactcctgtcaacgaatctcaactcttcctgtacgacacctttcccaagaactttttctggggaattggaaccggggcccttcaagtcgaaggaagctggaagaaggacgggaagggaccttcaatatgggatcactttatacatacccacctgaagaatgttagctctacgaatggctcgtccgactcgtacatattccttgaaaaggatctttcggcactcgactttatcggtgtgagcttctaccagttttccatctcctggccaagactgtttcccgacggtattgtgaccgtggcaaacgcaaagggactgcagtactactcgaccctgcttgacgccctggtgctgagaaacatcgagccaatcgtgaccctgtaccattgggaccttcctctcgcgctgcaagaaaagtacggagggtggaagaatgatacgattattgacattttcaacgattacgcaacttactgctttcagatgttcggggaccgcgtcaagtattggattaccattcataacccgtaccttgtggcttggcatggatacggaaccggaatgcatgcccctggagagaaagggaatctcgccgcagtctacaccgttggccataacctgattaaggcccactcgaaggtctggcataactacaacactcatttcagacctcatcagaagggatggctgtcgattactcttggatcccactggattgagccaaacaggagcgagaacactatggacatctttaagtgtcaacaatcgatggtgtcggtcctcggatggtttgctaaccctatccatggtgatggtgattaccctgagggtatgagaaaaaagctgttcagcgtcctccctatattctccgaagccgaaaagcatgaaatgagaggcacggcagatttctttgcattttcctttggtcccaataactttaagcctctgaacactatggcaaagatgggacaaaacgtgtcactgaaccttagagaggcgctgaattggatcaaactggaatacaataatccgcggatcctgattgccgaaaacggatggtttacggactcgagggtgaaaacggaggacaccaccgctatttacatgatgaagaactttctctctcaagtccttcaggcgattcgcctggatgaaattagagtgtttggctatactgcatggtcgttgctggatggtttcgaatggcaagatgcatacaccattcgccgtggtctgttttacgtggatttcaattcgaagcaaaaggaaaggaagcctaaatcctccgcacactactacaaacagattatcagggagaatggtttttccctgaaagaatcaaccccagacgtccaaggtcagttcccgtgtgatttctcgtggggggtcaccgagtcagttctgaaaccagagtccgtggccagcagccctcaattttccgatcctcacctttacgtatggaacgctaccggaaatcggttgctgcatcgggtcgagggcgtccgcctcaagactaggccggcccaatgcactgattttgtcaacatcaaaaaacagcttgagatgctggcaagaatgaaggtgacccactatcgctttgcactggactgggcatcggtgctgcctactggaaatctttcagctgtgaaccggcaagccctgcggtattacaggtgtgtcgtgagcgaaggactgaaacttggaattagcgcaatggtcactctctactacccaactcatgcacacctcggccttcctgagccgctccttcatgcagacggatggctgaacccatcaaccgcagaagcatttcaggcatatgccggcctttgttttcaggaactcggtgatctggtgaaactttggattactattaacgaaccaaatagattgtcggatatctataatcggtccggcaacgatacctacggggccgcgcataacctccttgttgcacacgcccttgcatggagactttatgatagacagtttaggccttcgcagcgaggcgccgtctcactttccctccatgcagattgggcagagcctgcaaacccttacgcagacagccactggcgggcggcggaacggttcctccagtttgagattgcctggttcgcagaaccgctctttaagaccggggactatccagcagcaatgcgcgagtacattgcatcaaaacatcggaggggtctgtcctcctcggcacttcctaggctcaccgaagcagaacggcgactgcttaagggaaccgtcgatttttgcgcacttaatcattttaccaccaggtttgtgatgcatgaacaactggccggatctaggtacgattcagacagagacattcagtttctgcaggacattacccgtctgtcgagccctaccaggctcgccgtcattccttggggagtgcgaaaacttctccgttgggtgcgtaggaattatggtgatatggacatttacatcaccgcgtcaggaattgacgatcaagcacttgaagatgacagactgcgaaaatactacctcggaaaatacctgcaggaagtgctcaaggcatacctcatcgataaagtgagaatcaaaggatactacgctttcaaacttgcggaggagaaatcaaaaccacgttttggattcttcacctcagactttaaagcaaagtcgtcaattcagttttacaataaggtgatttcgtcccggggctttccatttgaaaattcctcatcccgctgttcgcaaacgcaagaaaacacggagtgcactgtgtgcctttttctggtgcaaaagaaacccctgattttccttggatgttgcttcttctccactctggtgcttctgctgtccatcgctatctttcagcggcagaaacggaggaagttttggaaggccaaaaaccttcaacacatccctttgaaaaaggggaagcgcgtggtgtcc

SEQ ID NO: 250577 - DNA, 3132 bp, Artificial Sequence
  Description of Artificial Sequence: Synthetic coding sequence
atgaagccaggctgtgctgccgggtcgcctggcaatgagtggatattcttcagcacggatgaaattacaacccgttatcggaataccatgagcaacggtgggctccagcgaagtgtaatcctgtccgcgttgatactcctgcgggcggtgacgggcttcagcggtgacgggagggccatctggtccaaaaatccaaatttcactccggtgaatgaatctcagctctttttgtatgacactttcccaaaaaacttcttctggggcatcggtaccggcgcccttcaggtagagggttcctggaagaaggatgggaagggccccagcatttgggaccattttatccacacccatctgaagaacgtatcctcaaccaatggcagctccgactcttacatcttcctggaaaaggacctaagtgccctggatttcattggtgtcagcttctaccagttctctatctcatggccccgtctgtttccggacggcattgtaacggttgcaaacgctaaaggcttgcagtattatagtaccctcctcgacgcgttggtgctgcgcaatattgagccgatcgtgacgttatatcattgggatctcccactcgctctgcaagagaaatacggggggtggaagaatgacaccatcatcgacattttcaatgactacgcgacttattgtttccagatgttcggagatcgcgttaagtattggatcacaattcacaacccatatttagtggcttggcacggctatgggaccggtatgcacgccccaggagagaaaggtaaccttgccgcggtctataccgtaggccacaacctgatcaaggcccatagcaaggtttggcataattataacacacatttccgaccacaccaaaagggttggcttagcattacattgggaagccattggattgagcctaatagatccgaaaacacgatggatatcttcaagtgccaacaatccatggtcagcgttcttgggtggttcgccaaccccatccatggtgacggtgactaccccgagggcatgcgcaagaagttgttttctgtattgcctatcttctccgaggcagaaaaacatgaaatgcgggggacagcagacttctttgccttctctttcggcccaaataatttcaaaccactgaacaccatggctaagatgggacaaaacgtgtccctgaatctccgggaggcactaaactggatcaagttggagtacaataacccccgcattttgatcgccgaaaatgggtggtttaccgacagtcgcgtcaaaactgaagacacaacggccatctacatgatgaaaaattttctctctcaagttctacaagccattcgactggatgagattagagtgttcggatacaccgcctggtccttgcttgatggatttgaatggcaggacgcatataccatccgccgagggctcttttacgttgatttcaacagcaagcagaaagaacgcaaaccgaagtcgtctgctcattactataagcagatcatccgcgaaaatggcttctccttaaaagagagtactcccgacgtccagggccaattcccatgcgattttagttggggagtaaccgagtcagttctgaagcctgagtcggttgcatcttccccacaattttccgatccccatctgtacgtgtggaatgccaccgggaaccggctcctgcatcgagtcgagggagttcgccttaagactagaccagcacagtgcaccgactttgtgaatatcaaaaagcaactggagatgctcgcgaggatgaaggtcactcactatagatttgccttagactgggcttcggtcctccctaccggaaacctttccgctgttaaccgccaggctttaaggtattataggtgcgtcgtctctgaggggctcaaactgggaattagcgcgatggtcactctttattatcccacccatgcccacctaggactccctgagcccctgctgcacgctgacggatggctaaatccgagcacggccgaagcattccaggcctacgctggcctgtgttttcaagaactgggagatctcgtcaagctctggattacaatcaacgaacctaatcgtttgagcgacatttacaatagatctggtaacgatacttacggtgcagctcataacctgttggtggctcacgcgctcgcctggagactctacgaccgccagtttcggccatcacagcggggggccgtgtctctgtctcttcacgcagactgggctgagccagcaaatccttacgcggattctcactggagggcagctgagcgcttcctgcagtttgagattgcatggtttgccgaacccctttttaaaactggagattatccagccgcaatgagggagtacattgcctcaaaacaccgcaggggactgtcctcttcagctttgcctcggttaaccgaagcagaaaggaggttactgaaagggactgttgatttctgcgcattgaatcactttactactcgttttgtgatgcacgaacagcttgccgggtcgagatacgatagcgatagggatatacaatttctgcaggacataactagattatcttccccaacaaggctcgccgtgatcccgtggggggtgagaaaactgctccgctgggtccgaagaaactacggcgatatggacatctacatcacagcgtcaggaattgacgaccaagccttagaagatgacagacttcgtaagtattatctgggaaagtacttgcaagaggtactgaaagcctatctgattgataaggtgcggatcaaaggctactatgcgtttaagctcgccgaagaaaagagtaaacctcggttcgggttttttacctccgacttcaaggcaaaatcaagtatccagttctataataaagtgattagttctaggggcttcccttttgaaaatagctcctcgcgctgcagtcagacccaagagaacactgagtgcacagtgtgtctttttcttgtgcaaaaaaaacccctaattttccttggctgctgtttctttagcacattggtattactcttatccatcgctatctttcagagacagaagagacgaaagttctggaaagctaagaatcttcagcacatcccactgaaaaaggggaagcgcgtggtcagc

SEQ ID NO: 250578 - DNA, 3132 bp, Artificial Sequence
  Description of Artificial Sequence: Synthetic coding sequence
atgaaacccggatgtgcagctggatctcctgggaatgaatggatttttttttcaacggatgagatcacaacaagatatcggaacacgatgtctaatggaggactgcagagatctgtgatactcagtgccctcattcttctaagggccgttactgggttttctggggacgggagggctatctggagtaagaaccccaacttcacacccgttaacgaatctcagttattcttgtatgatacttttccaaaaaacttcttctgggggatagggacaggagcattacaggtggaaggaagttggaaaaaggatgggaaagggccttctatatgggatcacttcatacacactcacctcaaaaatgtgtccagtacaaatgggtcctccgattcatatatttttctggaaaaggatctgagtgcactcgatttcatcggagtctcattttatcagttttctatatcgtggccccggctttttcccgacgggatagtcactgtcgccaatgccaaagggttacagtactactctacactccttgatgcccttgtgcttagaaatatcgaaccaatcgtcacactataccattgggatctccccctcgcactacaggaaaaatacgggggatggaaaaatgatacaataatcgatatattcaacgattatgctacgtattgcttccagatgttcggagaccgagtcaaatattggatcacaatccataatccatacttagttgcctggcatgggtacggaacaggaatgcatgcacccggagaaaaagggaatctcgccgcagtgtacacagtggggcacaatctcataaaagcacactctaaagtgtggcacaattataatacacattttcgccctcatcagaagggatggttatctatcacactcggatctcattggatagaacctaaccgctcagaaaacacaatggacatttttaaatgccagcaatccatggtgtctgtgctggggtggtttgcaaaccctatccatggagatggggactatcctgaaggaatgaggaaaaaacttttttccgtgttacctatcttctctgaagcagaaaaacacgaaatgcggggaacagcagatttctttgcgtttagttttggacctaataattttaagcctctcaacacaatggccaaaatgggacagaatgtatccctgaacctgagggaagctcttaactggattaaactcgaatacaacaatccacgaattttaattgcagaaaacgggtggtttactgactctcgggtaaaaacagaagatactactgctatctacatgatgaaaaattttctatcccaggtcctgcaggcaataaggcttgatgagatccgggtttttggatatactgcttggagtttactcgatgggtttgaatggcaggatgcttatacaatccggcgtggactcttctatgtggatttcaactccaagcagaaagaaagaaagccaaaatcatctgcacactactataaacagatcattcgggaaaacggattttcactcaaagaatccacacctgatgtgcagggacaattcccttgtgatttttcctggggggtcactgaatcagtgttaaaaccagaaagtgtagcttcttccccccagttcagtgatcctcacctctacgtgtggaatgcaactggaaacagactcttgcatcgagtggaaggggtcagactgaagactagaccagcgcagtgcactgattttgtgaacattaaaaaacagttagaaatgctcgcaagaatgaaagtgacacactataggtttgccttggattgggcttccgtgctccctacaggaaacctctcggcagtgaataggcaggctctccggtactataggtgtgtagtttctgaaggacttaagctcgggatctccgcaatggtgactctgtattatcccacacacgcccatcttggactccccgaacctttgctgcacgccgatggatggctaaaccctagtacagcagaagccttccaggcttacgctggactgtgcttccaggaactaggagatctggtgaaactgtggatcacaataaatgaacctaatagactctctgacatctacaatcgcagtggaaatgatacttatggggctgcacacaacctcctggtggctcatgcacttgcttggcgtctctacgatcgccagttcagaccaagtcagagaggagcagtatcgctgtctctccacgccgattgggccgaacccgccaacccctatgccgatagtcattggcgggctgccgagcgcttcttacagttcgaaatcgcttggttcgcggaaccccttttcaaaactggagactaccctgctgccatgcgagaatatatcgcctctaaacatcgaagaggactctccagttctgctctccccagactgactgaagccgagagacggctgcttaaagggactgtagatttctgtgccctgaaccacttcacaacacgtttcgttatgcacgaacagcttgccggatcaagatatgattccgatcgggatatacagtttctacaagatatcactagactttcttcccccactcgactggccgttattccatggggagtcaggaaactcctgagatgggttaggaggaactatggggacatggacatatacattactgccagtgggattgacgatcaggctctagaggacgataggttaagaaaatattacttagggaaatatctccaggaagtgctgaaagcctacttaatagataaagtgcgcattaaagggtattacgcatttaaattagctgaagagaaatctaagcctagattcgggtttttcacatctgactttaaagcaaaaagtagtatccagttttataataaagtgatctcttctagagggtttcccttcgaaaactcttcctctcggtgtagtcagacgcaggaaaacacagaatgtacagtgtgcctctttttggtccagaaaaaacccctgatatttctcgggtgttgtttcttttcaacattagtactccttctgagtattgctattttccagagacagaaacgaagaaaattctggaaagccaaaaatctgcaacacatccctctaaaaaaaggaaaacgggtggtatcc

SEQ ID NO: 250579 - DNA, 3132 bp, Artificial Sequence
  Description of Artificial Sequence: Synthetic coding sequence
atgaaaccaggatgtgcggccggatcccctggcaatgagtggatttttttttctaccgacgaaatcacaacgaggtacaggaacactatgtctaatggcgggctgcaacggtccgtcatcctgtcagcactgatcctgctgcgggccgttacaggcttttcaggggacggccgcgcaatttggagtaagaatccgaacttcactcccgtgaatgaatcacaattgtttctgtatgacaccttccccaaaaacttcttctggggaatcggtacaggcgccctgcaggttgaagggtcttggaagaaggacgggaagggcccatccatctgggatcacttcatccacactcacttgaaaaatgtgtccagtactaacgggagttcagactcatatatctttctggaaaaggatttgagtgcgttggactttattggcgtgtctttttatcagtttagtattagttggcctagactgtttccggacggcatcgtgacggtggccaacgctaagggtctccagtattatagcacactgcttgacgcactcgtactcagaaatatcgagccaatcgtaactctgtaccactgggacctgcccctggccctgcaggagaagtatggtggttggaaaaatgataccattatagatatcttcaatgactatgctacctattgtttccagatgtttggtgaccgcgtgaagtactggataacaatccataacccatacctggtggcatggcacggctacggcacaggaatgcatgctccaggagaaaagggcaatctggctgcagtttatactgttggtcacaacctgattaaagcacatagtaaagtgtggcacaactataatactcactttcgcccccatcagaaggggtggttgagtatcaccctgggtagccactggatcgaaccaaatcggtctgagaacacgatggatattttcaaatgccagcagagcatggtgagcgtgcttggctggttcgctaaccctatccacggggacggggactacccggagggcatgcgaaagaagctctttagcgttttgcctattttcagcgaggccgaaaaacatgaaatgagaggtacggctgatttctttgcattttcattcggtcccaacaactttaaacccctgaatacaatggccaaaatggggcaaaatgtcagcctgaacctgcgcgaggccttgaattggataaagttggaatataataaccctagaatcctgattgcggaaaatggatggtttacagattcccgcgtcaagacggaggataccactgccatctatatgatgaagaacttcctgtcacaggtactccaggctataaggctcgacgaaatcagagtgttcggatacaccgcatggagccttctcgacggtttcgagtggcaggacgcatacaccattaggcggggcctgttttatgttgattttaacagcaagcaaaaagaacggaaaccgaaatcctctgctcattactataagcagataattagagagaacggctttagcctcaaagaaagtacgcccgacgtccagggccaattcccctgcgacttctcttggggcgttaccgaaagcgtactcaagcctgaaagcgtcgccagcagccctcagttttccgatccccatctgtacgtctggaacgctacgggaaaccgactccttcatcgagtggagggagtacggttgaagactagacccgcacaatgcacggacttcgtgaacataaagaaacagctggagatgttggctagaatgaaggtgacccattatcggtttgccctcgattgggccagtgtgctcccgaccggaaacctctctgcagtgaatcggcaggcacttcggtactaccgatgtgtggtgtccgagggtctgaaactgggcatctcagctatggtgaccctctactaccccacccatgcgcaccttggtctgcctgaacccctcctgcatgcagacgggtggctcaatcctagcactgccgaggctttccaggcttacgctggactctgtttccaggagctcggagaccttgtgaagctgtggataactattaatgaaccaaacagattgtctgatatctataatcgctccggaaacgatacttacggcgcggcccataatctgctggtggcacacgcgctcgcatggcgcctctacgatcgacaatttcggccttcccaaaggggggctgtctctctttcactgcacgccgactgggccgaaccagcaaacccatacgcagactcacactggagagccgccgagagattcttgcagttcgagatagcttggtttgcggaacctctgtttaagacgggggattacccagctgcaatgcgcgaatatatcgcctcaaagcacagaaggggactgtcctccagtgctctgcctagactgaccgaagcggaacgacgactgcttaaagggactgtcgatttctgcgcactgaaccattttacaaccaggttcgttatgcacgaacagttggcagggagtaggtacgattcagatagggatatacagttcctgcaggacatcactcggctgtcatccccaacaaggcttgccgttatcccatggggcgttaggaaattgctgcggtgggtccgaaggaactatggagacatggacatctacatcaccgcatctgggattgatgaccaggccctggaggatgatagacttagaaagtactatctggggaagtacctgcaggaggtcctgaaggcctatctgattgataaagtccggattaaagggtactacgcatttaagttggccgaggagaaaagtaagccccggtttggattttttacatctgattttaaagctaagagctccatccagttttacaataaggtgattagctcccggggctttccattcgaaaacagcagctccagatgctcacagacccaggagaatactgagtgcaccgtgtgtctgttcttggtgcagaaaaagcctctgatatttctcggctgttgtttcttcagtactctggtacttttgctgtctatcgccatttttcagcgccagaagcgccggaagttttggaaagccaaaaatcttcagcacattccactgaaaaagggtaagcgggtggtgtcc

SEQ ID NO: 250580 - DNA, 3132 bp, Artificial Sequence
  Description of Artificial Sequence: Synthetic coding sequence
atgaaacccggctgtgctgctggctctcctgggaacgagtggattttcttttccactgacgaaattacaacacggtataggaatacaatgtcgaatggtggactgcaaaggtccgttattctgtccgccctgatactgcttagggctgttacaggattttcgggggacggacgcgctatctggtcgaaaaatccaaactttacgccagttaatgagtcccagttatttctatacgacacattccctaagaactttttctggggtataggcactggggctctgcaggtggaaggatcttggaagaaagatggtaaggggccctcaatttgggaccacttcatccacacacaccttaagaatgtgtcgtccacaaatggctcctcggactcttacatatttctagagaaggacctttcggcccttgatttcattggcgtgtcattctatcagttcagtatctcatggccacggctctttcctgacgggatcgtgacagtggccaatgccaaagggctgcagtactattcaaccctcctggatgctctggtccttagaaacattgaacctatcgtcacactgtaccactgggatctgccattggccctacaggaaaagtatggcggctggaaaaacgatactattattgacatctttaatgactatgccacatattgctttcaaatgtttggtgatagagtgaagtactggataaccattcacaatccatatttggtggcctggcacggatatgggaccggaatgcacgctcctggggaaaaaggaaatctcgctgccgtatacactgtcggtcacaacctcattaaggcgcactctaaggtttggcacaactacaatactcatttccgcccgcatcagaaaggctggcttagcatcacactcggtagccactggattgagcccaatagaagtgagaacactatggacatctttaagtgtcagcagtctatggtttcagttctgggatggttcgcgaaccctatccacggcgatggcgactaccccgaaggtatgaggaagaaactgttttctgttttgccaatctttagtgaagcagagaaacatgagatgagggggacagccgacttcttcgccttcagctttggacccaataacttcaagccactgaacactatggccaagatgggtcagaatgtgagcttaaatctgcgggaagcccttaattggattaaactcgagtataacaatccccggatccttatagcagagaacgggtggttcactgatagtagggttaaaactgaagacacaacagctatctatatgatgaaaaattttctgagccaagtgttgcaggccattcggctcgacgaaattcgggtgtttggctataccgcatggtcgcttctggatggatttgaatggcaggacgcatacacaattagacgtggactgttctatgtggatttcaactcaaagcagaaggagcgcaagcctaaaagtagcgctcactattataagcaaatcatccgcgagaacggattctcattgaaagagagtacacctgacgtgcagggccagtttccatgcgacttttcctggggcgtgacagaatcggttctcaagcccgagtctgttgcctcatctccccagttctctgaccctcacctgtacgtatggaatgccactggcaatcgcctcttgcaccgtgtggagggagttaggctgaagactcgccccgctcagtgtacggacttcgtgaatatcaaaaaacagctcgagatgctggctcggatgaaggtgacgcactaccggtttgccttggactgggccagcgtcctgcccaccggaaatctgagcgcagtgaaccgtcaggctctgcgatattatcggtgtgtggtgagtgagggattgaaacttggcatctccgcgatggtgacactgtactaccctacacacgctcatctgggcttgcctgagccgctcctccatgccgacggatggctcaatccatctactgccgaggcatttcaggcctacgccggactgtgctttcaggagctgggagaccttgttaaactgtggattaccatcaatgaaccgaatcggctctctgatatctataacaggtctgggaatgacacctacggcgctgcgcacaatcttctagtggcgcatgctctggcttggcgtctgtatgaccgtcagttccgtcctagccagcggggcgctgtgtccctgtctctgcacgctgattgggcggagcccgctaacccctacgcagatagccactggagagccgccgaaaggttcctgcagtttgaaattgcgtggtttgccgagcctctcttcaaaacaggagactatcctgcagcaatgagggagtacattgccagcaaacacagaagagggctcagcagctcagcgctgcctcgactcacagaggccgagcggcggttgctgaagggtacagtcgatttttgtgcgctgaatcattttaccactaggttcgtgatgcacgagcagctggctgggagtcgctatgactccgacagggacatacagtttcttcaggacatcacccgattatctagtcccacccgtctggccgtgataccatggggcgttcgcaaactcctaagatgggtgcgacgaaattacggggatatggatatctacatcacggcttctggcattgatgaccaagccctggaggacgaccggctgaggaaatattatttgggcaagtacttgcaggaggtcctcaaagcatatcttattgataaagtcaggataaaggggtattatgcattcaagctggccgaggaaaaatctaaacctcggttcgggttcttcacaagtgatttcaaggcgaaatcctccatacagttttacaataaggttatctcttcccgcgggttcccctttgaaaacagttcttcccgctgttcacaaacacaggaaaatacggagtgtacagtctgtctgttcctggttcaaaagaagcctctaatatttctcggttgttgctttttctctacgctggtgttactccttagcatcgccatttttcagaggcaaaaaagaagaaagttctggaaggctaagaatcttcagcacatccccctgaaaaagggcaagcgcgtcgtctcc

SEQ ID NO: 250581 - DNA, 3132 bp, Artificial Sequence
  Description of Artificial Sequence: Synthetic coding sequence
atgaagcctgggtgcgccgctggttcacccggaaatgaatggatattcttcagcaccgatgaaatcaccactcgttatcggaatactatgtccaacgggggactccagcggagtgtgattctgtcggcactgatccttttgcgcgccgtcactggttttagcggagacggacgggccatctggtccaagaaccccaatttcaccccagtgaacgagtcacagctttttctgtacgatacttttccgaagaacttcttttggggaatcggaacgggagcactgcaggttgaagggtcctggaagaaagatggaaagggcccgagcatctgggatcactttatccacacccatctgaaaaacgtgtcatccaccaacggatcgtcagactcgtatatcttcctggagaaggacctctccgccttggacttcattggagtctcgttctaccagttcagcatcagttggccccggctgttcccggatgggatcgtcaccgtagctaatgccaagggcctgcaatactattcgaccttgctggatgcgcttgtgctgcggaacattgagccgatagtcaccctctaccactgggatctgccactggcccttcaggaaaagtacggaggatggaaaaacgataccatcatcgacatcttcaacgactatgctacgtactgcttccagatgttcggcgaccgggtgaaatactggataacgatccacaatccctacctggtggcatggcatggatacggcactggaatgcacgctccgggagagaaaggaaacctggccgctgtgtatactgtgggacacaatctgatcaaggctcactctaaagtctggcacaattacaatacccacttcaggccgcaccagaaggggtggttgtcgattaccctgggtagccactggatcgaacctaaccggagcgaaaataccatggacatctttaagtgtcagcagtcgatggtcagtgtcctgggatggttcgcaaatccgattcatggagatggcgactacccagaaggaatgaggaaaaagctgttcagcgtcctgccaatcttttcggaagccgaaaagcacgaaatgaggggaactgccgatttcttcgccttttcctttggacccaacaatttcaaacctcttaacactatggcgaaaatgggacaaaacgtgtccctgaatttgcgcgaagcgctgaactggatcaaactcgagtacaacaacccgcggattctcattgcggaaaacgggtggtttactgacagccgcgtaaagaccgaagatactacggctatctacatgatgaagaactttctgtcacaagttctgcaagccatcagactggacgaaatccgagtgttcggatacaccgcatggagcctgctcgacgggttcgaatggcaagacgcgtacactattaggcgcgggttgttctacgttgacttcaactccaagcagaaggagaggaagccaaaatcctcggcacattactacaaacagattatcagggaaaatggtttctcgttgaaagagtcgaccccggacgtgcaaggccagtttccctgcgacttctcctggggagtgaccgagtcggtgttgaagcctgagtcagtggcgagctccccgcaattctcagatccacatctgtacgtctggaatgcgactggtaacagactgctccatcgcgtggagggggtccgtctcaagactaggccggctcagtgtactgacttcgtgaacattaagaagcagctcgaaatgctggcgcgcatgaaagtgacccactaccgctttgccctcgattgggcatccgtgctgcctactggcaatcttagcgcggtgaaccggcaagcacttcgatactacagatgtgtcgtttccgagggcctgaagctgggaatctctgcgatggtcactctctactacccaacccatgcacatctgggcctcccggagcctctcctccacgccgatggttggctgaacccgtccaccgccgaggccttccaagcatacgcgggcctgtgcttccaggaactcggtgaccttgtgaagttgtggattacgatcaatgaaccgaaccggctgtcggatatctacaatcgctccggcaacgacacctacggggcggcccacaatctgctggtggcacacgctctggcctggcgtctctacgacagacaattccgcccttcacagcggggcgccgtgtcgctttcattgcatgccgattgggctgagcccgccaacccttacgccgacagtcattggcgggcggcagagcgcttcttgcagttcgaaatcgcctggtttgcggaacctctcttcaagactggtgattacccggctgccatgcgcgaatacatcgcctcaaagcatcggcgcggactgtcgtcgtcagctctgccacggctgaccgaagcagagagacgtttgctcaaaggcaccgtcgacttctgcgcactcaaccactttactactcggttcgtgatgcacgagcaattggccggaagccggtacgacagtgacagagacatacagtttctgcaggacatcaccagactctcctcgccaacccgcctggccgtgataccgtggggggtgcgcaagctgctgcggtgggtgagaagaaactacggcgatatggatatctacatcaccgccagcggaatcgatgatcaggcgctcgaggacgaccggctgagaaagtactacctgggcaagtaccttcaagaagtgttgaaggcgtacctgatcgacaaggtcagaatcaagggatattacgcctttaaactcgccgaggagaagtctaaaccaagatttggcttcttcacgtccgactttaaggcaaaatcgtcgatccaattctacaataaggtgatctcaagcagagggttcccgttcgaaaatagcagcagccgctgctcgcagacccaggaaaacactgagtgcactgtctgccttttcctcgtccagaagaagccactgattttcctcggatgttgcttcttctcgacgttggtcctcctgctgtcgatcgcgatcttccagcggcaaaaacgacgcaagttctggaaggcgaaaaacctccagcatatcccgttgaagaagggtaagagggtggtgtcg

SEQ ID NO: 250582 - DNA, 3132 bp, Artificial Sequence
  Description of Artificial Sequence: Synthetic coding sequence
atgaagccaggctgcgccgcagggagtcccggtaatgagtggatatttttctccactgacgaaatcacaacgcgttacagaaacactatgagcaatggcggtctccaacggtctgtcatcttgagtgccctgattctgctgagagcggtcaccggattttccggagacggaagagccatttggagtaagaaccctaattttacaccagttaatgaatcccaactcttcctgtatgatacatttcctaaaaatttcttctggggaataggcacgggagctctgcaggttgaaggctcgtggaaaaaggacggaaagggcccctcaatctgggatcacttcatccacacacatctgaagaatgtgtcatcaaccaacggatcttccgattcctatatatttctggagaaggacttgtccgctctcgattttattggtgtgtcattttaccagtttagtataagttggcccaggctgtttccggatgggatcgttaccgttgccaatgccaagggcctgcagtattactctaccttgcttgatgcattagttttgagaaacatcgagcctatcgtgactctttaccattgggacctaccccttgctttgcaggagaaatatgggggatggaagaatgatacaatcatcgacatcttcaatgactatgccacctattgttttcagatgtttggcgacagggtgaaatattggattaccatccacaatccctatctggtggcctggcatgggtacggcaccggtatgcatgcgcctggggaaaagggtaacctggccgcagtgtacacagtgggacacaacctgatcaaggcccactctaaggtgtggcacaactataacacccactttcgaccccaccagaaggggtggctttccataactttgggatcgcattggatcgagccaaatagatcggagaatacaatggacatatttaaatgtcaacagagcatggtgagcgtgctgggctggtttgcgaatcccattcatggggacggtgactaccccgaaggaatgcgcaagaaactgtttagcgtcttacccattttcagtgaggcagagaaacacgagatgcgcgggacagccgacttcttcgctttttctttcgggccgaacaatttcaagccgctgaacacaatggccaagatgggtcagaacgtttctctgaacctcagagaggctctcaactggattaaactggagtacaacaacccgcgcatcctgatcgccgagaacggatggtttacagactcaagagtaaaaaccgaggatacgacggcaatctacatgatgaagaactttttatctcaagtgttgcaggcaatacgtttggatgagatacgggttttcggctatactgcctggtccctgctggacggattcgagtggcaagatgcgtatacaatacgccggggccttttttatgtggattttaactctaaacaaaaggagaggaaacccaagtcctccgcccactattacaagcagattatcagggagaatgggtttagtcttaaagagagcacgcctgatgtacagggtcagtttccctgcgacttttcctggggcgtaaccgagtctgttctcaaaccggaaagtgtggcttcgagtccccaattctccgacccccacctttatgtgtggaatgccacagggaacagactcctccacagggtggaaggtgtacggctgaagacgcggcctgctcagtgtacagatttcgtgaacattaaaaaacagctcgagatgctggcccggatgaaagtcacccactacaggtttgccctggattgggctagcgtactaccgacagggaacctctccgccgtcaacagacaggcactccggtactatcgctgcgtagttagtgaaggccttaagttaggaatctctgcgatggtcactctctactatcctacccacgcgcatctgggtctgccggagcccttgttgcatgcagacgggtggcttaatcctagcacagctgaggcattccaagcatacgcgggtctgtgtttccaggaactgggcgatctagtgaaactgtggataactatcaacgagccaaatcggctcagtgacatctacaaccgatcgggcaatgatacctatggagccgcccacaacctgctcgttgcccatgccctggcctggcggctgtacgaccgtcagtttcgcccaagtcaacgcggagccgtatccttgagcttgcatgctgactgggcagaacctgctaacccctacgcagactcgcactggcgagctgcagaacgattccttcagttcgagatagcatggttcgctgagccactgttcaaaaccggtgattatccggcggcaatgcgggagtatattgctagtaaacaccgacgtgggttaagtagttccgcgctaccccggcttaccgaagctgaaaggaggcttctgaagggtaccgtcgatttctgcgccctaaatcacttcacgactagattcgtgatgcatgaacagctcgccggatctaggtacgatagcgacagggatatccagtttttacaggatatcactaggctgagctcacccacacgactcgccgttataccctggggcgtgcgcaaactattgcgatgggtgcgcagaaactacggcgatatggacatctatattaccgcgagtggcattgatgaccaggcactggaagatgacaggctgcgtaagtactatcttggaaaatacctccaggaggtattaaaagcttaccttattgataaagtgcgcataaaggggtattatgcgttcaagctggctgaggagaaatctaaaccacgattcggttttttcactagtgattttaaagcaaagtcgtctatccagttctataacaaggtgatttcttcacggggttttccctttgagaatagttctagccggtgttcgcaaacacaggagaataccgaatgcactgtttgcctttttttagtccaaaagaaaccgctcatttttctcggctgctgcttttttagcaccctggtgctgcttctgtcgatcgccatcttccagcggcaaaaaaggagaaagttctggaaagctaagaaccttcagcatattccgctgaagaagggtaaaagggtggttagc

SEQ ID NO: 250583 - DNA, 3132 bp, Artificial Sequence
  Description of Artificial Sequence: Synthetic coding sequence
atgaagcccgggtgtgcagcagggtcccctggaaatgaatggatctttttcagtactgacgagattaccacccggtaccggaacaccatgtcgaatggaggcttgcaaaggtcggtgatcctttcggcactgattctccttagagcagtgaccggttttagtggagacggacgagccatctggtcaaagaatcccaatttcacccctgtgaacgaaagccaactttttctttacgatacgtttccgaagaacttcttttggggcatcggtaccggagcactgcaggtcgaaggaagctggaagaaggatggaaaggggccatcgatttgggatcatttcattcatacgcacctgaaaaatgtgtcctctaccaacggatccagcgactcctacatttttcttgaaaaggatcttagcgcactggatttcatcggagtctcattttaccagtttagcatttcctggccccgtctctttccagatgggatcgtgaccgtggctaacgccaagggactccagtactactcaacccttctcgatgcacttgtgctccgcaacattgagcctatcgttactttgtaccactgggacctccctttggctctccaagagaagtacggaggctggaagaacgataccataattgacatcttcaacgactacgcaacctactgctttcaaatgtttggggatagagtcaaatactggatcactatacacaatccttacctggtggcatggcatggttacgggaccggtatgcatgcacccggtgagaaaggaaacttggcagcggtgtacactgtgggacataacctgattaaggcacattcaaaagtgtggcacaactacaatactcacttcagacctcatcaaaaaggttggctcagcattacccttggctcccactggatcgagccaaatcgcagcgagaacaccatggacatctttaagtgccaacaatccatggtgagcgttcttgggtggtttgccaaccccattcatggggacggagattatcctgaaggtatgcggaagaaattgtttagcgtgctcccgatctttagcgaggcagaaaagcatgaaatgagaggaactgctgatttctttgcattctcctttggtccaaacaactttaaacctctgaataccatggctaagatgggtcagaatgtgtcgctgaacctgcgcgaagcactcaactggattaaactggagtataacaatccacgtatccttattgcagaaaatgggtggtttactgactcgcgggtgaaaacggaggacaccactgcaatatacatgatgaagaattttctctcccaggttcttcaagctatccgtctcgatgagatcagagtgttcggatacactgcgtggtcccttttggatgggttcgaatggcaggatgcatatacgattaggaggggactgttctatgtggatttcaattccaagcaaaaggagaggaagcctaagtcctcagcacactattacaagcaaatcatcagggaaaacgggttcagcctgaaggaatcaacccccgatgtgcaggggcagttcccctgtgatttttcctggggggtgactgagtccgtccttaagcctgaaagcgtagcctcgtcccctcagttttcggatccacatttgtacgtctggaacgcaaccgggaacaggctgcttcacagagtggagggtgtccggctgaaaacccggcctgcacagtgtactgacttcgtcaacataaagaagcaactggagatgctggcccgaatgaaggtcactcactaccggtttgctctggattgggcgtccgtgctgcctaccggcaacctttccgcagttaaccgccaagctctgcgatactaccgctgcgtggtttccgaagggctgaagctcggtatttcggccatggtgactctgtactacccgactcatgcgcatctcggactgccggaacctctgctgcatgcagatggatggctcaacccatctaccgccgaggcattccaggcatacgctggcctctgctttcaggagcttggggatctggtcaagctgtggattactattaacgaaccaaatagactctcggacatatacaaccgaagcgggaacgacacttacggtgcagcgcacaatcttctggtggcccatgcacttgcctggcggctgtacgatcgccaattcagaccatcccaacgcggagcagtctccctttcactgcatgccgattgggcggaacctgcaaatccttatgcggactcacactggcgtgcagcggagcgctttcttcaatttgagatcgcctggttcgcagagccactgttcaagaccggagactaccctgctgctatgagagagtacattgcctccaaacatcgtcgcggtttgtcatctagtgcattgcctagacttacggaggccgaacggaggcttctgaagggaactgtggatttttgtgcgcttaaccactttaccacccgttttgtcatgcacgaacagcttgccggctcccggtacgattctgaccgcgacatccaattcctgcaggatattactagactgtcctcacccactagactggcagtgatcccatggggcgtgaggaaacttctgcggtgggtgcgccgcaattacggggacatggacatatacattactgcatccggaatcgacgatcaggcgttggaagatgatagacttaggaagtactatcttggtaagtatcttcaggaagtcctcaaggcttaccttattgataaggtgcggattaagggatactacgcctttaaacttgcagaagagaagtccaagcctagattcggattcttcacgtcagatttcaaagcaaaatccagcatacaattctacaacaaggtgattagctcacgtggctttccttttgagaactcctcttcgcgatgttctcagacgcaagaaaacactgaatgtactgtctgtctctttctggtccagaagaagcctctgatttttctgggctgttgtttcttctcgactctcgtgttgcttctttccattgcaattttccaacggcagaagcgcagaaagttttggaaggcaaagaacttgcagcatatcccgttgaagaaaggtaaaagagtcgtgagc

SEQ ID NO: 250584 - DNA, 3132 bp, Artificial Sequence
  Description of Artificial Sequence: Synthetic coding sequence
atgaagcccggatgtgctgccggaagcccgggaaacgaatggatcttcttttccaccgatgagatcacgacgcggtaccggaatactatgtcaaacggcggactgcagcgcagcgtgatcctttcagccctgatcctgctccgggcagtaactggtttctcgggtgacggaagagccatctggtccaaaaacccgaacttcactccagtcaacgaatcacaactgttcctctacgatacctttcccaaaaacttcttctgggggatcggaacgggcgcgctgcaggtcgaaggctcctggaagaaggatgggaagggaccatcaatctgggaccatttcatccacactcatctgaagaacgtgtcctctaccaacgggtcctcggacagctacattttcctggaaaaagatctgtcagcactggatttcatcggcgtctccttctaccagttctccatctcctggccacggctgttccctgacggaatcgtgactgtggccaatgccaagggccttcaatactactccaccctcctggacgccctcgtgctgcggaacatcgaacccatcgtaaccctgtaccactgggacctcccgctggcccttcaggaaaagtatggaggatggaaaaatgatactatcatcgatatcttcaacgattacgccacctattgctttcaaatgtttggtgaccgcgtcaaatactggatcaccatccacaacccttacctggttgcatggcacggatacgggactggcatgcacgctcctggtgagaagggtaatctggccgctgtgtacaccgtcggacataatctgatcaaggcacactcaaaggtctggcataactacaacacccatttcaggccacaccagaaaggctggctcagcatcacgctgggatcacactggattgaaccgaaccggtccgagaataccatggatatcttcaagtgccagcagagcatggtcagcgtgctgggatggttcgctaatccgatccacggcgatggagactacccggagggcatgcggaagaaactgttctccgtcctccctatcttttccgaagcagagaagcatgaaatgcgcgggactgccgatttcttcgccttctcgtttggaccgaacaactttaagcctctgaacactatggcgaagatgggtcaaaatgtctcactgaatctcagagaggcgctgaattggatcaagctcgaatacaataacccgcggatcctcatcgctgaaaatggatggtttactgattcccgggtgaaaaccgaggacactaccgccatctacatgatgaaaaacttcttgtcccaagtgctgcaggccatccgcctggatgaaatccgcgtgttcggttacacggcttggtcactgctcgatggatttgagtggcaggacgcctacaccattcggagaggattgttttacgtcgatttcaattccaaacaaaaggaaaggaagccaaagtcctcagcgcattactacaagcagattatccgagagaatggcttttccctcaaggagagcaccccggatgtgcagggccagtttccgtgcgacttttcgtggggggtcactgaatccgtgctgaaacccgaatccgtggcgagctctcctcaattctccgacccgcacctgtacgtctggaacgctacggggaatcggttgctccaccgggtggaaggagtgcgcctgaaaactcgccctgcccagtgcacggacttcgtgaacatcaaaaagcaactcgaaatgctggctagaatgaaggtgactcactaccggttcgccctcgactgggcctcagtgctgccgactgggaatctctccgctgtgaaccgccaggcgcttcggtactaccggtgcgtcgtgtcagaaggactcaagctgggaatctcagcgatggtgactctctactaccccactcatgcccatctcggcctgccggaacctctgctgcatgcggatggatggctgaacccttcgaccgccgaggcgttccaagcgtacgcgggtctgtgcttccaggagctgggcgacctcgtcaaactgtggattactatcaacgagcccaaccggttgagcgatatctacaatcgcagcggcaacgacacctacggggccgctcataacctgctggtggcgcacgccctcgcctggcgcctgtacgaccgccaattcagaccatcccagcgcggagcggtgtcactgtccctgcacgcagactgggccgaacccgccaatccgtacgccgactcgcattggcgggcggctgaacggtttctgcagttcgaaatcgcctggttcgctgaaccacttttcaaaaccggtgactacccggcggcaatgcgcgaatacatcgcctcgaagcaccggcgcggcctgagctccagcgccctgccgcgactcactgaagcggagcggcgcctccttaaaggaaccgtggatttctgcgccctcaaccactttactacccgcttcgtgatgcatgaacagcttgcgggctcgagatacgattcggatagggacatccaatttctccaagacattacccggttgagctcgcctacgagactcgccgtgatcccatggggagtgcgcaagctccttcgctgggtccgccggaattacggggacatggatatctacattaccgcatccggaatcgacgaccaggcactggaggacgaccggctgaggaagtactatctggggaagtacctgcaggaagttctgaaagcatacctgatcgataaagtccgcatcaagggatattacgccttcaagctggcggaggagaaatcaaagccgcgcttcggattcttcacgtctgactttaaggccaagtcgtcgatccagttctacaacaaagtcatcagcagccggggctttccgttcgagaattcctcatcgcgatgtagccagacccaagaaaacaccgaatgcaccgtctgtctgttcctcgtgcagaagaagccactgattttcctcggatgctgcttcttctctaccctggtgttgttgctgtcgattgccatattccagagacagaaacgccgaaagttctggaaagccaaaaatctgcaacacatcccactgaagaagggtaaacgggtcgtctcg

SEQ ID NO: 250585 - DNA, 3132 bp, Artificial Sequence
  Description of Artificial Sequence: Synthetic coding sequence
atgaaaccagggtgtgctgcgggtagccctggcaatgaatggattttcttctcgacagacgagataacgacgcggtaccggaacaccatgtctaacggcggactacagagatccgtgattctgtccgctttgatcctactccgtgccgtgaccggattctcgggcgacggtagggccatttggtctaagaatccaaatttcactcccgtgaacgaaagccagctcttcctgtacgacacgtttcctaagaattttttctgggggataggaacaggcgcactccaggtggagggttcctggaagaaggacgggaagggccctagcatatgggaccacttcatacacacccacctgaaaaatgtgtcatccacaaacggtagctcagactcttacatattccttgaaaaggatttgtccgcccttgatttcattggggtgagtttttatcaattctccatatcatggccgaggctctttccagatgggattgtaaccgttgccaacgccaagggtctgcagtactacagtacattgctcgacgccctggttctacggaacatagaaccgatcgtgacactgtatcactgggatctccccctggctctccaggaaaagtatgggggctggaaaaatgacaccatcattgacatctttaatgactacgctacctactgctttcagatgttcggggatcgagtcaagtattggataactattcacaacccttacctcgtggcgtggcatgggtacgggacaggcatgcacgcccccggcgagaagggcaatctcgccgccgtatatactgtaggtcacaacttgattaaagcgcactccaaggtgtggcataactataacacccactttaggccacatcagaagggttggctgagtattactctggggtctcactggatcgagcccaatcggagtgagaataccatggatattttcaaatgtcagcagtctatggtatctgtgctcgggtggtttgcaaaccccatccacggggatggagactacccggaggggatgcgcaagaagcttttctcggttctccccatctttagtgaagctgagaagcatgaaatgcgtggtacagctgatttcttcgcctttagctttggccccaataattttaaaccgctgaacacaatggccaagatgggccaaaatgttagccttaatctgagagaggccctcaattggatcaagctagaatacaacaaccctagaattcttatcgcggagaatggctggtttacggactcacgcgttaagaccgaggatacaacagccatctacatgatgaagaacttcctcagccaggtgctccaagcaattcgccttgacgaaattcgggttttcggatatacagcatggtctttgcttgacgggttcgagtggcaggatgcgtatactatccggagaggtctcttctacgtggatttcaattccaagcagaaggaacggaagcctaagtcatccgcacattattacaagcagattattcgggagaacggcttctcactgaaggagtccacccctgatgtgcagggtcagttcccatgcgacttcagctggggcgtaacagaaagcgtgctcaagcctgagtctgtggcatctagcccacagttcagcgaccctcacttgtatgtgtggaatgcgaccgggaaccgccttctgcacagagtggaaggtgtccggcttaaaactcgtcctgcgcagtgcactgatttcgtcaacattaagaaacaactggagatgctggcccgaatgaaggtaacccattatcgcttcgctcttgattgggcttccgtgctacctacgggcaaccttagcgctgtcaaccgacaggctcttcgctactaccggtgtgtggtgtccgagggcctgaaactggggatttccgcaatggtgaccctgtattatccaacacacgcccacctgggacttccagagccactgctgcatgccgacggatggctcaatccaagtaccgccgaggctttccaggcctacgcaggtttatgtttccaggaactgggcgatttagtgaaactctggataacgattaatgagcccaaccgcctttccgatatctacaaccggagtggtaatgacacgtatggtgcagcccataatctgctcgtcgctcacgcgctggcatggcggctatacgatcgacagtttcggccctcgcagcgaggggccgtgtcgctcagtctgcatgccgattgggccgaaccggctaatccgtatgccgactcccactggcgagcagcggagcgattcctgcagtttgaaattgcatggtttgccgagcccctctttaagaccggcgactatcctgctgcgatgagagagtacattgcaagcaagcacagacggggcctgtcttcctctgctctaccgaggctgacggaagcggagcggagactgctgaaaggcactgtagatttttgcgccttaaaccacttcacaacacgctttgtgatgcatgagcagcttgcggggtcgcggtacgacagcgacagggacattcagttcctgcaggatatcactcgcctgagcagtcctacccgcctcgccgtgatcccctggggcgttcgcaagctcctgagatgggttcgcaggaattacggcgatatggatatatacatcacggcctccggcatagacgatcaggccctggaggatgaccgcttgcggaaatactacttgggtaagtatctacaggaggtcctgaaggcctatcttattgacaaagtgcggattaagggatattatgccttcaaactagctgaagagaaatccaagcctcgcttcggattctttaccagcgattttaaagcgaagagcagtatccagttctacaataaagtgattagtagtagaggatttccatttgagaatagttctagcagatgctctcaaacgcaagagaacactgagtgcacagtttgcctatttctggtgcagaaaaaaccactcatcttcctgggctgttgcttttttagcaccctcgtgctgctgctcagcatcgctatcttccagcgacaaaagagacggaagttctggaaggctaaaaacctgcagcatatcccccttaagaagggcaaaagagtggtttca

SEQ ID NO: 250586 - DNA, 3132 bp, Artificial Sequence; identical to SEQ ID NO: 250585
  Description of Artificial Sequence: Synthetic coding sequence

SEQ ID NO: 250587 - DNA, 3132 bp, Artificial Sequence
  Description of Artificial Sequence: Synthetic coding sequence
atgaagcctggatgcgcagcaggatcccctggtaatgagtggatctttttcagcaccgatgaaattacgactcggtaccgcaataccatgtctaatggtggcttgcagcgatcggtgattctcagcgcattgattttgctccgcgcagtgactggattcagcggagacggaagagcgatttggtccaagaacccaaactttactccagtgaacgagtctcaactcttcctttacgataccttccctaagaacttcttctggggcattggcactggagcccttcaagtcgaaggatcctggaagaaggacggcaagggcccatccatttgggatcactttatacatacccacttgaaaaatgtgtcgagcactaatggaagcagcgatagctatatctttctggaaaaagatctttccgcactggatttcattggcgtctcattttaccaattttcgattagctggcctagactgttccccgatgggattgtcaccgtcgcaaacgcaaagggacttcaatactactcgaccctgcttgatgctctcgtgctgaggaacatcgaaccgatcgtcaccctttatcattgggatctgcctttggcccttcaggaaaagtacgggggctggaagaatgacacgatcatcgacattttcaatgactacgcgacttactgtttccagatgttcggagatcgcgtgaagtactggatcactattcacaacccgtacctcgtggcgtggcacgggtacggtactgggatgcatgccccaggcgaaaaaggtaacctggcagcagtatacactgttggccacaacctgattaaggcacattccaaggtgtggcataactataacactcactttagaccccatcagaagggatggctttcgatcaccctcggctcacattggattgaacctaaccggtcggagaacaccatggatatcttcaaatgtcaacaaagcatggtgtcggtgcttgggtggtttgcgaatcctatacacggtgatggagattaccctgagggcatgcgaaaaaagctgttttccgtccttcctatattctcggaagcagaaaagcatgagatgcgcgggactgcggacttttttgcgttttcctttggacccaacaacttcaagcccctgaacaccatggccaagatgggccaaaatgtgagcctgaatcttcgtgaagccctcaactggattaaacttgaatacaacaatcctcggatcctcatagcagaaaacggatggtttaccgattcaagggtcaagaccgaagatacgactgcaatatacatgatgaaaaacttcctctcccaggttctgcaggcaatccgccttgatgaaattagagtgtttggttacactgcgtggtcccttctggatggatttgaatggcaggatgcatacaccatcagacggggtcttttctacgtggactttaactctaagcaaaaggaaaggaagccaaagtccagcgcacactactacaaacaaatcatacgtgagaatggatttagcttgaaggaatctacccctgacgtgcaagggcaatttccctgcgatttttcgtggggggtgaccgaaagcgtgctgaaaccagaatccgtggcctcgtcccctcaattctcagacccacatctgtacgtgtggaatgcaacgggaaaccgccttctgcaccgggtggaaggggtgcggcttaagacccgacccgcacagtgtaccgatttcgtgaacatcaaaaaacaacttgaaatgcttgcccgaatgaaggtgacccattacaggttcgcactcgattgggcatccgttcttcctactggtaacctttccgctgtgaatagacaagccctgaggtactaccgctgcgtggtgagcgagggtctgaaacttggtataagcgcaatggtgaccctttactacccgacccacgctcatcttggcctccccgaaccactcctgcacgcagacggatggctgaatccatcaaccgcagaagcctttcaagcatacgccggactttgctttcaggaactcggcgatctggtgaagctgtggatcacgattaatgaacccaataggctgtcggatatctataaccgctccgggaacgatacctacggagccgcccataaccttcttgtggcgcacgcattggcctggaggctttacgatagacaattcaggccatcgcagagaggagcagtcagcctgtcattgcatgcggactgggcggaaccggcaaatccgtacgcggattcgcactggagagcagccgagaggttcctgcaatttgaaattgcctggtttgcagaaccactgtttaagacgggagactacccggcggccatgcgcgaatacattgcaagtaaacatcggagagggctttcctcctctgcactccccagacttaccgaagccgaaagacggctcctgaagggaaccgtggacttctgcgcgctcaaccattttaccacccgcttcgtgatgcacgagcaacttgcaggttcgaggtacgattcggatagggatattcaatttctgcaggatattactcggctttccagccctaccagactcgcagttatcccatggggagtgcgcaaacttctccggtgggtccggagaaattacggagatatggatatctacattacggccagcggtatcgatgaccaagcccttgaagatgataggctccggaagtactacctcggtaagtaccttcaggaagtgttgaaagcctaccttattgataaggtgcgcattaaagggtattacgcctttaaacttgccgaagagaaatcgaagccccggtttggatttttcacttctgactttaaggctaagtcctccatccaattctacaacaaggtgatttcgtccagaggttttccctttgagaattccagctcacgctgttcgcaaacgcaggaaaacaccgaatgtaccgtgtgcctgtttctcgtgcagaaaaaacctcttatctttctgggatgttgttttttctcgactctggtgctcctgctttcaatcgcaatcttccaacggcagaagagaagaaagttttggaaagcaaagaacctgcagcatattccacttaagaagggaaagcgagtggtgagc

SEQ ID NO: 250588 - DNA, 3132 bp, Artificial Sequence
  Description of Artificial Sequence: Synthetic coding sequence
atgaaacccgggtgtgctgccggatctcctgggaacgagtggatatttttttcaactgatgaaataacaactcggtatcgaaatacaatgtcgaatggaggactacaacgcagtgtgatcctgtcagcactcatcctccttcgggctgttactgggttttctggagatgggcgggctatctggtctaaaaacccaaattttacaccagtgaacgaatctcagctattcctctacgatacttttcctaaaaactttttctgggggattgggacaggggccttgcaggttgaagggtcttggaaaaaagatgggaaaggaccctcaatctgggatcatttcatacatacacacttaaaaaacgtcagttccactaatgggtccagtgattcttatattttcctcgaaaaagatctcagtgccctcgatttcatcggggtttccttttatcagttctctatatcttggccacgcctctttccagatgggatagtgactgtcgctaatgcaaaaggacttcagtactattccacactgctggatgcactcgtgctgcggaacattgaaccaatagtcactttataccactgggatctgccactggccctccaggaaaaatatgggggatggaaaaatgatacaataattgatattttcaacgattacgctacatactgcttccagatgtttggagatcgggtgaaatactggatcactattcataacccatatcttgtcgcctggcatgggtacgggacagggatgcatgcacccggggagaagggaaatctggcagctgtatatacagtggggcataatctaatcaaagcacattctaaagtctggcataattacaacacgcactttcgtcctcaccagaagggatggctaagtatcacattaggatcacattggattgaaccaaacagatctgaaaacacaatggatatattcaaatgccaacagtcaatggttagtgtactcggatggtttgctaatcctatacacggggatggagattatcccgaggggatgcgaaaaaaattattttcggtactccccatcttttctgaagctgagaaacacgagatgcggggaactgctgatttttttgcattctcctttgggcctaacaattttaaacctttaaacacaatggcaaaaatgggacaaaacgtgtctctcaatttaagggaagctcttaactggataaaactagagtataataaccctagaatactgatcgcggaaaacggatggttcacagattcccgcgtgaaaactgaagatactactgcgatttatatgatgaagaatttcctctctcaagtccttcaggctatacggttggatgagatacgagtctttgggtatactgcatggtccctcctcgatgggtttgaatggcaggacgcatatacaatcagacgcggactcttttacgtagatttcaattccaaacagaaggaaagaaaacccaaaagttccgcacactattacaaacagatcatacgggaaaatggattttctcttaaggagtctactcctgatgtacagggacagtttccctgcgatttttcttggggggtgacagaatcagtgctgaaaccagaatctgtggcgtcatcacctcagttttccgatccccacctgtatgtctggaatgccacagggaatcggctgctccaccgggtggaaggagtgagactaaaaactcggccagcacagtgcacagatttcgtcaacatcaagaaacagttggaaatgctggcaagaatgaaagtgacacactaccggtttgccctggactgggcatctgttctgccaacagggaacctgtctgccgttaataggcaggcactgagatattacaggtgcgtggtctctgagggactaaaactggggatatctgccatggtaacactctattatcccacacacgctcacctcggactgcctgaacccctccttcacgcagatgggtggctgaacccatcgactgctgaagcattccaggcctatgctgggctctgctttcaggaattaggggatctggtcaaactctggatcacaataaatgagcccaatagactaagtgatatatataaccggtcggggaatgatacttatggggctgcacacaaccttcttgtggcccacgcccttgcttggagactgtatgatcgccagtttagaccaagtcagaggggagctgtctcattatctcttcatgctgattgggccgagccggccaatccatacgcagatagtcactggagggctgccgagcgcttcttgcagttcgaaatagcatggtttgccgaacccctcttcaagacaggagattatcctgctgcaatgcgggaatatatcgcttctaaacatcggaggggactctctagttctgcactgccacgcctgactgaggcagaaagacgcctcctgaaagggacagtagatttctgcgcattgaaccacttcactacacgcttcgttatgcatgaacagctggccggaagtcggtacgattctgatagggatatccagtttctccaggatatcacacggctgtcctccccaactcgcctggccgtgatcccatggggagttagaaaactcctcaggtgggttcgcagaaactacggggatatggatatttatataacagccagtgggattgatgatcaggccctggaagatgatcggcttcgcaaatattatctcgggaaatatttgcaggaagtactcaaagcttacctcatcgataaagtcaggatcaaaggatattatgcgtttaaattagctgaagaaaaatccaaacctaggttcgggtttttcacttcagattttaaagctaaatcctccatacagttctacaacaaagtgatcagttctaggggattccctttcgagaattcctcttctaggtgtagtcagacacaagaaaacacagaatgcacagtgtgtctcttccttgtgcagaaaaaaccactgatctttcttggatgctgttttttttctactctcgttttactcctgtctatagcaatatttcagcgccagaaacgacggaaattctggaaagccaaaaaccttcaacatatacctctcaaaaaagggaagagggtggtgtca

SEQ ID NO: 250589 - DNA, 3132 bp, Artificial Sequence
  Description of Artificial Sequence: Synthetic coding sequence
atgaaaccaggatgcgccgctggcagccccgggaacgagtggattttcttcagcactgacgagataaccacccgctaccgtaacaccatgagtaatggagggttacagaggtccgtgatcttgtcggcacttatactactgagggctgtcacgggattttctggagatgggcgcgctatatggtccaagaacccaaatttcacgccagtgaatgagtctcagctttttctatacgatacatttccaaagaacttcttttggggtattgggaccggtgccctccaggtcgaagggtcttggaagaaggatggcaaggggccttctatatgggatcacttcattcacacacacctgaagaacgtatcttccactaatggttcctccgatagctacatctttctcgaaaaagatctttctgctctggacttcataggtgtgtctttttatcaattctccattagctggccaagactgtttcccgatggaattgtgactgtcgccaacgcaaaaggattgcagtactattctaccttgctcgacgcactggtcttgaggaatattgaacccatcgtaactctgtatcattgggatctgccactggccctgcaggaaaagtacgggggctggaaaaatgataccataatagacatctttaacgactacgctacctactgttttcagatgttcggtgacagggtgaagtattggattactatccataacccatacctcgttgcctggcacggctacgggactggcatgcacgcccccggggaaaagggaaacctcgcagcggtgtatacagttggacacaacctgatcaaggcgcactctaaggtgtggcacaattacaacacacactttcggccacatcagaaaggctggctgagcatcacattgggtagccattggatagaaccaaataggtcggaaaacactatggacatttttaaatgtcaacagagtatggtgtctgtcctgggttggtttgcgaaccccatccacggtgatggcgactacccggaagggatgcggaaaaaattattcagcgtcctgccgattttcagcgaggccgagaaacatgagatgcggggcactgccgattttttcgcattctccttcggccctaataatttcaagccactgaacaccatggcgaaaatgggacagaatgtgagcttgaatctcagagaggcactcaattggatcaaattggagtataacaatcccagaatcctcattgccgaaaacggatggtttaccgattctagggtgaagactgaggacaccaccgccatctacatgatgaagaatttcttgtcccaagtgctgcaggccattcgcctagacgagatcagggtcttcggctacaccgcttggtctctacttgatggcttcgagtggcaggatgcctacaccattcgccgtggcctgttctatgtggacttcaactcgaaacaaaaggaaaggaaacccaagtcgagcgcgcattattataagcaaattattcgggagaatgggtttagcctgaaggagagtactccggatgtgcagggacaattcccgtgtgatttttcctggggtgtgactgagtctgtgctgaagcccgagtccgtggcctctagcccacagttctctgacccacacctttacgtgtggaacgcgactggtaacaggctgttacatcgcgtcgagggcgtgcgactgaagactcgcccagcacagtgcactgattttgttaatataaaaaaacagctcgaaatgttggccaggatgaaagtgacacactacagatttgccttggactgggccagcgtgttgccaaccgggaatctcagcgccgttaacaggcaggccctgcggtattataggtgcgtggtatctgagggattgaaactgggcatctccgctatggtgactctctactatcccactcacgcgcacctaggcctcccagagcccttgctccacgccgatgggtggctgaacccaagcacggccgaagccttccaggcttacgcaggattgtgtttccaagagctgggggatctcgtcaagctgtggatcaccataaacgagcccaaccgactgagtgacatctacaaccgctccgggaacgacacttacggcgctgcccacaacctccttgttgctcacgcccttgcctggagactgtatgacagacaattccgcccctcacagcgaggagcagtcagcctctcattacacgccgactgggccgagcccgccaatccctatgccgatagtcactggcgcgcggccgagcgattcctccaatttgaaatcgcttggttcgcagaaccgctcttcaaaaccggagactaccctgccgccatgcgggagtatatcgcctcaaagcacaggcgcggattgtcctcatccgctttgcctagattaacagaggctgagaggaggctcttgaagggaacagtggatttttgcgctctgaatcactttacaacccggtttgtgatgcacgagcaactggcggggagcaggtatgattcagatcgggatatccagtttctgcaggacattacaagactcagttccccaacacgcctcgccgttattccttggggggtgcgcaagctgttgaggtgggttagaaggaactacggagacatggatatatatattactgcgtccggcattgacgatcaggcccttgaagatgacaggctgaggaagtattatttgggcaagtacctccaggaagtgctgaaggcctacttgatcgacaaagttaggatcaagggctattacgctttcaagctggcggaggaaaaatcaaagccgcgtttcgggttctttacttcggatttcaaggcgaagagcagcatacagttctacaacaaggtgatcagctcgagagggttcccctttgaaaactccagcagtagatgctctcagacacaagagaacacggagtgcaccgtgtgcctcttcctggtccagaaaaaacctcttattttcttaggatgttgcttcttcagcacactggtgctactactgagcatagcgatcttccaaagacaaaagaggaggaaattctggaaagcaaagaatctgcagcacatcccccttaagaaaggtaagcgagttgtatct

SEQ ID NO: 250590 - DNA, 3132 bp, Artificial Sequence
  Description of Artificial Sequence: Synthetic coding sequence
atgaaacccggctgtgcggccggctcccctggaaatgaatggatattttttagcacagatgagatcaccacccggtaccgcaatactatgtccaacggaggcctgcaacgtagtgtgatcctgtccgcccttatattgctgcgtgcagtcacaggattcagcggcgatgggcgggccatctggagcaaaaatcctaattttacaccagtcaacgagagtcagctttttctgtacgatactttccccaagaattttttttggggaatagggacaggggctcttcaagtggaaggcagctggaagaaagacgggaaaggtccttcaatctgggaccactttatccacacacaccttaaaaatgtgtcctctacaaacggttcctcagacagctatatctttctcgaaaaagatctgagtgcgctcgatttcatcggagtgagcttctaccagtttagcatctcatggcctagactgttccctgatgggatcgtgaccgtggccaacgccaaaggccttcagtactactctacactattggatgccctggtgttgcggaatatcgagcccatcgtcacactctaccactgggatttacctctggccctccaagagaagtacggtggttggaagaacgatactatcatcgacatcttcaacgactacgcaacctattgctttcagatgtttggggaccgcgtgaagtactggataactatccataacccatacctagtcgcatggcacgggtacggaaccggcatgcacgctcctggtgagaaaggaaatttggcagccgtgtacaccgtgggacacaacctgatcaaagcgcacagcaaagtttggcataactacaacacacactttcgccctcatcagaaaggatggttgagcataacactgggttctcactggatagagccgaatcgcagcgagaataccatggatatctttaaatgtcagcagtccatggtcagtgtgctggggtggtttgcaaaccccatccatggtgacggagactaccctgagggcatgcgcaaaaagttattttcagtactgcctattttttctgaggccgaaaaacacgagatgcgaggcaccgcagattttttcgcattctccttcggccccaacaactttaagcccctgaacaccatggcgaaaatgggtcagaacgtcagcctcaacttgcgggaggcgttgaactggattaagctggaatataataatccccgcattctgattgcagagaacgggtggtttaccgactctcgtgttaaaacagaggatacaaccgccatttatatgatgaaaaactttcttagtcaggtgttacaggctataagattggacgaaattcgcgtctttgggtacaccgcatggtcattactcgacggttttgaatggcaagacgcttataccattagacgcggattattctacgttgactttaactctaaacagaaggagaggaagcctaaatcttctgcgcactattataagcaaatcatcagggagaatggattttccttgaaagaatccactccagacgtgcaagggcagttcccttgcgacttcagttggggggtgacggagtcggtgctgaagcctgaatcagtggcatcatctccccagttttcagatcctcatctgtacgtctggaacgcaactgggaacagattgctgcatcgggtggaaggggttagactcaaaactcggcccgcccagtgtactgattttgtgaacattaagaaacaattagaaatgctcgcccgcatgaaggtgacacactatcgatttgccctggattgggcctcagtcctgcccactggaaaccttagcgctgtgaacaggcaggccctgaggtattacaggtgtgtagtgagcgagggcctcaaactagggatttcagccatggtgactctctattatcctacgcacgcccaccttggcctacccgagcctctactgcatgccgacggctggctgaatcctagtaccgctgaggctttccaggcctatgctgggttatgcttccaagagctgggggacctggtcaagctgtggataaccatcaatgaacccaacagactgtctgatatctacaaccggtccgggaacgatacctatggagcggcccacaacctcttggtcgcccatgctttggcatggcggctatatgacagacagttccgacctagccagagaggggccgtgagcctctcactgcacgccgattgggccgagccagcgaacccctatgcagactcccactggagggcagcagagcggttcttgcagtttgaaattgcatggtttgcagagccactgtttaagaccggggactatcccgctgccatgagggagtatatcgcttccaagcatcgacgcggcctgtcctccagtgctttgcccagactaactgaagctgaacggcgtcttctgaagggcaccgtggatttttgcgctctgaaccactttacaacaaggttcgtaatgcacgaacagctggcaggctctcgatatgattccgaccgggacattcaattcctgcaggatatcacaagactttcatcaccaactcgcctcgcagtgatcccgtggggagtcagaaagctattgagatgggtgcgtcgaaattacggcgacatggatatctacatcacagctagcgggattgatgaccaggcactggaagacgataggctgcgaaagtactacctggggaaatacctgcaggaggtccttaaggcctacctgatcgacaaagtgagaatcaagggctattatgcattcaagctggctgaggagaaatctaagccacggtttgggttctttacgtctgacttcaaagctaagtcctcaattcaattttacaacaaagtcatctcaagccgcggtttccccttcgaaaacagctcctccagatgttcccagacccaagaaaacaccgagtgtacagtttgtttgttcctggttcagaagaagcccctaattttcttaggatgctgtttcttttccactctcgtgctactgctgtcaatagctattttccagcgtcagaagagacgcaagttttggaaagccaaaaacctccagcacatacccctaaagaaagggaagagggtagtgtct

SEQ ID NO: 250591 - DNA, 3132 bp, Artificial Sequence
  Description of Artificial Sequence: Synthetic coding sequence
atgaagccgggttgcgctgcaggatcccctggtaacgagtggatcttctttagcaccgatgagataaccaccaggtataggaatacaatgagtaacggtgggttgcagaggagtgtcatcctgagcgctctgattctcctgagagcagtgacaggcttttccggcgatgggagggccatatggagcaaaaacccaaatttcactccggtgaatgaatctcaactttttctttacgatacttttcctaagaacttcttctggggaattggcacgggagctttacaggtagagggcagttggaagaaggacggaaaaggaccttcaatatgggatcattttatccacactcatctgaagaacgtgagcagcactaacggatcatccgattcctatatttttctagaaaaggacctgagcgcgctcgacttcataggcgtgagtttctatcaattcagcatatcatggccccgactttttcctgacggaattgtgactgtggccaatgcaaagggtctacaatactacagcacactgctggatgcgttagtgctacgaaatatagagcccatcgtcacactgtaccattgggatctgcctctggccctgcaggaaaagtatggcggctggaagaacgatacaatcatcgatatattcaacgattacgccacctactgcttccagatgttcggagacagggtgaagtactggatcacaattcacaacccatacctcgtggcctggcatggctatgggacgggtatgcacgcccccggggagaagggcaacctagcagctgtgtacactgtgggccacaacctgatcaaagcccattcgaaggtgtggcataattataatacacatttcagaccgcatcagaagggctggttatccattacactgggaagccattggattgaacctaacagatccgaaaacacaatggacattttcaagtgccagcaatccatggttagtgtgctaggatggtttgctaatcctattcacggcgacggagattatccagaaggcatgcggaaaaaactcttttcagttctacctattttcagcgaggctgaaaagcatgagatgcgaggaacagccgacttctttgcgttctcctttgggcccaataactttaaacccctgaataccatggcgaagatgggccagaacgtctctctgaacctacgggaggctctgaactggatcaagcttgaatataataaccctagaatacttattgcagaaaacggatggtttacagacagtagggtgaagacggaagataccacggcaatctatatgatgaagaactttctctctcaagtgctgcaggcaattcggctggacgagattagggtgttcggttatacagcgtggtccctgctcgacggttttgagtggcaagatgcctatactattcgcaggggactcttctacgtagacttcaacagtaagcaaaaggagcggaaacccaaaagttccgctcactattataagcagatcattcgcgagaacggcttctcactcaaggagtccacccccgacgttcaggggcagtttccatgcgatttttcctggggcgtgacagagtcggtgctcaagcccgaatccgtcgccagctctcctcagttttccgacccacatttatacgtatggaatgccactggcaataggctcttgcacagagtggaaggcgtgcgactgaagacacgaccggcgcagtgtaccgacttcgtcaacataaagaaacagcttgagatgcttgcgcggatgaaggtaacccattataggtttgcccttgactgggcatccgtcctgccaacgggcaacctgtcggccgtgaatcgacaggcactgaggtactatcgatgtgtggtctcggaaggccttaaactcggcatttccgcaatggtgactctttactaccccacacacgcccaccttggtctgccagagcccctcctccatgctgacggctggctcaacccatctacagcagaggcctttcaggcctatgccggtctatgcttccaggagctcggcgatctggtgaagttatggatcacaattaatgaacccaacaggctgtcggacatttacaatagatccggaaacgatacttacggagccgcccataatctattagtagcccacgctctcgcatggcgcctttacgataggcaattcagaccctcccagcggggtgcggtttctctgagtctccacgctgactgggcggagccggccaacccgtacgccgatagtcattggagagctgctgaacggttcctgcagttcgagatcgcgtggttcgcggaacctctgttcaagaccggcgattatcctgccgcaatgagggaatacatcgcttctaagcaccgtcggggcttatcttcttctgccttgcctaggcttaccgaagcagagcgtcggctgctcaagggcactgtggacttctgcgcattaaatcacttcaccactagatttgtaatgcacgagcagttagccgggtcccggtacgactctgaccgggatattcagtttttgcaggacatcactcgcctctccagtcccactagattagctgtaattccttggggtgtccggaaattgctgaggtgggtgaggcgtaattacggtgacatggacatttacatcaccgcgtctgggatagatgaccaggctctggaggacgaccggctacgcaagtattacctgggcaaatatctgcaggaggtgctcaaagcgtacttaattgacaaagtgcggatcaaaggctattacgcttttaaacttgcagaagagaaaagtaagccacgttttggttttttcaccagcgattttaaggcgaagtcctctatacaattctataataaggtgatttcttcgcgtggatttccctttgaaaattcctcaagcagatgctcacaaactcaggagaacaccgagtgcacagtatgcctgtttctagtgcagaagaaacccctaatctttctaggctgttgctttttctccaccctcgtgctcctgctgtcaatagccatctttcaacgacagaagcgcaggaaattctggaaagcaaagaacctgcagcacattcctctgaaaaaggggaagcgcgtagttagc

SEQ ID NO: 250592 - DNA, 3132 bp, Artificial Sequence
  Description of Artificial Sequence: Synthetic coding sequence
atgaagcctggatgcgctgcgggtagtcccgggaatgagtggatcttcttcagcaccgacgaaattaccaccagataccggaatacaatgagcaacggtgggctgcagcggagcgtgatcctgagtgcgcttatcctgctgcgcgccgttacaggcttctcaggagatggaagggctatttggtcaaagaaccctaattttaccccagtaaacgagagtcagctgttcctctatgataccttccctaagaactttttttggggaattggaaccggagctctgcaggtcgagggatcatggaaaaaagatgggaagggtccaagcatttgggatcattttattcacacccaccttaaaaatgtgagctctactaacggctcttcagacagctatatctttctggagaaggacctcagtgctctcgattttatcggggtgagcttctaccagttcagcatcagctggccacgcctcttcccagatggaatagtgacagtggccaatgcaaaaggactccagtactattctacccttctcgatgctctggtgctgcgtaatattgagccaattgtcaccttgtaccattgggatctgcccctggcacttcaggaaaaatatggggggtggaaaaacgatacaatcatcgacatctttaatgactacgctacttattgcttccagatgttcggcgacagggtaaaatattggatcaccattcataacccttacttggtagcatggcatgggtatggaaccggtatgcacgctccaggagaaaaaggcaatctcgcagctgtgtacactgtgggccacaacctgataaaggctcattcaaaagtgtggcataattataatacgcatttccggccacaccagaaaggttggttgagcatcacgctgggatcacactggatagaaccaaaccgtagcgaaaataccatggacattttcaaatgtcaacagagtatggtgtcggtgctaggttggtttgctaatcctatacatggagacggggactatccagagggcatgcgcaagaaacttttctccgtcttgccaattttctcagaggctgagaagcatgagatgaggggcactgctgacttttttgctttttccttcggcccaaataatttcaaaccccttaacaccatggctaagatgggccaaaacgtgtctctcaatctcagggaagctctgaactggatcaaactggaatataacaacccacgaattctcatcgcagaaaacggctggtttactgattcccgcgtaaagaccgaggatacaaccgcaatatatatgatgaaaaactttttgagccaagtcctgcaggctattagactcgacgaaatccgtgtttttgggtacacagcgtggagcctccttgacggctttgaatggcaagatgcatataccatccggcgaggtcttttctacgtcgatttcaacagtaaacaaaaagaacgtaaaccaaagtcgagcgcccattactacaagcaaatcatacgtgagaatggatttagtttgaaagagtcgactcctgacgtgcaaggtcaattcccatgcgattttagttggggcgtgactgaatccgtgctcaagcctgagtccgtggctagtagcccgcaattttcagatccccacctttacgtctggaatgctaccggaaacaggctgctgcacagagtggaaggagtgcgcctcaagacaagaccagctcaatgcactgactttgtgaacattaagaaacagctggaaatgttagctcgaatgaaggttacacattataggtttgctctggactgggcctcggtgctgcccacgggaaacctgtccgctgtgaacaggcaggcgctgaggtattataggtgcgtggtcagcgagggcctcaagctcggaatctccgccatggtcaccctgtattatccaactcatgcgcacctgggactcccggagcccttgcttcacgccgatgggtggctcaaccctagcaccgctgaggcctttcaggcctatgccggactgtgtttccaggaactcggcgacctcgtgaagttgtggattacaatcaatgagccaaatcgcttaagtgacatatacaacaggtctggaaacgatacttacggcgccgcgcacaatcttctcgtcgctcacgctctcgcatggcgcttatacgaccgccaatttaggcctagccagcggggcgccgttagcttgagtctgcatgcggactgggccgagccagctaatccttacgccgatagccactggagggctgctgaaagattccttcaatttgagatagcctggtttgccgagcctctgtttaagaccggcgattatcctgcagccatgagggaatacatagcaagtaaacacaggagaggcctgtcaagttctgcccttccaagactgaccgaagccgagaggaggttgcttaaggggaccgtggatttctgtgcgctcaaccactttaccactaggtttgttatgcacgaacagctggctggctctcgctatgacagcgatcgggatatccagttccttcaagatatcacaagactctccagccctacccgtcttgctgtgatcccttggggagtcagaaaacttctgagatgggtgaggagaaactatggagatatggacatctacataaccgcatcgggaattgatgatcaagccctggaggatgaccggctgcgcaaatactaccttggcaagtatttgcaggaagtacttaaagcttaccttatcgacaaggtgaggataaagggctactacgcatttaaactcgcagaagaaaaaagcaagccaagatttggcttttttacctccgactttaaggctaaaagcagcatccagttttataataaggtgatcagcagcagaggcttcccttttgaaaactcctccagcagatgttcccagacacaagagaacactgaatgcaccgtttgcttgtttttggttcagaaaaaacccctcatctttcttgggtgttgttttttttctaccctggttttgttgttaagcattgctatttttcaaagacagaagcgcaggaaattttggaaggctaagaacctgcaacacataccgctgaagaaaggtaagagagtagtgagt

SEQ ID NO: 250593 - DNA, 3132 bp, Artificial Sequence
  Description of Artificial Sequence: Synthetic coding sequence
atgaagccaggttgcgccgccggctcacctggcaacgagtggatcttctttagcacggatgagatcacaacgagataccgcaacacaatgtccaatggcggtcttcagcgcagcgtaatactctccgcacttatcctgttaagagccgtgaccggcttctcaggcgacgggcgcgcaatctggtctaagaatcctaacttcacccccgtcaatgagagccagctcttcctgtatgataccttcccgaagaatttcttttgggggatcggtacgggtgctcttcaggtggaaggtagttggaaaaaggacggcaaaggcccttccatttgggatcattttattcacactcacctgaagaatgtgtccagcaccaacgggagctctgatagctatatctttctggagaaagatctttcagcgctcgactttatcggcgtgagcttttatcaattctctattagctggccgcgcctgttcccggatggcattgtcacggtggcgaacgctaaaggcttgcaatactatagcaccctgctggatgccctggtgctccgcaatatcgagcctatcgtgaccctgtaccactgggacctgcccttagctctgcaagagaagtatggaggctggaagaacgatacgataattgatatatttaatgattatgctacctactgcttccagatgttcggggatagggtgaagtattggattaccatccacaatccatacctggtcgcgtggcacggatatggtacgggcatgcatgcacctggcgagaaaggaaacttggctgccgtgtacaccgtgggccacaacttgatcaaggctcactccaaggtttggcacaattataacactcactttcgccctcatcaaaagggatggctcagtataaccctgggttctcattggatcgagccaaatcgcagcgagaacacgatggacatctttaaatgccaacagagcatggtatccgttctcgggtggtttgctaatcctattcacggcgatggagattacccggaaggtatgagaaagaaattgttctccgtgttgccaatttttagcgaagccgaaaagcatgagatgcggggaaccgcagacttctttgctttcagctttgggccgaataacttcaagccgctgaacaccatggcgaagatggggcagaatgtgtccctgaaccttagggaggcgctgaactggattaaactggagtataacaatcctcgcatcctgatcgcagaaaatggctggttcaccgactcccgcgtgaaaaccgaggataccacggcgatctacatgatgaaaaattttttgagccaagtgctgcaggccatccgactggacgagataagggtttttggatataccgcatggtctctgcttgatggttttgaatggcaggacgcgtatacgatccgccgtggcttgttttacgtcgactttaatagcaaacaaaaggaacggaaaccgaagtccagtgcacattactacaaacaaattattcgagagaatggcttttctttgaaagagagcacaccggacgtacaaggccagtttccttgtgacttcagctggggagtaacggagtccgttctcaagccggagagcgttgcgtctagcccgcagttttcggatccacacttgtatgtctggaatgcaactggtaaccgcctgctgcatcgcgtggagggcgtacgcttgaagaccaggcctgcgcagtgcaccgactttgtcaatattaagaaacagctggaaatgctggcgaggatgaaagtgacgcactatcggtttgccctggactgggctagcgtgctaccgaccggtaatctctccgcggtcaaccgccaggccttgcggtactacagatgcgtggtgagcgagggcctgaaactcggtatcagcgctatggtgaccctgtattacccaacccatgcccacctgggtctgccagagccactgctccatgctgacggttggctgaatccgtcaacagccgaagcgttccaagcatacgcaggtctatgcttccaagaactgggcgacttggtcaaactgtggatcactatcaatgagcctaacagactgagcgacatttataatcggtccggcaatgacacgtacggtgccgctcacaatctcctggtggcgcacgcgctggcctggcgcctgtacgaccgtcagtttcgcccttcccaacgcggtgcggtctctcttagcctacatgcggattgggctgaaccagcaaacccatacgcggactcccactggcgggccgcggagcgctttcttcaattcgaaattgcgtggtttgcggaaccgctgtttaagacgggtgattacccggccgcaatgcgcgaatatattgcttccaagcatagacgtggtctgtcctcatccgcgctccctcgcttgacggaagccgagcgccggctcctgaagggtactgtggacttctgcgcactgaatcatttcaccacgcgcttcgtgatgcatgagcagttggcaggctcccgttacgacagtgatagggatatacagttcttgcaagacatcaccaggctgagctcaccgacccgcctggcagttattccttggggtgtgcgcaaactgctgcgctgggtcaggaggaattacggggatatggacatttatatcacggctagcgggattgacgatcaagccctggaggatgacagacttcgcaagtattacctgggcaaatatttgcaagaagtgttgaaggcgtacttgattgataaggtccggatcaagggctattatgcttttaaactggcggaagaaaagtctaagcctagatttgggttcttcacgagcgacttcaaagcgaagtccagcatccagttttataataaagtcatcagcagccgcggttttccgttcgagaatagctcatcgaggtgttctcagacccaggaaaacaccgagtgtaccgtgtgcctgttcctagtccagaagaagcctctgatcttcctcggttgctgttttttctccaccttagttctgctgctgtccatagcaatcttccaacggcagaagcgccgcaagttctggaaggcgaagaatctccagcatatcccgctcaagaaggggaagcgcgttgtaagc

SEQ ID NO: 250594 - DNA, 3132 bp, Artificial Sequence
  Description of Artificial Sequence: Synthetic coding sequence
atgaagccgggttgcgcagcaggttcaccagggaacgaatggattttcttcagcactgatgagatcaccacccgctaccgcaacactatgtcaaacggcggactgcaacgctcagtgatcctgtctgctctgatcctgctgcgggcggtgaccggcttctcgggagacggtagagccatctggtccaaaaacccgaactttacccctgtgaacgaaagccagctcttcctgtatgatacttttcctaagaacttcttctggggtattggtaccggggccctgcaagtcgaaggatcttggaagaaggatggaaagggaccctcgatctgggaccactttatccacactcatctgaaaaatgtgtcgtcgaccaacgggtccagcgactcctacatcttcctggaaaaggacctctcggcgctggatttcatcggagtttcgttctaccagttttccattagctggcctcggctgtttccggatggcatcgtgacggtggccaatgcgaaggggctccaatactactcaaccctgctggacgccctggtgctgcgaaacatcgaaccgatcgtcactctctaccactgggacttgccactggccctgcaagagaaatacggaggatggaagaatgacaccatcatcgacatctttaatgactacgcgacctattgcttccagatgtttggcgacagagtcaagtactggatcaccatccataacccgtacctggtcgcttggcatgggtacggcactgggatgcacgcaccgggagaaaaaggaaatctggcagcggtgtataccgtggggcacaacctcatcaaggcgcattccaaggtgtggcacaactacaatacgcatttccgcccgcaccagaaaggatggctttcgatcactctcggaagccactggatcgagccaaacaggtcggagaataccatggacatcttcaaatgccaacagtccatggtttccgtgctgggatggttcgccaacccaattcatggagatggagattatccggagggaatgagaaagaaactcttttcagtcctcccaatcttctccgaggcggagaagcatgagatgcgggggactgcagacttcttcgctttctcttttgggccaaacaatttcaagccactcaacactatggcaaaaatgggacagaatgtgtcccttaacctgcgggaggcactcaactggatcaaactggaatacaacaaccctagaatcctcatcgcggagaatggttggttcacggactcgagagtcaagactgaggacactaccgctatctatatgatgaagaacttcttgtcgcaagtgcttcaggccatcagactggatgagatcagggtctttggatacaccgcttggtcgctcctggacggattcgagtggcaggacgcatacactatccgccgcggacttttctacgtggactttaatagtaagcagaaggaacggaaaccgaaatcgtccgcacactactacaaacagatcattagagagaatgggttttccctcaaggaaagcaccccagacgttcagggacagtttccatgcgacttttcgtggggcgtgactgagtccgttctgaagcccgagtcagtggcgtcatccccacaattctcggacccgcacctgtacgtgtggaacgccaccggcaatcgcctgcttcatcgggtggaaggagtgagactgaagacccgcccggcacaatgtaccgactttgtcaatatcaagaagcaactggaaatgctggcgcgcatgaaagtcactcattaccggttcgcactcgactgggcctcagtgctcccgactggcaacctctccgctgtgaacagacaagccctgcgctactacagatgtgtcgtatcggagggtttgaagctgggtattagcgcaatggttaccctgtactacccaacccacgcccatctgggcctcccagaaccactgctccatgctgatggatggcttaacccatccactgcggaggccttccaggcctacgccggactgtgcttccaggagctgggagatctggtcaagctgtggatcactattaacgaaccgaaccggctgagcgacatctacaaccggtccggaaatgacacctacggggcggcacacaacctgctggtggcgcacgccctcgcctggagactgtacgacaggcaattccgcccgagccagagaggagctgtgagcctctccttgcatgcggactgggcagaaccggctaatccatacgctgacagccactggcgggccgcggaacgcttcctgcagttcgaaattgcctggttcgccgaaccgctcttcaaaacgggcgattaccctgctgctatgcgcgaatacattgcctccaagcatcggcgcggactgtccagctcagcgctgccgcggctgaccgaagccgagaggagactgctgaaagggaccgtggatttctgcgcgcttaaccacttcaccactcggttcgtgatgcatgaacagttggcggggagcaggtacgatagcgatcgggacatccagttccttcaggatatcactaggttgagcagcccgaccaggctggcggtcatcccatggggggtgcgcaagctgctgcggtgggtgagacggaattacggagatatggatatctacatcaccgccagcggcatcgacgaccaagcgttggaggatgatagactccgcaagtattacctggggaagtacttgcaggaagtgttgaaggcctacttgatcgacaaggtccggattaaaggatattacgccttcaaactcgccgaagaaaaatcaaagccaagatttggtttcttcacctccgatttcaaggcgaagagcagcatccaattctacaacaaggtcatctcgagcagagggttccctttcgagaactcaagctccagatgctcccaaactcaggagaacaccgaatgcaccgtttgcctgttcctcgtccagaagaagcccctgatttttctgggttgttgcttcttctcgactttggtcctgctgctctcaatcgccatctttcaacgccaaaagcgccgcaagttctggaaggcgaagaaccttcagcacatccctctgaagaagggcaaaagagtcgtctcc

SEQ ID NO: 250595 - DNA, 3132 bp, Artificial Sequence
  Description of Artificial Sequence: Synthetic coding sequence
atgaaacctggttgtgcagccggttcacccggaaatgaatggatattcttctccacagacgagattacgacaaggtacagaaacacaatgagcaacggcggcttgcagcggtccgtcatcctgtcagccctgatcctcctgagggccgtcaccggattctccggagatggaagggccatctggtcaaagaatcccaactttacccccgtgaacgaatcacaacttttcctgtacgacactttccctaagaatttcttctggggaattggtactggagcgctgcaggttgagggttcatggaagaaggatggcaaggggccgtctatctgggaccattttattcatacacacctgaaaaacgtcagctccacaaatggctcttccgatagctacatctttttggagaaagatctctcagcacttgatttcataggagtgagtttttatcagttcagtatctcttggcccagacttttccctgacggaattgtcacagtcgcaaacgcaaaagggttgcagtactactccaccctactagacgctctcgttttacgcaacatcgaaccaattgtcacgctgtaccactgggatctccctctggcccttcaggaaaagtatggcggttggaagaatgacactatcatagatattttcaatgattacgctacctactgttttcagatgtttggcgaccgggtgaagtactggatcacgattcacaatccatatctcgtggcttggcacggctatggtacaggcatgcatgcaccaggcgaaaaaggcaatctggccgctgtgtacactgtgggacataatctaatcaaggctcattcaaaagtttggcataattacaacacccacttcaggccccaccagaaggggtggctttccattacactcggctcccactggatcgagccgaataggtccgagaatacaatggacatctttaagtgccaacagtcaatggtgtcagttctaggatggttcgccaacccaatccacggggatggcgattacccggagggcatgcgcaagaagttgttctcagtgctccctattttcagcgaggctgagaaacatgaaatgagaggcactgctgacttcttcgccttcagtttcggacctaacaacttcaagcccctaaataccatggccaagatggggcaaaacgtctctctgaatctcagggaagcacttaactggatcaaacttgagtacaataacccccggatcctcattgccgagaatggttggttcactgacagtcgcgtgaagacggaagataccactgccatttacatgatgaagaacttcctgtcccaggtcctccaagcgattcgcctcgacgaaattagggtgtttggttataccgcatggtctcttctggatggcttcgagtggcaggacgcatacaccattcggagggggttattctacgtggattttaactccaagcagaaggagaggaaacccaagtcatccgctcactactataaacagataattagagaaaatggtttctcccttaaagagtccactcctgacgttcagggccagtttccttgtgattttagctggggagtgacagaaagtgtgctgaagcccgaatctgttgcaagctcccctcagttcagtgaccctcacctgtatgtgtggaacgccactggcaaccgacttctccaccgcgtggaaggggtccggctgaagacccgacccgcgcagtgcacagactttgtgaatataaaaaagcagctggagatgctggccagaatgaaggtgactcattaccggttcgcactggattgggcaagcgtgctgcctaccggcaacctgtctgcagtcaatcgacaggctcttaggtattaccggtgtgttgtgagtgaagggctgaagctcggcataagtgccatggtgacactctattacccaacacatgcacatctgggcctgccagagccccttctccacgcagacggatggctgaaccccagcaccgccgaggcatttcaggcctacgcaggcctctgcttccaggagctgggggaccttgtaaagctttggatcactattaatgagccaaaccggctgtctgacatctacaacaggtccgggaacgacacgtacggagcagcccacaacttgctggtggcgcacgccctcgcttggcggctgtacgaccgccagtttaggccttcacagcgtggcgctgtcagtctcagcctacacgccgattgggctgagcccgctaatccatacgccgattctcactggcgggcggcggagagatttcttcagtttgagatagcatggtttgcagaaccgttattcaagactggagattaccctgccgcaatgcgtgaatacattgctagcaagcacaggcgcggcttatcatccagtgctctgcctcgcttaacagaggccgagagaagactgctgaagggcaccgtggacttctgcgcacttaaccactttacgacgcgatttgtgatgcacgagcagttggcggggtctaggtacgattctgacagagatatccaatttctccaagacatcacacggctctcaagcccaaccaggctcgccgtaatcccttggggggtgagaaagctgttgcgatgggtaaggcgcaattacggtgacatggatatatatatcacagcaagtgggatcgatgatcaggccctcgaggatgatcggctgcggaaatattatcttggcaagtacctccaggaggtccttaaagcatacctgattgacaaggtcaggattaaggggtactatgcctttaagcttgctgaggaaaaatctaagcccagattcggctttttcactagcgattttaaagccaaaagctctatccaattctacaataaggtaatcagctcccgaggttttccgtttgaaaactcaagcagccgttgctcccaaacacaggagaacacagaatgcactgtgtgtcttttcctcgtgcagaaaaagcctcttatcttcctgggctgctgctttttctcgacactggtgctgctgttatccatcgccatttttcagagacaaaaacgtcgaaaattctggaaagctaagaacctccagcacatccccttaaaaaaggggaagcgggtggtgtcg

SEQ ID NO: 250596 - DNA, 3132 bp, Artificial Sequence
  Description of Artificial Sequence: Synthetic coding sequence
atgaaacctggatgcgccgcaggatctcctggaaatgagtggatcttcttctcaactgatgagataactacaagatataggaacactatgtcaaatggcgggctgcagaggagtgtgattctttccgcacttattctgctaagagccgtgactggcttttccggcgacgggcgggcaatctggagcaaaaacccaaattttactccagtaaacgaatcgcagttgttcttgtacgatacatttccaaagaatttcttctgggggatcggcaccggagcacttcaggtcgaaggttcctggaaaaaggatggtaaaggccctagcatatgggatcacttcatccatacccacctgaagaacgtttcatccaccaatggtagctcagacagttacatatttctcgagaaagacctctccgcgttggacttcattggcgtgtcgttctatcagttttcgatctcttggccacgactgttccctgatggcatcgtcactgtggccaacgcgaagggacttcagtattactccacactgctcgacgcactcgtgctgcgcaacattgagcctatagtgaccctttaccactgggacctgcccctagcactgcaggagaagtatggcgggtggaagaacgacacaatcatagatatctttaacgactatgctacatattgcttccagatgttcggggatagagtgaagtattggataaccatccacaacccgtatttggtggcgtggcacggctatggcactggtatgcatgcacctggggaaaagggtaacctagccgcggtatataccgttggtcataatctcattaaggcccacagcaaggtttggcataattataatacccatttcagaccccaccagaagggatggctcagcatcaccctgggctcccattggatcgagccaaatcgctccgaaaacaccatggacattttcaagtgtcaacagtccatggtgtccgtcttaggctggttcgcaaatcccatccacggcgatggggactaccctgaagggatgcggaagaaactgttttcggtgctgcccatattctccgaggccgagaagcacgagatgcgtggaaccgcggatttcttcgctttctcattcggccctaacaacttcaagcctctgaatacaatggctaagatggggcaaaatgtgagcctgaacctgagggaagcactcaattggatcaagctggaatataataatccgcgtatcctaattgcggagaacggatggtttaccgactcccgggtaaaaacagaagatactaccgctatctatatgatgaaaaatttcctgtctcaggtgctacaggccattaggttggacgagattcgcgtttttgggtacactgcctggagtctccttgacggcttcgagtggcaggacgcatataccattcgtcgcggcctgttttacgttgacttcaattctaagcagaaggaaagaaagcctaaatcttcagcccattattacaaacaaataatcagagagaacggcttcagcctgaaagaaagtactcctgacgtccagggccagtttccatgtgatttttcttggggtgtgaccgaatcagtgctcaagccagagagcgttgcaagttcaccacaattttctgacccacatctctacgtgtggaacgcaacaggaaatcggctattacaccgagtcgaaggggtacggttgaagacccgtccagcgcaatgcacagactttgttaacatcaagaagcagctcgagatgctcgccagaatgaaggtgacccactatcgcttcgcgttggattgggccagtgttctgcccacaggtaatttgtctgcagtgaaccgtcaggctctcagatactatcgctgcgtggtctccgagggactcaagttgggcatctccgctatggtgaccctttattacccaacccacgcccatctcggcttgcctgaaccgctgctgcacgccgacggttggctcaatccatcaacagccgaagctttccaagcctatgctggactgtgctttcaagaactcggggatctggtgaagctctggatcaccattaatgaaccgaatcgcctcagcgatatctataatcggtcggggaacgatacatacggtgccgcgcacaacctgctggtagcccatgccttggcatggcgcttatatgaccgccagttccgccccagccagcggggagcagtgtctctgagcctgcacgctgactgggcagaacccgccaacccatatgcggattcccattggagggcagctgagcgcttcctccagtttgagattgcgtggttcgccgaaccactgtttaagactggggactacccggccgccatgcgtgaatatatcgcctctaagcaccgccggggcctgtcatctagcgctctccccagactgacagaggcagaacggcgcctgttgaaaggtactgtggatttctgcgctttgaaccacttcaccacgcgtttcgtgatgcatgagcaactggccggcagcagatatgactctgacagagatatacagttcctgcaggacataactaggttgtcctcgcctacgcgcctggcggtgatcccgtggggtgtgagaaaattgctgcgatgggtgagacggaattatggcgatatggatatttacattacagctagcggaatcgatgatcaggccttagaggacgaccgcctgcgcaagtattatttagggaaatacctgcaggaggtactgaaagcctatctcatagataaggtgcggataaaggggtactatgcctttaagcttgcagaagaaaaaagtaaacccaggtttggattctttacgtctgacttcaaggccaagtccagcatccaattttacaacaaggtcatcagcagccgcgggttcccctttgaaaactcatcttcacgctgctcgcagacccaggaaaatacagaatgtacggtgtgtttattcctcgtccagaagaaaccactaatatttctggggtgctgcttctttagcaccctcgtgctgctgctgtccattgccatattccagcgccagaagcggcgaaaattctggaaggctaagaacctgcagcatatccccctaaaaaagggaaaaagggtggtctcg

SEQ ID NO: 250597 - DNA, 3132 bp, Artificial Sequence
  Description of Artificial Sequence: Synthetic coding sequence
atgaagcccgggtgtgccgcagggtctccaggcaatgaatggatatttttctctaccgacgaaattacgacacgctatagaaacactatgtctaacggcggccttcaacgaagcgtgattctgtctgctctcattctgctcagagccgttacgggattctctggcgacgggcgtgccatctggtctaaaaaccccaactttactccagtgaacgagtcacagctgtttctgtacgacaccttccccaaaaactttttttgggggatcgggactggcgctctgcaggttgagggctcatggaagaaagatggaaagggtccgagcatatgggaccatttcattcatactcacctgaaaaatgtgtcaagcacaaatggttcctccgactcttacattttcttggagaaggacctatctgctcttgacttcattggagtatccttttatcaattctccatttcttggccaagactattccctgacggaattgtgaccgtggccaacgccaaaggactacagtactactcgacattgcttgacgcattagtgcttaggaatatcgagcctatagtaaccttgtatcactgggatttgccactggccctgcaggagaagtacgggggatggaagaacgacaccatcattgacattttcaatgattacgccacatactgtttccagatgtttggcgatcgcgttaagtactggataaccatccataacccctacctggtagcctggcatgggtatggaaccggaatgcatgccccaggtgagaaaggtaatctggccgccgtgtacaccgtcgggcataatctcattaaagctcacagtaaagtgtggcacaattacaatacccacttccgcccccaccagaaaggatggctatccatcaccctcgggagtcattggatcgagccaaatagatccgaaaataccatggatatttttaagtgtcagcagagtatggtgtcagtgctgggatggttcgctaatcccattcacggcgacggcgactaccctgaagggatgagaaaaaaacttttttcagttctccccatcttctcggaagctgaaaaacacgaaatgcggggcactgccgattttttcgcctttagctttgggccaaataacttcaagcccctaaatactatggctaaaatgggacaaaacgtgagcctcaaccttcgcgaagccttgaattggatcaaactggaatacaataatccgcgaattttgatcgccgagaatgggtggttcacagattcccgagtcaagacggaggataccaccgccatctatatgatgaaaaacttcctgagtcaggtactgcaggcgattagactagacgagatacgggtgttcggatacaccgcctggtctctactagatggttttgagtggcaggacgcttacaccatacggcgtggactgttttatgttgacttcaactccaaacagaaggaaaggaaacccaagtcttccgcacattattataagcagatcatccgagaaaatggattcagcctgaaggagtccactcctgacgtgcaaggtcagtttccctgcgatttcagctggggggtgacagaaagcgtccttaaacctgagtctgtggcctccagtccccagttctctgatccccacctgtacgtctggaacgctactgggaaccggctgctccatcgggtcgagggcgtgaggctgaagacccggcccgcccagtgtactgattttgtgaatatcaagaaacaactcgagatgctcgcaagaatgaaggtaacacattatagatttgccctggactgggcatctgtgctgcctaccggcaacttaagcgcggtgaatcgtcaggcattgagatattaccgttgtgtcgttagcgaggggctgaaacttggaatttctgcaatggtgacactctactatccaacccatgcccacctggggctgcctgagcccttactccacgctgatggctggttgaatcctagtactgcagaggcatttcaggcctacgccgggctgtgtttccaagaattgggcgatttggtcaagctgtggattaccatcaacgagcccaatagactctctgatatttacaaccgcagtggtaatgacacctatggtgccgcccataatctgctcgtagcgcacgccctcgcatggaggctctatgatcgccagtttcggccaagccaacgaggtgcggtctctctatcattgcacgccgactgggccgaaccggccaatccctacgcggactcccactggagggcagctgaacgcttcctgcagtttgagatagcttggtttgcagagcccctgttcaagaccggtgattacccagctgcgatgagggaatatattgcatccaagcacaggagggggctgtcttcatctgccctaccgaggcttactgaggccgagcggaggcttttgaagggaaccgtcgacttttgtgctttgaatcactttaccacccgattcgtcatgcacgaacagctcgcaggtagtcggtatgatagcgatagagatatccagttcctgcaggacataactcgcttgagctcccctacgcggttggccgtgatcccttggggtgtgcgcaaattgcttaggtgggtccgtcggaactatggagacatggacatctacattactgcttcaggaattgatgaccaagcactggaggacgatcgccttcgaaaatattaccttggcaagtatctccaagaggtgctgaaggcctaccttatcgacaaagtgagaatcaaaggctactatgcctttaaactggcagaggaaaagtcgaagcctcgattcggcttttttacttcagacttcaaggctaaaagctcgatccagttttataataaggtgatctcttcacggggatttccttttgaaaactccagcagccgctgttcccagactcaggagaatacagagtgcactgtctgcctcttcctggttcagaagaagcctcttatttttcttggctgttgctttttttctactctcgtcctactactgagcatcgctatcttccagaggcagaaaagacgcaagttttggaaggctaagaatttacagcacatccctctgaagaagggaaaacgagtggtgtca

SEQ ID NO: 250598 - DNA, 3132 bp, Artificial Sequence
  Description of Artificial Sequence: Synthetic coding sequence
atgaagcctggatgcgccgctggctctcctgggaacgaatggatttttttcagcacagacgagatcaccacgcgctacaggaacactatgtcaaacggtgggctgcagaggagcgtgatcctttccgcgctcatcctgctgcgtgccgtaaccggattttccggcgacggccgcgccatatggagcaaaaacccaaatttcaccccggtaaacgagtcacagcttttcctgtacgacaccttcccaaagaactttttttggggtataggcaccggcgccctacaggtcgagggatcatggaagaaagatggcaaaggccccagtatttgggaccatttcattcatacccatctcaaaaatgtgtcctcaacgaacggttcgagcgactcttatatatttctcgagaaagacctgtccgcattggatttcatcggtgtaagcttctatcagttcagtatctcgtggcccagactcttccccgacgggatcgtaaccgttgctaacgctaaaggccttcaatactacagcactctgctggacgcccttgtgctgcgcaatatcgagcccatagtgacgctttatcattgggatctgccgcttgcgctgcaggaaaagtacggcggttggaaaaatgacaccatcatcgacatcttcaacgattatgcaacatactgtttccagatgttcggggaccgggtgaaatactggattacgattcacaatccatacctggtcgcctggcacggctacggtaccggcatgcatgcccctggagaaaagggaaatctggcagccgtttatacggtcggacataacctgatcaaggctcacagtaaggtgtggcataactacaatacccacttccgtcctcaccagaaaggctggctgagcatcaccctgggtagtcattggatcgagccgaacagatcagaaaacactatggatatattcaagtgccagcaatcaatggtttccgtcttgggctggtttgctaacccaattcacggggacggcgattaccctgagggcatgaggaagaaactcttctccgtcctccccatttttagcgaggccgagaagcacgagatgcgcggtaccgccgacttcttcgccttcagtttcggaccaaataacttcaagcccctcaacaccatggcgaagatggggcagaatgtgagcttgaatctgcgtgaggccctgaactggatcaaactggagtacaacaacccacgtattcttatcgccgaaaacgggtggttcaccgatagccgcgttaagaccgaagataccactgccatctatatgatgaagaacttcctgagtcaagttctacaggcaatccggctggacgagatacgtgtgttcggatacactgcatggtccctccttgatggctttgagtggcaggacgcctacaccatccgaagaggtctcttttacgttgatttcaactcgaaacagaaggagagaaagcccaagtcgagcgcacattactacaaacagatcattcgcgaaaatggttttagcctcaaagaaagtactcctgatgtccaggggcagttcccatgtgatttttcttggggcgtgaccgaatctgtgctaaaacctgagtctgtagccagtagcccccagttttccgacccgcatctctacgtctggaacgctaccggcaaccgtctgttgcatcgcgtcgaaggagttaggctcaagacccgccctgcccagtgtacagattttgtgaacattaaaaaacaactcgaaatgttggcccgaatgaaagtgactcactaccggttcgctctggactgggccagtgtgcttccaactgggaatctcagtgctgtcaatcgccaggctctgcgctactaccgctgtgtagtgagtgaaggcttgaagcttggcatctccgccatggtgactctgtactaccccacacacgcacaccttggcctgcctgagccacttttgcacgctgatgggtggctcaacccatcaaccgccgaggccttccaagcctacgcaggcctgtgcttccaagagctcggagacctcgtgaagttgtggattaccatcaatgaacccaacagattgagtgatatttataatagatcaggcaatgacacatacggggcggcccacaatctgctcgtggcccatgcactggcttggcgcctgtacgatcgccaatttagacccagccagcggggggcggtgtctcttagtctgcacgctgattgggcagagcctgctaatccttacgccgactcacactggcgagcggccgagaggttcctccagtttgaaattgcctggttcgcagagcctttgttcaaaaccggtgactaccccgccgccatgagggaatatatcgcttccaagcacagacgcggactctcttcctccgctctgccgagactaacagaggctgaaagaaggctgctcaagggcaccgtagacttctgtgctttgaaccattttacaactcggttcgtcatgcatgagcagcttgccggaagcagatatgactccgatagggatatacagttcctgcaggacataaccaggttgtcttcccctacgagacttgccgtgattccttggggtgtgagaaagctcttaagatgggtgcggagaaattatggcgacatggacatctatataacggcctctggcatcgacgatcaggctctggaggatgatagattacgcaagtactacctcgggaaatatcttcaggaagtcctaaaggcgtaccttatcgataaggtccgtatcaaaggctattatgccttcaagctagcggaagaaaaaagcaagccacgcttcggcttttttacgtcagactttaaggccaagtcctcaatccagttttacaacaaggtcattagcagtcgcgggtttcccttcgagaacagcagctcgagatgctcccagacacaggagaataccgaatgtacagtgtgcctttttttagttcagaaaaagcccctaatttttctgggctgttgttttttctccaccctcgtcttgctcttatctatcgcaatcttccaacgccagaaacggcgcaagttttggaaggctaaaaacctacagcatatccccttgaagaagggaaagagggtagttagt

SEQ ID NO: 250599 - DNA, 3132 bp, Artificial Sequence
  Description of Artificial Sequence: Synthetic coding sequence
atgaagccaggctgtgctgctggctcacccggaaacgagtggattttcttttctactgatgagataaccactcggtatcgaaacactatgtctaacgggggactccagagatctgtgattctcagcgcgctcatcctgttgcgagccgttacgggcttctcaggggacggcagagccatttggtctaaaaaccccaactttacaccagtcaatgagagccagcttttcctctacgatactttccccaagaactttttctggggtattggtaccggcgcacttcaagtcgaaggctcctggaaaaaggacgggaagggcccatccatctgggatcattttatccacacccaccttaaaaacgtcagctccactaatggtagcagtgacagctatatcttcctggaaaaggacttgagtgccctcgacttcattggcgtaagcttctaccaattttccatcagctggcctagactattccctgacgggatcgttacagtggctaacgctaagggcctgcagtactactcaacattactcgacgcactggttcttcggaacattgaacctatcgtgaccctgtatcattgggatctgcctctggccctgcaggagaagtacggtggttggaaaaatgacaccatcattgacattttcaacgattacgcaacctactgctttcagatgttcggagatcgagtcaagtactggattaccatccataacccatatctcgtggcatggcacggctatgggacaggcatgcacgcgcctggggagaagggaaatcttgccgccgtctacacagtcggacacaacctgataaaggcacatagtaaggtatggcataattacaacactcacttccgacctcaccagaaggggtggctgtccatcaccctgggctcacactggatcgaacctaatcgctccgaaaatacgatggatatcttcaaatgccagcaatctatggtgtcggtgctgggctggttcgctaaccctattcacggggatggggattacccggagggcatgagaaagaagctgttctccgtcctacccatttttagcgaggcagagaagcacgaaatgagaggtaccgccgacttttttgctttcagttttggacctaacaacttcaagccacttaacacaatggcaaagatgggtcagaacgtttctttgaacttgagggaggccctcaattggattaagcttgaatacaacaatccacggatcctgatcgctgagaacgggtggttcacagactcgcgggtaaaaacagaagacactaccgcaatctacatgatgaagaacttcctgagtcaggtgctgcaggcgatacggcttgacgaaattcgggttttcggttacactgcctggtcactgttggacgggtttgagtggcaggacgcctatacaattaggcgagggttattctatgtggatttcaattctaaacagaaggagaggaagccaaaaagttccgctcactactacaagcaaattattagggagaacggcttctcactgaaagagtccacccctgatgtccagggccagttcccttgtgatttttcctggggagtaaccgaaagcgtgctgaagcccgagagcgtggccagttcaccgcagttcagtgatccccacctgtacgtgtggaacgcaaccggaaatcggctccttcatcgcgtcgagggagtgaggctcaagacacgccctgcccagtgcactgactttgtcaacattaaaaagcagctggagatgctggcccggatgaaggttacacattatagatttgctctggactgggcttccgtactgcccactggtaatctgagtgccgtgaatagacaagccttaagatactatcggtgcgtggtttccgagggtctgaaactcggtattagcgctatggttactctgtactaccccactcacgcccacctcgggctccctgagccactcctacacgctgacgggtggctcaacccttctactgcagaagcatttcaggcttacgccggtctgtgtttccaggaactgggcgacctcgtgaagctgtggatcaccataaatgaacctaatcggttatctgacatttacaatcgaagcggaaacgacacgtacggtgccgctcacaaccttctggtggcccacgctctcgcctggcgcttgtatgacaggcaattcaggccatcacagcgaggtgccgtttccttaagcctacacgccgattgggctgagccagcaaatccttatgctgatagtcattggcgcgcagctgagcgttttctccaattcgaaattgcatggtttgccgaaccactcttcaagactggcgattacccggccgctatgcgagaatacatcgcttctaagcaccgccggggactgtcctcttccgcactcccccgtttgactgaagctgagagaaggctgctcaaggggactgtggatttctgtgccctaaatcatttcactacccgtttcgtcatgcatgagcagctggccggtagcaggtacgacagtgatcgcgatattcagttccttcaagacattaccagattaagcagccccacccgactagccgtcatcccgtggggggtgcgcaaacttctgaggtgggtgaggcggaactacggagatatggacatctacatcactgcttccggcatcgacgatcaggctctcgaagatgatcggcttaggaagtattacctgggcaaatatctgcaggaggtcttgaaggcgtacctcatagacaaggttagaattaaagggtattacgcctttaagctcgctgaggaaaagagtaagcccaggttcggattcttcacctccgactttaaggccaaatccagtattcaattctacaacaaggttattagctccagaggctttccgttcgagaattcctcgtctagatgtagtcagacacaggaaaatactgagtgtaccgtgtgtttattcctcgtccagaaaaagcccctcatcttcctcggctgctgttttttttcaacactggtgctactcctgtctatcgctatcttccagcgtcagaagaggcgcaagttttggaaggccaagaacctgcaacatatcccacttaaaaaaggcaagcgggtggtctcg

SEQ ID NO: 250600 - DNA, 3132 bp, Artificial Sequence
  Description of Artificial Sequence: Synthetic coding sequence
atgaaaccaggctgtgctgctggatcacccggaaatgagtggatatttttctccacagatgaaattactacgcgttatcgcaacaccatgtctaacggaggccttcagcgcagcgtgatactctctgcccttatcctccttagagccgtgacggggttcagtggcgatggcagggcgatatggtccaagaaccctaattttactcccgtcaacgaatcccagctctttctttatgatacatttccgaaaaactttttctggggaatcgggacaggagctcttcaggtggaaggaagctggaagaaggacgggaaggggccttccatctgggatcattttattcacacgcaccttaaaaacgtgagcagtactaatggcagcagtgattcttacatcttccttgagaaagacctatctgctttggatttcataggagtgtcgttctaccaattctctatctcctggccacggctcttccccgatgggatagttaccgtcgctaatgccaaaggccttcagtattattccacactcttggacgcactagtgctgaggaatattgagcctattgtgacactgtaccactgggaccttcccctcgctctgcaggaaaagtacggcgggtggaagaatgatacaattatcgatatcttcaatgactacgccacatactgtttccagatgtttggagaccgggtcaagtattggattacaatacacaatccctacctggtggcctggcacggctatgggacaggcatgcacgcaccaggtgaaaagggtaacttggccgccgtttacacagtaggccacaatctgattaaggcccactcgaaggtgtggcacaattacaacactcatttcaggccacaccaaaagggttggctgtccattactcttgggtctcattggattgaaccaaatcgaagcgaaaatactatggacatcttcaaatgccagcagagcatggtcagcgtgctgggctggtttgccaacccaatccatggagatggtgattacccggaaggaatgcggaagaagctgttttccgtactgcctattttctcagaggccgaaaaacatgagatgcgggggacggccgactttttcgctttctcattcggccctaacaacttcaagccactgaacaccatggctaaaatgggccagaacgtgtctcttaatcttcgggaggccctcaattggatcaaattagaatacaataatccccgaattctcattgcagagaacgggtggttcacagatagccgggtgaagaccgaggataccacagccatttatatgatgaaaaactttctaagccaggtgctacaggccatccgcttggacgagattagggttttcgggtatacagcttggagccttctcgacgggttcgagtggcaggatgcctacaccatcaggcgggggttgttttacgtggatttcaactctaagcagaaggagcgcaagcccaaatctagtgcacactactataaacaaatcattcgggagaacggctttagtctcaaggagagtactcccgatgtgcagggccagtttccctgtgatttctcttggggcgtgaccgaaagtgtcctcaagccggaaagcgttgcatcttcaccacagttcagcgacccccatctgtacgtctggaacgctacaggtaaccggctgctgcaccgggtagaaggggtgagactgaagaccagaccggctcagtgtacggattttgtgaacatcaagaaacagctggagatgttggccagaatgaaagtcacgcattacaggttcgctctggactgggcatcagtgcttcctaccgggaatctatccgctgtgaaccgacaggcgttgcggtactaccggtgtgtggtgtcagaagggctgaaactgggaattagcgcaatggtaacgctgtactaccctacgcacgctcacttgggattacccgagcccttacttcacgcagacggctggctaaacccatcgactgccgaggcttttcaggcgtacgcggggctctgttttcaggaactcggggatctcgtgaaactatggatcacaatcaatgagcccaaccggcttagcgacatctataaccggtctggtaacgacacttacggagcagcccataaccttctggtggcgcacgctttggcctggcggctgtatgaccgacagttcaggccaagtcagagaggagctgtgtctctatccctgcacgccgactgggctgaacctgccaacccatatgcggattcacactggcgcgccgctgagcgctttctgcagttcgaaattgcttggtttgccgagcctctgttcaaaactggagactacccagcggccatgcgggagtacatcgcttccaaacaccggagggggttatcttcgagcgctctgccccggcttaccgaagcggagcgtaggctgcttaagggcacagtcgacttttgcgctctgaaccacttcaccacaagattcgtgatgcatgagcagttggctggttcaaggtacgacagtgatagagatattcagtttctccaggacattacccggctgtcaagtcctacccggctggccgttatcccatggggagtgagaaaactcttaagatgggtgcggcgtaattacggggatatggatatctacataactgcctccgggatagatgaccaggccctggaagatgaccgactgaggaagtactaccttggcaaatacttacaggaggtgctgaaggcttatcttattgacaaggttaggatcaaagggtactacgccttcaagctggccgaagagaagtcgaaaccacgctttggattcttcaccagtgacttcaaggccaaatcatccattcaattctacaataaagttatctctagtcggggctttccatttgagaatagctcatcaagatgctctcagactcaggagaatacggagtgcactgtttgcctctttctcgtccagaagaagcccctaatctttctaggctgctgtttctttagcaccctcgtgcttctgctctctattgcaatctttcaacgccagaagcggcgtaagttctggaaagccaaaaacctccaacacattcccctaaagaaaggcaagagggttgtgtcc

SEQ ID NO: 250601 - DNA, 3132 bp, Artificial Sequence
  Description of Artificial Sequence: Synthetic coding sequence
atgaagccgggttgcgcagccggatcaccaggaaatgaatggatattcttcagcacggatgaaattactacccgatacagaaacaccatgagcaacggaggtctgcagagatcagtcatcctctcagccctcattctgctgcgagcagtgactggtttttcgggggacgggcgggcaatttggtcaaagaacccgaacttcactccggtcaatgaatcccagctttttctttacgatacctttcctaagaactttttctggggcattggaaccggtgcgctccaggtggagggctcttggaagaaagacggcaaaggtccctccatttgggatcactttattcacacccatcttaagaacgtctcgtcgaccaacggatcctctgatagttacattttccttgaaaaggatctgtcggctcttgactttattggggtgtccttttatcaattttcgatctcctggccacgtctttttcctgacggaatcgtaactgtcgcgaatgcaaagggactccagtactactccacccttctcgacgcattggtgcttagaaatatcgagccaatagtgaccctgtaccactgggatctgcccctggctctgcaagaaaagtacggaggatggaaaaatgacacgatcatcgatatctttaatgattacgcaacgtactgtttccaaatgtttggggacagggtgaagtactggatcactattcataacccctatctcgtggcgtggcacggttacggcaccggaatgcatgcacccggcgagaagggaaacctggccgctgtgtataccgtcggacataacctcattaaggcccactcaaaggtgtggcataactacaacacccattttcgtccacatcaaaaaggatggctgagcataaccctcggttcccactggatcgaaccaaaccgcagcgagaacactatggacattttcaaatgccagcaatcgatggtcagcgtgttggggtggttcgcaaatcctatacatggagatggggattaccctgagggaatgaggaagaaacttttttcggtccttcctattttctccgaggcagaaaagcatgaaatgcggggaactgctgacttcttcgcattttcgtttggtcctaacaactttaagccattgaacaccatggcgaagatggggcaaaacgtatcccttaaccttcgcgaggccttgaactggatcaaacttgaatacaacaatcctagaatcttgatagccgaaaatggatggttcaccgactcgagagtaaagacggaggatactactgcgatctatatgatgaaaaacttcctgagccaagtgctccaggcaatcaggcttgatgagatccgggtgtttggttacaccgcctggtcgctgctggacggctttgagtggcaagatgcatacaccattcgtagaggcctgttctacgtggactttaactcgaagcaaaaggaaagaaagcctaagagctcggcgcattactacaagcagatcatccgggaaaatggattttcgcttaaagaatcgacccctgatgtgcaggggcaatttccctgcgacttctcatggggagtgactgaatctgtcctgaagccagaatccgtcgcctcgtcacctcaattttcagatcctcatctgtatgtgtggaatgcaacgggcaaccgtctgctccaccgggtggaaggagtgcgactgaaaactcgccctgcacagtgtaccgattttgtcaacataaagaaacaactcgagatgctcgccagaatgaaggtcactcattacagattcgctcttgattgggcttcagtgctgcccactggtaatctgtcggcagtgaatcggcaagcactgcggtactacagatgtgtcgtgtcagaaggccttaagctgggaatctcagcaatggtgacgctctactaccccacccatgcgcatctcggtctgccagaacctcttctgcacgcagatggatggctcaacccatcgactgcagaagcgtttcaagcatacgccggtctgtgcttccaggagttgggtgatcttgtgaagctctggattaccattaatgaacccaacaggctttcggacatctacaatagaagtggaaacgacacttacggagccgctcacaatctgctggtggcacacgcgctggcctggcgcctgtacgacaggcaatttaggccttcacaacggggagcagtttccctctcgcttcatgcagactgggctgaacctgcgaatccctacgcagactcccactggcgcgcggcagaaagatttcttcaatttgaaattgcttggtttgccgaaccacttttcaaaactggcgattacccagcagctatgcgggagtacatagcatccaagcatagacgtggcctgtccagttccgcacttccacgccttactgaagccgaaaggagactgttgaagggcactgtcgatttttgcgcacttaatcactttactactcgtttcgttatgcatgagcagctggcgggttcccggtacgattccgatcgcgatattcagttccttcaagatattactcgcctctcatcccctaccagacttgctgtcattccgtggggtgtcagaaaactcctgaggtgggtgcgacggaattacggagacatggacatctacattacggcgagcggaatagatgatcaggcactggaggatgatcgactgcgcaagtattatcttggtaaataccttcaggaggtgcttaaggcataccttattgataaagtgcggattaaagggtactacgccttcaaacttgcagaagaaaagtccaagccgagatttgggtttttcacctcagacttcaaggctaagtcctcgatacagttttacaataaggtaatttcaagcagaggttttccatttgagaactcctcgtcccgctgttcgcagacccaggagaacacggagtgtaccgtctgtctgtttctggttcagaagaaacctctgatcttcctgggctgttgttttttcagcaccctggtgttgttgctctccattgcgattttccagagacaaaaacggagaaagttctggaaggcaaaaaacttgcaacatatcccactcaagaagggaaaaagggtcgtgagc

SEQ ID NO: 250602 - DNA, 3132 bp, Artificial Sequence
  Description of Artificial Sequence: Synthetic coding sequence
atgaagcctggatgcgccgcaggaagcccaggaaatgagtggatcttcttctcgactgatgaaatcaccactcgctacagaaatactatgagcaatggcggtctgcagcgctccgtgatcctctcggcgcttatcctgctgagggcagtgactggattttcgggagacgggcgggccatctggtcgaagaaccccaacttcactcccgtgaacgagtcacaattgttcctgtacgacacctttccaaagaactttttctggggaatcggcaccggcgcactgcaagtggaaggctcgtggaaaaaggacggcaaaggacctagcatctgggaccactttatccacacccatttgaagaatgtcagctccactaatggatcaagcgacagctacatctttctggagaaagacctctcagcactggatttcatcggcgtgtccttttaccaattctcgatttcatggccacgcctgtttccagacggcatcgtcaccgtggctaacgccaaggggctgcagtactactccaccctgctggacgcacttgtcctgcgcaatattgaaccgattgtcacgttgtaccattgggacctgcctctggccctccaggagaaatacggaggatggaagaatgatactatcattgacatcttcaacgactacgcgacgtactgtttccaaatgttcggtgatcgggtgaagtactggataacgatccacaacccgtacctggttgcttggcacggctacggaacgggaatgcacgccccaggggaaaagggaaacctggctgccgtgtacaccgttgggcataacctcattaaggcccactcgaaagtttggcacaactacaacactcacttcagacctcatcagaagggatggctgtccatcactctggggtcgcattggatcgagccgaaccgcagtgagaacaccatggacattttcaagtgtcagcagtccatggtgtcggtgcttggctggtttgcgaacccaatccatggtgatggggattatccggagggaatgcggaaaaagctcttctccgtgcttccgatcttctcggaagctgagaaacacgaaatgcggggaaccgccgacttcttcgccttttcctttggacccaataactttaagccgcttaatacgatggccaaaatgggccagaacgttagcctcaacctccgcgaggcactgaactggatcaaactggaatacaataatcctcgcatccttatcgctgaaaacgggtggttcactgactcaagagtgaaaactgaggatactactgctatttacatgatgaaaaactttctgagtcaagtgctgcaggcaatccggttggacgaaatccgcgttttcgggtacactgcctggtcactgttggatgggtttgagtggcaggatgcgtacactatccggcggggactgttctacgtggactttaactccaagcagaaggagcgcaaaccgaagagctcagcccactactataaacagattattcgcgagaacgggttctccctgaaagagagcaccccggacgtgcaaggacagttcccgtgtgacttcagctggggagtgactgaaagcgtccttaagcctgaatcggtcgcaagctccccgcaattctcggatccacacctgtacgtctggaacgctaccggaaatcggctgctgcacagagtggagggcgtgaggttgaaaacgcgccctgcacaatgcaccgatttcgtcaacattaagaagcagctggaaatgctcgccaggatgaaggtcacccactacagatttgctctggactgggcttcagtgctccctactggcaatctttccgctgtgaataggcaggcgctccgctactaccggtgtgtcgtgtcggagggactcaagctggggatctccgccatggtcactctgtactacccgacccacgcgcatttgggactgccggaaccattgctgcacgcagacgggtggttgaatccttccacggccgaagcctttcaggcgtacgccgggctgtgcttccaagaactgggcgacctggtgaagttgtggatcaccattaacgagcctaataggctctccgacatctacaaccggagcggcaatgatacttacggagccgcccataacctgttggtggcacacgctctggcatggagactctacgatcgccagttcagaccgtcgcagcgtggagccgtctcgctgtcactgcatgctgactgggccgaaccggcaaatccgtacgctgattcgcactggcgcgcggctgagcgctttcttcagttcgaaatcgcctggttcgcggaaccgctgttcaagaccggagactacccagcagcgatgcgcgaatacatcgcatcgaagcatagacggggactctcgtcctccgcacttccacgccttactgaagccgagcgccgcttgctgaaaggtaccgtcgatttttgtgcgctgaaccactttactacgaggtttgtcatgcatgaacaactcgccggaagcaggtatgattcggatcgcgatatccagttcctccaagacatcactagattgagctcccccactcgcctcgctgtgatcccttggggggtgcggaagctgctccgctgggtcagaaggaattacggggacatggatatctacatcacggcatcaggaatcgacgatcaggctctggaggatgacagattgagaaagtactacttgggaaagtacctgcaagaggtgctcaaggcatacctgatcgacaaagttagaatcaagggctactatgctttcaagctcgccgaagaaaagtctaagccgagatttggattcttcacctcagacttcaaggcgaagtcgtcgatccagttttacaataaggtgatctcatcccggggattcccgtttgaaaacagctcgagccggtgctcccagacccaagaaaatactgagtgcaccgtgtgtctgttcctcgtccagaaaaaacccctcatcttccttggatgctgcttcttctcaaccctggtgttgctgctctccatcgccatctttcagcgccagaagcggaggaagttctggaaggcgaagaacctccaacacatccctctgaagaagggcaaacgggttgtctcg

SEQ ID NO: 250603 - DNA, 3132 bp, Artificial Sequence
  Description of Artificial Sequence: Synthetic coding sequence
atgaagcctgggtgtgcagcgggctctcccggtaatgagtggatctttttttcgactgacgaaataacgactcgataccgcaatacgatgtcgaacggaggactgcagcgctcagtaattctgtctgcgcttatattgctgagggcagtgacagggttctctggagacgggagggctatttggtccaaaaatcccaacttcacaccagtgaacgagtcacaactctttttgtatgacacttttcccaagaatttcttctggggcataggtacaggcgctttgcaggttgagggctcttggaagaaagacggaaaagggcccagcatttgggaccacttcattcacacgcatctgaagaacgtgtcatccacgaacggctcatccgattcttacattttccttgagaaggatctgtctgcgctggacttcattggtgtgtctttctaccagttcagcatttcatggccaagactgtttcccgacgggatcgtgactgtcgccaatgcgaagggcctacaatattattctaccctgctagatgcactggtcttgaggaatatcgagcccatcgtgactctctatcactgggacctcccattggctctccaggagaaatacggaggctggaaaaacgataccatcattgatatcttcaatgactatgctacctactgcttccagatgtttggggatcgagtgaaatattggatcaccattcataacccttacctggtggcttggcatgggtacggcacagggatgcatgcccctggcgaaaaggggaacctcgccgcagtatacaccgtgggccataacctgatcaaagcccactctaaggtgtggcacaattacaatacacacttcagaccccatcaaaaagggtggctgtccatcaccctaggttctcactggatagagccgaaccgttctgagaatacaatggatatattcaaatgccagcagtcaatggtgtcagttctcggctggttcgctaatccaatacacggagacggcgattatccagaggggatgcgaaaaaaattgttcagtgttttgcccatattctcggaagctgagaagcacgagatgagaggaacggcggatttcttcgcatttagttttggacctaacaacttcaagcctctgaataccatggcgaaaatgggacagaacgtgtcactgaacctccgtgaagccctgaattggatcaagctggagtacaataatccacgaatactgattgctgaaaatggctggttcactgactctagggtaaagactgaagatactaccgctatctatatgatgaagaacttcctgagccaggttcttcaggccatccggctggacgagattagggtcttcgggtataccgcctggagtttattggatgggttcgagtggcaggatgcttatacgattcggaggggcctcttctacgttgactttaacagtaagcagaaagaacgaaagcctaaatcgtctgcccattattataagcagatcatacgggagaacggctttagtttgaaagagtcaacccccgatgtgcaggggcagttcccatgtgacttctcatggggcgtgacggaaagtgttttgaaacccgagagtgtggcttcctctccccagttttccgacccacatctctacgtctggaacgccaccggtaatcggcttttgcaccgcgtggagggggtccgccttaagaccagacctgcccagtgtaccgactttgtaaatattaagaagcagctggagatgctggctaggatgaaagttactcactaccgcttcgccctcgactgggcatcggtgcttccaaccgggaacctcagcgccgtgaaccggcaggctttgcggtattaccggtgtgttgtgtccgagggcctaaagctcggcatctctgcaatggtgaccttgtactaccccacacacgcccatctgggccttcctgagccactcctccacgccgatggctggcttaacccctccaccgccgaggcctttcaggcttatgccggactgtgcttccaggagttgggtgaccttgtgaagctctggattaccataaacgagccaaatcggctctctgacatttataatcgaagcggaaatgatacttacggcgccgcccataacttactcgttgcccacgccctggcatggcgactatacgatcgtcagtttcggccgagccagagaggagcagtgtctttgagccttcacgccgactgggcagagcctgccaatccctatgctgacagccactggagagctgccgagcggtttctgcagttcgagattgcctggttcgctgagcctctgtttaaaactggcgattatcctgcagccatgcgagagtatatagcctcaaagcatcgcagaggccttagcagcagtgccctgcctcggcttactgaagccgagcgcaggctgttgaaaggcacagtggacttctgtgccttgaatcattttacaacccgctttgtgatgcacgagcagctcgcaggctctcggtatgattcagaccgtgacattcagttcctgcaagacattacacgcttgtcctcgccaacaagattagctgtaattccctggggagtgaggaagttattgaggtgggttcgcagaaattacggagatatggacatttacatcacagcttcagggattgatgatcaggctctggaggacgaccggctaaggaagtactacctcggtaaatatctccaagaggtcctcaaagcatacctcatcgataaggtgcgtattaagggctattacgctttcaaactggctgaagagaagagtaaaccaagattcggcttttttacaagcgacttcaaggcaaagtccagcatccagttttacaacaaagttatttcatcccgaggttttccgtttgaaaatagcagctctcgctgtagccaaacacaggagaataccgaatgcactgtgtgtctgtttctggtgcagaagaaacccctgattttcctggggtgctgctttttttcaacactcgtcttacttctttcaattgcaatcttccagcggcagaaacgccgaaagttctggaaagccaaaaatttacagcacatcccactgaagaaaggcaagagggttgtaagt

SEQ ID NO: 250604 - DNA, 3132 bp, Artificial Sequence
  Description of Artificial Sequence: Synthetic coding sequence
atgaagccaggatgtgcggcaggttctcctggaaacgaatggattttcttttctaccgatgagattaccacgaggtatagaaacactatgtcaaatggtgggcttcaaagatcagtgatacttagcgcactcatccttctcagggccgtgacgggattctccggggacggacgcgcaatatggtcgaagaatccaaactttacgcccgtcaacgaatcgcaactttttctgtacgatacctttcctaagaatttcttctggggtattgggactggagcgcttcaagtggaaggatcctggaaaaaagatggcaagggcccctcgatctgggatcatttcattcacacccaccttaagaacgtcagctcgacgaatggttcatcggattcgtacatatttctggagaaagacctttcagccctggatttcatcggagtgagcttttatcaattttccatttcatggccgcgtttgtttcccgatggtattgttaccgtggcaaacgcaaagggcctccagtactactccacccttttggacgcactcgtgctgcggaacatcgaacctattgtgactctgtaccattgggatcttcctctcgcactccaagagaaatatggcggatggaaaaacgacaccattattgatatcttcaatgattacgctacttactgtttccagatgttcggtgatcgggtgaagtattggattaccatccataatccttaccttgtggcctggcatggttacggcaccggaatgcatgcgcctggagaaaaaggcaacctggctgcagtctacaccgtcggacataatctgattaaagcacactccaaagtgtggcacaattacaatacgcattttagaccccatcaaaaggggtggttgagcatcacccttggatcacattggatagaaccaaacaggtccgagaacactatggacatctttaagtgtcagcagagcatggtgtcggtcctgggatggtttgccaacccaattcacggcgatggggattaccctgaaggtatgagaaagaaactgttctccgtgctgcccattttctcggaagcagaaaagcatgaaatgcggggaactgcagacttcttcgcattctcgtttggaccaaataactttaaaccacttaacaccatggctaagatggggcagaacgtctccctgaacctgagagaagcgctcaactggattaaactcgagtacaacaaccctcgcatcctcattgcagaaaacggatggtttaccgattcgcgggtcaagaccgaagataccactgccatctacatgatgaaaaactttctttcccaagtgctgcaagccatccggctggacgaaattcgggtgttcggttacaccgcgtggtcactgcttgacggtttcgagtggcaagatgcttacaccattcgtcgtggacttttctatgtggactttaactcgaagcagaaggaaagaaagcctaagagctcagcacattactacaagcagataatccgcgaaaacggattttcccttaaggagtccactcctgatgtgcaagggcagttcccatgtgacttctcatggggagtgaccgaatcggtgctgaaaccggaatcggtggcctcatccccacaattttctgacccccatctttacgtatggaacgcaactggaaatcgtctccttcaccgcgtggagggagtgagattgaaaactaggcctgcacagtgtactgattttgtcaacatcaaaaagcaactcgaaatgcttgcacgtatgaaggtgactcactaccgcttcgcgctcgattgggcatcagtgctcccgacggggaacctcagcgccgtgaatcgccaggcgctgcggtactaccgctgcgtggtgtcggaaggtcttaagctgggcatttcagcaatggtcacgctgtactaccctacccatgcccatctggggcttcctgagccccttctgcatgcggacggatggctgaatccgtctaccgcagaggcatttcaagcatacgcaggactctgctttcaggaacttggagatctggtgaagctgtggattaccattaacgaacctaaccggctgagcgacatttacaaccgctcgggaaacgatacctacggagccgcacataatctcctggtggcccatgctcttgcatggagactctacgataggcagttccgcccgagccaaaggggggcagtgagcctgtcgcttcacgcagattgggcagaaccggcaaatccttacgcagacagtcattggagggcagcagaaaggtttttgcaattcgaaattgcgtggttcgcagaaccattgttcaagaccggagactacccagcagctatgcgggaatacattgcaagcaagcaccgccgcggcttgagctcgtcagcactgcctagacttactgaggccgagcggcgcttgctgaaggggactgtcgatttttgcgcattgaaccactttactaccaggtttgtgatgcatgaacaacttgccggatcgcggtacgacagcgatcgcgatattcagttcctgcaggatattactcgcctgtcctcacctactcggctcgcggtgattccttggggtgtgagaaagctccttcgctgggtgcggcggaattacggcgatatggatatctacattactgcctcggggatagatgatcaagccctggaagatgatcgtctgcgcaaatactacttgggtaagtatctgcaggaagtcctgaaagcatatctgattgacaaggtccgaattaaggggtactacgcattcaaacttgcggaggagaagtcgaagcctagatttggtttcttcacctccgatttcaaggctaaatcctccatccagttttacaacaaggtgatttcctcacggggtttcccttttgaaaattcgtcctcccgctgttctcaaacccaagaaaacactgaatgtacggtctgtctttttcttgtgcagaaaaagcctcttatctttctgggatgttgtttcttctccacccttgtcctgctccttagcattgcaatctttcagaggcagaagcgccggaagttctggaaggccaagaacctgcaacatattccgttgaagaaaggtaagcgcgtggtttct

SEQ ID NO: 250605 - DNA, 3132 bp, Artificial Sequence
  Description of Artificial Sequence: Synthetic coding sequence
atgaagccgggatgcgccgcaggctcgccgggaaacgagtggatcttcttcagcacggacgagatcaccacccgttaccgtaacaccatgtcgaatggaggtctgcaacggtcagtgatcttgagcgccctgatcctcctccgcgctgtgacgggcttctctggagatggaagagccatctggtcaaagaacccgaactttaccccagtgaacgaatcacaactgtttctgtacgacacctttccgaagaacttcttctggggaatcggtaccggcgcactccaggttgaaggaagctggaagaaggacggtaaggggccatcgatctgggaccacttcatccacacccacctcaagaacgtgtcctcaaccaacggctcctctgatagctacatttttctcgagaaggatctctcggcgctggatttcatcggggtgtcattttaccaattctctatttcatggccccggctgttcccggacggaatcgtgaccgtggccaatgcgaaagggcttcagtattactccactttgctggatgccctcgtgctgaggaacatcgaaccgatagtgaccctgtatcactgggacctgccgctcgctcttcaagagaaatacggcgggtggaagaatgatacgatcatcgacattttcaatgactacgcaacctactgtttccagatgttcggagacagagttaagtactggattacgatccataacccttaccttgtcgcttggcatggatacggcaccggtatgcatgcaccgggagaaaaaggaaatcttgccgcagtctacaccgttggtcataacctcataaaggctcactccaaggtgtggcacaactataacacccatttccggccgcaccagaaagggtggctgtcgatcactttggggtcccattggatcgaacccaacagatcggagaatactatggatatcttcaagtgccagcagagcatggtgtcagtgttgggatggttcgccaatccgatccacggagacggcgactacccggaagggatgcgcaagaaactgttctcagtgctgcctatattcagcgaagcggaaaaacacgagatgagaggaactgctgatttctttgcgttctcgtttggacccaataactttaaacccctgaatacgatggctaagatggggcaaaatgtctccctgaatctgagagaggccctgaattggatcaagctcgagtacaacaacccaagaatactcatcgcagaaaacggttggttcaccgactcgagagtcaagactgaggacaccactgctatctacatgatgaagaatttcctcagccaggtccttcaagcaatccgcctggacgaaatcagagtgtttggttatacggcctggtccttgctcgatggttttgagtggcaggacgcctacactatccgaaggggactgttctacgtcgacttcaactccaaacagaaagagagaaagccaaaatcatcggcacattactacaagcaaatcattcgggagaacggcttcagccttaaggaatccacccctgatgttcagggacagttcccgtgcgattttagctggggggtgactgagagcgtcctgaaacctgaatcggtggcctcgtcgcctcagttctccgatcctcatctctacgtctggaatgctactggaaaccgcctgctccatcgggtggagggcgtgcggctcaagactagaccagctcaatgcactgattttgtgaacattaagaagcagctggagatgctggcgaggatgaaggtcacgcactatcgctttgccctcgattgggcatcggtgctgccgactgggaacctttcagccgtcaaccgacaagcactgcggtactacaggtgtgttgtgtcggagggcctgaaattgggaatctcggcgatggtcactctctactaccctacccatgcccatctgggactccccgaaccgttgctgcacgcagacggttggcttaacccgtcgaccgctgaggcgtttcaggcctatgccggactctgtttccaagaactgggagacttggttaagctgtggatcactattaacgaaccgaataggctcagcgacatatacaatcgctcaggcaacgacacctacggagcggcgcacaacctgctggtcgcgcacgcgttggcatggcggctgtacgaccgacagtttcgcccgtcccagcggggagccgtgtcgctgtcgcttcatgccgattgggcggaacccgcaaatccctacgcggactcccactggcgggcagccgaacgcttcctccagttcgaaatcgcatggtttgcggaaccccttttcaagactggagattacccggctgcgatgcgcgaatacatcgcatcaaagcaccggcgcggcctctcctccagcgcgctgccacggctcaccgaggccgagcgcagacttctgaaggggaccgtggacttttgcgcgctcaaccacttcaccactcgcttcgtgatgcacgaacaactggccggatccagatacgattcagacagggatattcagtttttgcaagacatcacccgcctgtcctccccaacgcgcctggcagtcatcccctggggcgtccggaagctcctgagatgggtgaggcggaattatggagatatggacatctacatcactgcctcaggtatcgatgaccaggctctggaggacgacaggctgagaaaatactacttgggcaagtaccttcaagaagtgcttaaggcgtacctgatcgataaggtccggatcaagggatactacgccttcaagctcgccgaagaaaaatcgaaaccacgctttggcttcttcacttcggactttaaggccaagtcgagcatccagttctacaacaaagtgatttcatcacgcggattcccattcgagaactcctccagcaggtgctcccaaactcaggaaaacactgagtgcactgtctgccttttcctggtgcagaagaagccactcatcttcctgggctgttgcttcttctcgaccctggtgctgctgttgagcattgctattttccaacggcagaagcgccgaaagttctggaaggctaagaatcttcagcatatccctttgaaaaaaggaaaacgagtggtgtcc

SEQ ID NO: 250606 - DNA, 3132 bp, Artificial Sequence
  Description of Artificial Sequence: Synthetic coding sequence
atgaagccgggatgtgcagccggatcacctggaaatgaatggatattcttttcgacggatgagattacgaccaggtacagaaatacgatgtccaacgggggtctgcaacgctcagtcattctttccgctctcatcttgctgagagctgttaccggattttctggagatggacgggccatttggtcgaaaaacccgaatttcactcctgtgaacgaaagccaactttttctgtatgacaccttcccgaagaatttcttttggggtattggtaccggtgccctgcaagtcgaaggtagctggaagaaagacggtaagggaccatccatctgggaccactttatccatacccatcttaagaacgtgtcatcaacgaacggatcgagcgattcgtacattttcctcgaaaaagatctgtcggcacttgatttcattggagtgtccttttaccagttttcgatctcctggcctaggctctttcccgatggtattgtgaccgtggcaaatgcaaagggtctgcagtactactcgaccctcctcgatgcccttgtcctccgtaacatcgaaccaatagtgactctttaccactgggaccttcctctggcacttcaggaaaagtacggcgggtggaagaatgataccatcattgatatcttcaacgattatgccacctattgcttccagatgtttggagatcgcgtgaagtactggattaccatccataacccgtacctggtggcgtggcatgggtacggtaccggaatgcacgcgccaggcgagaagggaaacctggcagcagtgtacaccgtcggccataacttgataaaagcacattccaaggtgtggcataactacaacactcatttccgcccgcaccagaaaggatggctttcaatcaccctgggttcgcattggattgagccgaatcgttccgagaacacgatggacattttcaagtgtcagcagagcatggtgtcggtgcttggatggttcgccaatcccattcacggcgatggagattaccctgaaggtatgaggaagaagctcttttcggtgctgccaatattctccgaagcagaaaaacacgaaatgagggggacggccgacttttttgcgttcagcttcggaccaaacaacttcaagccccttaatactatggctaaaatgggtcaaaacgtgtcacttaacctgagagaggcacttaattggataaagttggaatacaacaaccccaggattcttattgcagagaacggctggtttactgacagccgagttaagactgaggataccaccgcaatctacatgatgaagaactttctgagccaggtgctgcaggcgatcagactggacgaaatacgggtctttggttataccgcctggtcattgctggatgggtttgaatggcaggacgcgtacactattcgcagagggctcttttacgtcgactttaactctaagcaaaaggaacgtaagcctaagtcctccgcacattactacaagcagattatcagagaaaatggtttctcgctgaaggagagcaccccagatgtccaagggcaattcccatgtgatttcagctggggagtcactgaaagcgttctgaagccggaatccgtcgcatcatcacctcaattttcggacccccatctctacgtgtggaatgcgactggcaataggctgctgcacagagtcgagggagtccgccttaaaacccgccctgcccagtgtactgattttgtgaacattaagaaacagctggaaatgctggccagaatgaaagtcactcactaccgttttgcactggactgggcatcagtgctgcctaccggaaacttgtccgcagtgaatcggcaagcactgcggtactaccgctgcgtcgtctcagaaggactgaagttgggtatctcagcaatggtgaccctgtactaccctacgcatgcacacctcggtctgcctgagccgctgctgcacgcagatggctggctcaatccttccactgcggaggcgtttcaggcatacgcgggactttgctttcaagagctgggagatctggtgaagctctggatcaccatcaatgaacctaatcgcctttctgatatctacaatcgaagcggcaatgacacttacggagccgcccacaacctgctggtggcccatgcacttgcctggcggctgtacgacagacaatttcgcccgtcacagcggggtgcagtgtcacttagcctccatgcagattgggctgagccggccaacccatacgccgactcgcattggcgtgccgcagagaggtttctgcagtttgaaattgcatggttcgccgaaccactcttcaaaactggtgactaccccgcagcaatgcgagagtacattgcctcgaagcaccgacgtgggctcagctcctccgcactgcctaggctgaccgaagcagaacgaaggcttctcaagggaaccgtggatttctgcgcactcaaccattttaccactcgatttgtcatgcatgaacaactggcaggaagccgctacgatagtgatagagacatacagttcctgcaggacattactcgattgtcaagcccaacgagactggcagtgatcccctggggagtgaggaagctcctgcgatgggtccgacgaaactacggggatatggacatctatatcactgcttcagggattgacgatcaggctcttgaagatgatcgtcttagaaagtactacctgggaaagtatctccaggaagtcctgaaggcctacctcatagataaggtgagaattaaggggtactacgcctttaaactcgcagaggaaaaatccaaacctaggttcggcttctttacgtccgatttcaaagcaaagagctcaatccagttttacaataaagtaatttcgtcgcgtggatttccttttgagaactcctcctcgaggtgctcgcagactcaagaaaacactgaatgtaccgtgtgcctttttctggtgcagaagaagcctctgatatttcttggttgctgtttcttctcgactctcgtgctccttctgtcaattgccatttttcaaaggcagaagcggaggaagttctggaaggctaagaacctccaacatattccgctcaaaaagggcaagcgggtcgtgtcg

SEQ ID NO: 250607 - DNA, 3132 bp, Artificial Sequence
  Description of Artificial Sequence: Synthetic coding sequence
atgaagccaggttgtgcggcggggagccccgggaatgaatggatttttttctcaacagatgaaataacaacacggtaccgcaataccatgtccaatgggggcctgcagaggtccgtaatactgagcgcattgattctactgagggcggtgactgggttttcaggcgatgggagggccatttggagcaaaaacccgaatttcacgcctgtcaatgaatctcagcttttcctgtatgatacgtttcccaagaacttcttctggggaattggaaccggcgcgctgcaggtagaagggagttggaaaaaggacgggaaagggccatccatatgggatcactttattcatactcacctgaagaacgtcagctctacaaatgggtcgagtgactcctacatcttcttggagaaagatctaagtgcacttgactttataggcgttagcttctaccagttcagtatatcgtggccccggctgttccctgacggaattgttacagtcgcgaatgctaagggactgcaatactactccactcttctcgatgccctcgttctgaggaacatcgagccgatcgttacgctgtaccattgggacctgccactagccttacaggagaaatatgggggctggaagaatgacaccatcatcgatatttttaacgattacgccacatattgcttccagatgtttggcgacagagtcaagtattggattactatccacaacccttatctggtagcatggcatggttacggaaccggtatgcatgccccgggcgagaagggcaacctggccgccgtgtatactgtcggccacaacctcattaaggcacactccaaagtgtggcataattacaacacacacttcagaccgcaccagaaagggtggctgtccattacccttggaagtcactggatcgagcctaacaggagcgagaatacaatggacatcttcaagtgccagcagagcatggtctcggtgctcgggtggtttgccaacccaattcacggggacggcgactaccctgagggcatgcgcaaaaagctatttagcgtgctccctatcttcagcgaagccgagaagcatgagatgcgggggactgccgacttttttgctttttcttttggtccaaataacttcaaacccttgaatacaatggcgaaaatgggacaaaatgtgtcgcttaatcttagagaagccctgaactggataaaacttgagtacaataacccacgtatcttgatagccgagaacggctggttcaccgattcacgggtgaaaactgaggacaccacggcgatttatatgatgaagaacttcctttctcaggtgctgcaagcaatacgactggacgagattagggtctttggctacacagcctggtccctacttgatggttttgaatggcaagacgcctatactatccggagaggcctgttttatgtggatttcaattcaaagcaaaaagagcgtaaaccaaagtccagcgctcattattataagcagataattagagaaaatggtttctctttaaaagagtctacacctgatgtgcagggccagttcccttgcgactttagttggggagtgaccgagtcagtcctgaaaccggagtctgtcgctagcagtcctcagttctcggatccccatttgtacgtgtggaacgctacagggaatcgactgctgcacagggtagagggagtcagactgaagacccggcctgctcagtgtaccgactttgtaaatattaagaaacagctggagatgctcgccaggatgaaggtgacccactacaggtttgcactggactgggcatcagtgctgccgactgggaatctgtctgctgtcaacagacaggctctgcgctattacaggtgcgtggtgagcgaaggactcaaactggggatctccgcgatggtgactctgtattaccccacccacgctcacctgggcctcccagagccgctcctccacgccgatgggtggctcaacccttctaccgcagaggcgtttcaggcgtatgccgggctgtgtttccaggaacttggtgacctcgtgaagctgtggatcaccatcaatgaacccaacaggctgtccgacatctacaaccgttctggtaatgacacatacggagccgctcataatcttttggtggcacatgccctggcttggaggctgtatgacagacagttccggccttcacagcgtggcgcagtgtctctgagtctgcacgccgactgggcagaacccgctaatccgtacgccgatagccactggagagctgctgagcggtttctccagttcgaaatcgcatggttcgcagaacctctattcaaaactggcgactacccagctgcaatgcgcgaatacatcgcatccaagcaccggcgtggcctgagttcctccgccctcccacgactcaccgaagccgagagacgcttactcaagggcacggtggacttttgtgccttgaatcatttcacaaccagattcgtgatgcacgaacagcttgctgggagccggtatgactctgacagagacatacaatttttacaggatatcacgcgtctcagcagtccaacacggttggcagtcattccatggggtgtccggaagcttcttcggtgggtgaggagaaattacggggatatggatatctatataaccgcttcaggcatcgatgatcaagccttggaggacgacagactgcggaaatattatctgggcaagtacctgcaggaagttcttaaggcctatcttatcgacaaggtgaggattaagggatactacgcattcaaattagctgaggagaaatccaaaccgagatttggattctttacaagtgacttcaaggccaagtcttccattcaattttataacaaagtgattagctcaagaggattcccctttgagaactcctcttctcggtgttcccagacacaggagaataccgaatgcaccgtgtgtctctttttggttcagaagaagcccctgatatttctcggttgctgttttttcagtactctcgtgcttctcttgagcatcgccattttccagaggcaaaagagacggaagttctggaaggcaaaaaatctacaacatatccccctgaaaaaagggaaacgggttgtgagc

SEQ ID NO: 250608 - DNA, 3132 bp, Artificial Sequence
  Description of Artificial Sequence: Synthetic coding sequence
atgaagcccggttgcgcagcgggttcgcctggaaacgaatggatcttcttctcgactgacgagatcaccacgcgctacagaaacactatgtcaaatggcggtttgcagcgctccgtgattctttcggcacttattcttttgagggcagtgaccggttttagtggagacggacgcgcaatctggtccaaaaaccccaatttcacgccagtgaatgaatcacaactctttctttacgacactttccctaaaaacttcttttggggcatcggaaccggagctctgcaggtggaaggctcctggaagaaggacgggaagggccccagcatttgggatcactttatccatacccatcttaagaacgtgtcgagcactaacggatcatccgattcatacatcttcctggagaaggatttgagcgccctcgacttcattggcgtgtcattttaccagttctccattagctggcctcgcctttttccagacgggatagtgactgtggcaaacgccaaggggcttcaatactacagcaccctgctggacgctctcgtgcttagaaatatcgaacctattgtcaccctttatcactgggatctgccacttgcgctccaggaaaagtacggaggttggaagaatgatactatcattgatatcttcaatgattacgcaacttactgttttcaaatgtttggtgatagagtgaagtactggattactatacataacccctatctggtggcatggcacggatacgggaccggaatgcatgcacccggagaaaagggaaaccttgccgccgtttacactgtgggacataacctgatcaaggcacactcaaaggtgtggcataactacaacacccattttagaccccatcagaaaggttggctcagcataactcttggctcccactggattgagccaaataggtcggagaataccatggacattttcaagtgtcagcagtcaatggtgtccgtgcttggttggtttgccaaccctatccatggcgacggtgattatcctgagggaatgcggaaaaagctgttctcggtgcttccaatcttctccgaagcggaaaaacatgagatgagagggactgccgacttttttgcattcagctttggtccaaacaactttaagcccctcaacaccatggctaaaatggggcaaaacgtgtcgctgaatcttagagaggcgcttaactggattaagctcgaatacaataaccctcggatactcatcgcggaaaacggatggttcaccgattccagagtgaaaactgaagataccactgccatatacatgatgaaaaactttctttcccaggtacttcaagcaatcaggttggatgaaatccgggtctttggatacaccgcctggagcctcctggacggttttgagtggcaagatgcatacactattagacgaggcttgttttatgtagactttaactccaaacaaaaggaacgaaaacctaaatccagcgctcattactacaagcagattatccgtgagaacggtttttccctgaaggaatcgactccagatgtgcaaggccagttcccctgtgatttttcctggggagtgaccgaatcagtccttaaaccagaatcggtggcaagcagcccacaatttagcgacccacacctgtacgtctggaacgccactggcaaccggctgcttcatcgcgtggagggagtcagactcaagacccgtccagctcagtgtaccgatttcgtgaacatcaagaaacaactggaaatgttggcacgcatgaaggtgacccattaccggtttgccctggattgggcatcggttctgccaaccggtaatctgtccgcagtgaacagacaagctcttagatactacagatgtgtggtgtccgaaggtcttaaactcggtatttccgcgatggtgaccctgtactaccctacccacgcacatctgggactgcccgaaccacttcttcacgcagatggctggcttaacccttcaaccgcggaagcatttcaagcatacgcagggttgtgttttcaggagctgggggacctggtgaagctgtggattaccatcaatgaacccaaccggctgtcagacatatacaatcgatccggaaatgatacgtacggcgcggcacacaatcttttggtggcacacgcactggcatggcgactgtacgatcgacagtttcgtccttcgcagagaggagcagtctcgctgagcctgcatgcagattgggccgaaccggcaaacccttacgcagattcacattggcgggcggcggagcgtttcctgcagtttgaaattgcgtggtttgcagaaccacttttcaagacgggggattaccctgccgccatgcgtgagtatatagcaagcaagcatcggagagggctgagcagctcagcacttccccgccttactgaagcagaacgtagacttctcaagggtaccgtggatttctgtgcgctgaatcattttaccactcggttcgtgatgcatgagcaacttgcgggatcgcggtacgatagcgacagggatattcaatttcttcaggatattaccaggctttcttcccctacccgcttggcggtgataccttggggagtgcgcaagctgcttcgttgggtgagaaggaattacggagacatggacatatacattactgcctcaggaatcgatgaccaagccctcgaagatgatcggcttcgcaaatactacctgggtaaataccttcaggaagtgctgaaggcctacctcatcgacaaggtgcgtattaagggatactacgcattcaagctggcggaagagaagagcaagcccagatttggttttttcacttccgactttaaggcaaagagctcgattcagttctacaacaaagtgatctcatcacgtggattcccttttgagaacagctcgtccagatgctcccaaactcaagagaatactgaatgtaccgtgtgtttgtttctcgtgcagaagaagcccctgatatttctgggttgttgctttttctcgacgctggtgctgctgctgtccattgctatctttcagcgccagaagcggagaaagttctggaaagcaaagaatcttcaacacattccactgaagaaaggaaagcgcgtcgtgtcc

SEQ ID NO: 250609 - DNA, 3132 bp, Artificial Sequence
  Description of Artificial Sequence: Synthetic coding sequence
atgaagcctggttgcgcagcgggatccccgggaaacgaatggatcttcttctctaccgacgaaataactactcggtaccgcaataccatgtcgaacggtggtttgcagcgtagcgtgatcctcagcgcactgattctcctgcgggccgtcactggcttcagcggcgatggaagagccatctggtccaagaaccctaacttcacccctgtgaatgaatcccagctgttcctgtacgacaccttcccgaagaatttcttctggggaattggtacgggcgcactccaagtggagggaagctggaagaaggacggaaagggaccctcgatttgggaccacttcatccacacccacctcaagaacgtcagctcaaccaatggatcatcggatagctacatctttttggagaaggacctgtcagccctggactttatcggagtctcgttttaccagttctccatctcctggccaaggctctttccggatgggatcgtgaccgtcgcgaatgctaagggcctgcaatactactcgaccctgctggacgccctggtgctgcgcaatatcgagccaatcgtgactctgtaccactgggatcttccactggctctgcaagaaaagtacggaggttggaagaacgacactatcatcgacatcttcaacgactatgctacctactgtttccaaatgtttggggaccgcgtgaagtactggattaccatccacaatccgtacttggtcgcatggcatggatacgggacgggtatgcacgccccgggagaaaagggcaatctggccgctgtttacactgttggccacaacctcatcaaggcacattcgaaggtgtggcataactacaatactcattttagaccccatcagaagggatggctgtcgatcactctcggctcgcactggattgagcctaacaggagcgaaaacaccatggacatcttcaagtgccaacaaagcatggtcagcgtgttgggatggttcgccaatccgatccatggggacggagactaccccgagggtatgagaaagaagctgttctcggtgctgccgatcttttcagaggccgaaaagcacgagatgaggggaaccgcggacttttttgccttctcgttcggacctaacaacttcaagccattgaacaccatggcaaaaatgggccaaaacgtttccctgaacttgagagaggctctcaactggatcaaacttgaatacaacaatccacgcatcctgatcgctgaaaatggctggtttaccgatagcagagtcaaaaccgaggacactactgccatctacatgatgaagaacttcctctcccaggtgctgcaagccatcagactcgatgaaattagagtattcggatacactgcctggagcctgctggacggtttcgaatggcaagacgcctatactattaggcgcggactgttctacgtggacttcaactccaaacaaaaggaacgaaaacctaagtcgagcgcacattactataagcaaatcattcgcgaaaatggattcagcctgaaggagtcaactccagacgtccagggacagtttccttgcgatttcagctggggggtgaccgagtcggtcctcaagccagaatccgtggcgagctcaccacagttttcagaccctcacctgtacgtgtggaacgcgaccgggaaccgcctcctgcacagggtggaaggggtgcggctcaagaccagaccagcccagtgcaccgacttcgtcaacatcaagaagcaattggagatgcttgcgcggatgaaagtcacccactaccgctttgcactggattgggctagcgtgctccccacgggcaatctgtctgcggtgaatcggcaggcgctccgctactacagatgtgtggtatcagaaggcctcaagctgggaatctccgccatggtgaccctgtactaccctactcatgcacatttgggcctgccggagccacttctccacgcagatggatggctcaatccctcaactgccgaggccttccaggcctacgcgggcctttgcttccaggagctgggtgaccttgtcaagctgtggatcactatcaacgagcctaatcgccttagcgatatctataaccggtcgggtaacgacacctacggagcggcgcacaatctgctcgtggcgcatgccctcgcgtggcggctctacgatcggcagttccgcccgtcccagcggggcgccgtgagtctgtctctgcacgccgactgggcagaaccggcaaacccgtacgccgacagtcactggcgggccgcagaacgcttcctgcaattcgaaatcgcctggtttgcggaaccattgtttaagaccggagattacccagccgctatgcgggagtacattgcgtctaagcatagacggggactctcgtcctcagctctccctcgccttaccgaagccgaacgacggctgctcaaaggcacggtggacttctgcgccctgaaccattttacgacccgattcgtgatgcatgagcaacttgccggatcaaggtacgattcggatcgggacatccagtttctccaggatatcaccagactcagctcaccgacgcgccttgccgtcatcccgtggggcgtgcgcaaattgctccgctgggttaggcgtaactacggtgacatggatatctacatcacggccagcggaatagacgatcaggcgctggaggacgatcgcctgcggaagtactacctgggaaagtatctgcaggaggtcctgaaagcgtacttgatcgataaggtccgcatcaagggttattacgcattcaagctggccgaagaaaaaagtaagccacgcttcggattctttacgagcgatttcaaggcaaagtcatcgattcagttttacaacaaagtgattagttcgaggggattcccgttcgaaaattcttcttcacgctgcagccagactcaagaaaacaccgagtgtactgtctgcttgttcctcgtgcagaaaaaacccctgattttcttgggatgttgcttcttttcaactctcgtgctgctcctctcgatagccatcttccagcggcagaaacggagaaagttctggaaagcaaagaatctccagcacatcccgctgaaaaaaggaaaacgggtggtcagc

SEQ ID NO: 250610 - DNA, 3132 bp, Artificial Sequence
  Description of Artificial Sequence: Synthetic coding sequence
atgaaacctggctgcgctgcaggtagtcccggaaatgagtggatattcttttctactgacgagattacaacgagatacagaaacacaatgtcaaacggtggtttacaaagatccgtgattttatccgcactgatactcctgcgggcagtcacagggttcagcggggacgggagagctatctggagtaaaaatccaaactttacacccgtcaacgaaagtcaactcttcctttatgatactttccctaagaacttcttttggggaatcgggacaggggccctgcaggtcgaagggtcctggaaaaaagatggcaaagggccttcaatttgggatcatttcatccacacacatctgaagaacgtgagtagtactaacgggtcgtccgatagctacatctttttggagaaggacttgtccgccctcgatttcatcggcgtgagtttctaccagtttagtatctcttggccaagattattccccgacggcattgtgacggtggcaaacgcgaaaggcctgcaatactactccacattgcttgatgccttggttttgagaaacattgagccaatcgtgacgttataccattgggatttaccacttgctctgcaggagaaatacggaggttggaagaatgacactatcatagatatctttaacgactatgcaacttactgtttccagatgttcggtgatagggtaaagtattggattaccatacacaacccatacttagttgcctggcacggctacggcaccgggatgcacgcccccggcgagaagggaaatttagccgccgtttatacagtgggtcacaacctcattaaggctcattctaaggtgtggcacaactataatacacatttcaggccacaccaaaagggatggttatccatcacattgggctcacattggatcgagcctaataggagcgaaaacacaatggatatttttaagtgccagcagagcatggtaagtgtcctgggctggtttgctaaccctattcatggcgatggcgactatcccgaggggatgagaaagaagcttttcagcgtgttacccatcttcagtgaagctgagaaacatgaaatgcgagggaccgctgatttcttcgctttttcattcggccccaacaactttaaacctctcaacacaatggccaagatgggacagaatgtgtctctgaacctgcgtgaagccttgaactggatcaagctggaatacaacaatccaagaattcttatcgccgaaaacggatggttcacagattctcgagtcaaaacagaagatacgactgccatatatatgatgaaaaacttcctaagtcaggtgctgcaagccattagactggatgaaataagggtttttggatacacagcgtggagcctcttggatggtttcgaatggcaggacgcttatacgatccgaaggggactgttctatgtggatttcaattctaagcaaaaggagcgaaagccaaaaagttccgcccactactacaagcagattatccgtgaaaacgggttttctctgaaggagtccactcctgatgtgcagggccagttcccttgcgacttcagctggggagttactgagtcagtgctgaaacctgaaagtgtggctagtagccctcagttttcagacccccatctgtatgtgtggaatgccactggcaacaggctattgcatagggtggaaggtgtaaggctgaaaaccaggcccgcgcagtgcacagatttcgttaatattaagaaacagctggagatgctcgcaaggatgaaggtaacacactaccgttttgccctcgactgggccagcgtactgccaaccggcaatctctcagcagtgaataggcaagcgctgcgatattaccgatgtgtcgtgtcagaagggctcaaactgggaatcagtgccatggtgactctgtactatcctacgcacgctcaccttggactgcctgagccgctgctgcacgcagacgggtggctgaatccgagtactgctgaggcatttcaagcctatgccggcctgtgctttcaagaattaggcgatctggtaaaattatggatcaccatcaacgagcccaatagactaagtgatatctacaaccgctccggaaatgatacctatggcgcggctcacaatcttctagtcgcccatgctctagcttggagactttacgacaggcagttcagaccaagccaacgaggggcagtcagcctttcccttcacgccgactgggccgagcctgctaacccatatgccgactctcattggcgagcagccgagaggttccttcagttcgaaattgcctggttcgctgagcctctgttcaagaccggtgactatccggccgccatgcgagagtacatagcaagtaaacatcgacgaggcctttcatctagcgccctgccgagattgacagaggctgaacggagactactgaaagggacagtcgatttttgtgccctcaatcactttacaacacgtttcgtcatgcacgaacagctcgccggaagccgatatgacagtgaccgagatatccagttccttcaagacattacccgattatcttcacccacacgactggcggtgatcccatggggcgttcgaaagctcctgcgatgggtgcgcaggaactacggagacatggacatctacataacggcgtccggcatagatgaccaggcactcgaggacgatcgcctcagaaagtattacctaggcaaatatcttcaggaagtgctgaaggcatatctgatcgataaggtgagaatcaagggctattatgcctttaaattggcggaggaaaagagcaagccccgattcggcttctttaccagcgactttaaggccaaaagtagtattcagttctacaataaggtgatatccagtagagggttcccctttgagaattctagcagccggtgctctcagacccaggagaacaccgaatgcaccgtgtgcctatttctggtccagaagaagccactgatttttctcggttgctgtttttttagtaccctggtcctactgctcagcattgccatctttcaacggcagaagaggcgcaagttctggaaggccaaaaacctccaacacattccattgaagaaagggaaaagagtcgttagc

SEQ ID NO: 250611 - DNA, 3132 bp, Artificial Sequence
  Description of Artificial Sequence: Synthetic coding sequence
atgaaacctggatgtgctgcaggaagtcccggcaatgagtggatctttttcagtactgacgagatcacaactcgatatcgaaacacgatgtctaatggaggcctgcaaagatcagtgatcctttccgccctaatcctgctcagggccgtgacgggcttcagcggggacggacgagcgatatggagtaagaatcctaactttactccggtgaacgagagtcagcttttcctgtacgacacctttccaaaaaactttttctggggaattggaacaggggcattacaggttgaagggtcttggaaaaaggatggcaaggggcccagcatctgggaccatttcatacatacgcatctgaagaatgttagctctacaaacggctcctcagacagctacatcttcctggagaaagacctaagcgctctggacttcataggcgtgagtttttatcagttcagtattagttggcctcgtctgtttccagacggaatcgtgactgtggccaacgcgaaaggtctccaatactactctactttgctggatgcccttgtgctgcgcaacatagagccgatcgttacactctatcactgggaccttcccctggccctccaggagaaatacgggggttggaagaatgacacaatcatcgacatcttcaatgattatgccacctattgctttcaaatgttcggggatcgggtcaagtattggattacaatccacaacccttacctggtagcatggcacgggtacggtaccgggatgcacgctcccggtgagaagggcaatctcgccgcagtctacaccgtaggacacaatctaattaaggcgcactctaaagtttggcacaattacaacacacatttccggccccatcaaaaagggtggctgtctattacgctcggatcacactggattgagccgaataggtctgaaaatactatggacattttcaagtgccagcagtctatggtgtccgtgttgggatggttcgcgaatccaatccatggggatggggattatcccgaagggatgcgcaaaaaactgtttagtgtcttgccaatcttctccgaggccgagaaacatgaaatgagaggaacagcagactttttcgccttttcatttggacccaacaatttcaaaccccttaataccatggctaagatgggacagaatgtgtccctgaacctaagagaggctttgaactggataaagctggaatataataatccgcggatactcattgccgaaaacggttggttcaccgactccagagtgaagactgaagacactaccgcgatctacatgatgaagaactttttaagtcaggttctgcaagcgatcagattagacgagatccgtgtgttcggatatactgcttggagtctgctggatggcttcgaatggcaagacgcttacaccattcgccgcgggttgttctatgtggattttaacagcaagcagaaggagcgtaaacccaagagttctgcccactactacaaacaaatcattagagaaaacgggtttagcttgaaggagtctaccccggacgttcagggccaatttccttgtgacttctcatggggggttaccgaatcggtgctgaagcccgagagcgtggcaagttccccacaattctctgatccccatctgtacgtgtggaacgccacgggcaataggctgctgcatcgcgtcgagggtgtcagattgaagactcggccagcccagtgtactgattttgttaatatcaagaaacaactcgaaatgttagcacggatgaaggttacccattatcgctttgcgctcgactgggccagcgtgctaccaaccggaaatctgtccgccgtgaatagacaagcgctgcgctattatagatgcgtcgtatctgaagggctcaaactcgggatttccgcgatggtcacactatactatcccactcatgcccatctagggttgccagagccacttctgcacgcagatggatggctgaatccaagtacagccgaggcgtttcaggcctacgcggggttatgctttcaggagctgggcgacttggtaaagctgtggatcactatcaacgagcccaatagactgagcgatatatataacagaagtggcaacgacacgtacggggcggcgcacaatctgttagtggcccatgctctggcttggcgcttgtatgaccgacagttcaggccctcccagcgcggtgccgtctccctttctctgcacgccgattgggctgagcccgctaatccctatgcggactcacactggagagctgccgagcgatttcttcagtttgagatcgcctggtttgctgagccgctgttcaaaaccggcgactatcctgccgccatgcgcgaatatatagcatctaagcaccggcgcggcctgtcttcaagcgcccttccccgcctcaccgaagcagaaagaagattgctgaaggggaccgtggatttttgtgctttgaaccactttactaccagatttgttatgcacgagcagctggcaggaagtcgctatgattctgatagggatatccagttcttgcaggatattactcgtttgagtagtccgacgcggctagcagtgatcccttggggagttcggaagctgttgaggtgggtgcggcggaattacggagacatggacatttacattaccgcctccgggatcgacgatcaggcccttgaagacgatagattgcggaagtactatctggggaaatatctccaagaagttttaaaagcctatctaattgacaaggtgagaatcaaaggatactacgcctttaagcttgccgaggagaagagcaagcctcgatttggcttttttaccagcgacttcaaagccaaatcctcaatccagttctataataaagtcatatcttctaggggcttccctttcgagaacagttctagtagatgttcccagacccaggaaaacaccgagtgtacagtatgcctgttcctcgtgcaaaaaaaaccccttatctttctcggttgttgtttcttttccactctagtacttctcttgtccatcgccatattccaacggcagaagcgtagaaaattctggaaagctaagaatttgcagcacatccctctcaagaagggaaaaagggtggtgtct

SEQ ID NO: 250612 - DNA, 3132 bp, Artificial Sequence
  Description of Artificial Sequence: Synthetic coding sequence
atgaagcctgggtgtgccgccggctcccccggtaacgagtggatctttttctctaccgatgaaataaccactcgctacagaaacactatgtcgaacgggggactgcagcggagcgttattcttagcgccctgattctgctgcgcgccgtcactggattctcgggagatggcagggcaatatggtcgaagaatccaaatttcaccccagtgaacgaatcacagctgttcttgtacgatactttccccaagaatttcttttggggcatcggtaccggtgcactgcaagtggaaggatcgtggaaaaaggacggtaaagggccttccatatgggatcacttcatccacactcatctcaagaacgtgtcgagcactaacggttcgtcagattcgtacatattccttgaaaaggacctgtcggctttggatttcataggagtgtcgttttatcaatttagcatttcctggccgcggctgtttccagacggtattgtgactgtcgcaaatgcaaaggggctgcagtattactcgaccctgttggacgccctggtgctgcggaatatcgaaccaatcgtgacgctctatcactgggaccttcctctggcattgcaagagaagtacgggggctggaagaatgataccattatcgatatctttaacgattacgcaacctactgttttcagatgttcggggatagagtcaagtattggattactatccataatccctacctcgtggcctggcacggatacggaaccggcatgcatgcaccaggagaaaaaggtaaccttgcagcagtctacactgtcggacataacctgattaaagcccactccaaagtgtggcataactacaacactcattttcgccctcaccagaagggttggttgtcaattacgctgggcagccattggattgaacctaaccggtccgaaaacactatggatatcttcaagtgtcaacaatcaatggtgtcggtcctgggatggtttgcaaatccaatacatggcgacggagactatccggagggtatgcgtaagaagctgttttcagtgctgcctattttcagcgaagcggagaagcatgaaatgagaggtaccgcagactttttcgcattcagctttggacctaataactttaagccgctcaacactatggcgaagatgggacaaaacgtgtcgcttaatctccgtgaagccctcaattggattaaactcgagtacaacaaccctcgaatcctgattgcggaaaatggatggtttaccgattcgcgggtcaagaccgaagatacgactgccatatacatgatgaaaaacttcctgtcccaagtgctgcaggccattcgtcttgatgagatacgggtgttcggttatacggcctggagcttgctcgatggatttgaatggcaggatgcatacaccatacgtcgcgggctgttctacgtggatttcaatagcaagcagaaggagcgtaagccaaagtcgtccgcacactactacaaacagattatcagggaaaatggattttctctgaaggagtccacgccagatgttcaaggccagttcccatgcgacttctcgtggggagtgacggaaagcgtgctgaaacctgaatcagtggcatcgtcaccccagttcagcgacccacatctgtacgtctggaatgctaccggtaacagacttttgcatcgtgtcgaaggagtcagactcaaaactcgacccgcacagtgcaccgacttcgtgaacattaagaagcaactcgagatgcttgcgaggatgaaggtgactcattaccggtttgcacttgattgggcatcagtcctccccaccggtaaccttagcgcagtgaaccgccaggcacttcgatactaccgatgtgtcgtgtctgaggggcttaagctgggaatttcggcaatggtgaccttgtattaccctacccatgcccatcttggactgcccgagcctctccttcatgcagacggttggctcaacccttcaaccgcagaagcattccaagcgtacgcagggctctgttttcaagagctcggtgatcttgttaagctgtggatcactatcaacgaacccaataggttgtcggacatttacaacagatcaggaaacgacacctacggagctgcacacaacctgcttgtggcacacgcactggcatggaggctgtacgacagacagtttcgtcctagccaacggggagcagtttcgttgtcgctgcatgctgattgggcagaacccgccaacccttacgcggattcgcactggagagcggctgaaagatttttgcaattcgaaatcgcatggtttgctgaaccccttttcaaaacgggagactaccccgccgccatgcgggagtacatcgcaagcaagcatcgccggggcctcagctcatcggcgcttccaagactgactgaagctgagcgacgcctgctgaagggaactgtcgacttttgtgccctcaatcacttcaccactcgtttcgtcatgcatgagcaactggccggcagccgctacgattccgatagggacatccagtttctgcaagatatcactaggctgagctcacccacccgcctggccgtgatcccctggggcgtgagaaaacttcttaggtgggtgagaaggaattacggggatatggatatctacataaccgcctctggaatcgacgatcaggcactcgaggatgataggctgagaaaatactacctcggtaaataccttcaagaagtgcttaaggcgtaccttatcgacaaggtccgcataaaaggatactacgcatttaagctggcggaagagaagtcgaagccgagatttggcttctttacttcagactttaaagcaaaaagctcgatccaattctacaacaaggtgatctcgtcgaggggatttccttttgaaaattcctcgtcgcgatgctcccaaactcaagaaaacaccgaatgtaccgtgtgtcttttcctcgtgcagaaaaagccgttgatttttctcggatgctgcttctttagcaccctggtgctcctcctgtccattgcgatttttcaaaggcagaaacgccggaagttttggaaggccaaaaaccttcaacacattccactcaagaaggggaagcgggtggtgagc

SEQ ID NO: 250613 - DNA, 3132 bp, Artificial Sequence
  Description of Artificial Sequence: Synthetic coding sequence
atgaagccaggatgtgcagccggaagccccggcaatgaatggatctttttcagcactgatgaaattactacccgataccgcaacaccatgagcaacggaggattgcaacgttcggtgattctttcggcgctcatattgctgcgagcagttacgggtttttcaggggatggtagggcaatttggtcgaaaaacccgaatttcacgcctgttaacgagagccagctctttctgtacgacacctttcctaaaaactttttctggggaatcggaaccggcgcattgcaggtggaaggatcgtggaaaaaggatggtaaggggccttcgatttgggatcactttatccatacccacctgaagaacgtaagctccacgaatggctcgtccgacagctacatttttctggaaaaagatctgtccgcacttgacttcataggtgtgagcttctatcaatttagtatttcgtggccgcgcctgttccccgacggaattgtgacggtcgcaaatgcaaagggcctgcaatactattcaactcttctcgatgcactggttctccgaaacattgagccaattgtcactctgtaccactgggatctgccattggccctccaagaaaagtatggaggatggaagaacgatacgatcatagacatctttaacgattacgccacctactgtttccagatgtttggagatagagtcaagtactggatcactatacacaacccctacctcgtggcatggcatggatacggaaccggcatgcacgcacccggcgagaagggtaacctcgctgctgtatacaccgtgggacacaatctgattaaagcgcactccaaagtgtggcacaactacaatactcattttcgcccccatcagaagggatggctgtctattactctgggttcccattggatagagccaaatcggtccgagaataccatggacatctttaagtgccagcagtcaatggtatcggtgctgggttggttcgctaaccctattcatggtgatggtgactaccctgaggggatgaggaaaaaacttttttcggtgcttcccattttctcggaagccgaaaaacatgaaatgcgtggtactgcggatttcttcgccttctcctttggtccaaacaactttaagcctctgaatactatggcaaagatggggcagaatgtgtcattgaatctccgggaggccctgaattggataaaactggaatacaataaccctcggattttgatagcagaaaatggttggtttactgatagccgagtaaagacggaggataccaccgccatttacatgatgaagaactttctcagccaggtccttcaggccatacgcctcgatgagatcagggtgttcggctacacggcatggtcgcttcttgatggatttgaatggcaagacgcgtacaccattcgcagaggactgttttacgtcgacttcaactccaagcagaaggagagaaaacctaagagctcggcacactactataagcagatcatcagagaaaacggtttctcccttaaggaatcgacccccgatgtccagggccaatttccttgtgatttctcatggggcgtgactgagagtgtcctgaaaccagaatcagtggcatcttcgccgcaattctccgatccccatctgtacgtgtggaacgctaccggaaacagactgctgcatcgtgtggaaggagtgaggctcaagacccggcccgcacaatgcactgactttgtgaacatcaagaagcaactggagatgttggcccgaatgaaagtgactcattaccggtttgcacttgactgggcgtcggtgctgccaaccggaaacctttccgcagtgaacagacaagcacttaggtattaccgatgtgttgtgtctgaaggtctgaagctggggattagcgcgatggtgaccctctactacccaacgcatgcccatcttgggcttccagagcctctcctgcatgccgatggttggcttaacccttcgaccgcagaagcatttcaagcgtacgctggtctgtgttttcaggaactcggagacttggtcaaactgtggattactatcaacgagcctaacaggctgtcagatatctacaaccgtagcggtaacgatacttacggcgctgcccacaatctgttggtcgctcatgctctcgcatggagactttacgatagacaatttcgcccaagccaacgtggggcagtgtccctctcactccatgccgattgggcagaacctgctaatccttacgcagactcacactggagagctgcagagcggtttcttcagttcgaaatcgcctggttcgcagaacccctctttaagactggtgattacccggcagcaatgcgtgaatacatcgcatccaagcatcgccgaggactgtcgagctcggcgcttccgcgtcttactgaagcggaacgcagacttctgaagggtacggttgatttctgcgcgcttaaccattttaccaccagattcgtgatgcatgagcagctggctgggagtagatacgactccgatcgggatattcagtttctgcaagacattactcgcctctcgtccccaactcgacttgctgtcatcccttggggagtgagaaaacttctcaggtgggtgcggcggaactatggtgatatggacatatacattaccgcatccggaatcgacgaccaagcactcgaagatgatcggcttagaaaatactacctgggcaagtacctgcaagaggtcctgaaagcgtaccttattgataaggtgagaataaagggctactacgcattcaagctcgccgaagaaaagtcgaagccaaggttcgggttctttaccagcgactttaaggcaaagtcgtcaattcagttctacaacaaggtcatttccagccgaggatttccgtttgaaaattcgtcctccagatgttcgcaaacccaagagaataccgaatgcactgtgtgtctgtttctcgtccagaagaagccgctcatctttcttggctgttgcttcttttcaacccttgtcctcttgctgtcaatcgcaatctttcaacgccaaaaacgccggaagttttggaaggcaaaaaaccttcagcacatcccccttaagaagggaaagcgcgtggtgtcg

SEQ ID NO: 250614 - DNA, 3132 bp, Artificial Sequence
  Description of Artificial Sequence: Synthetic coding sequence
atgaaacccggatgcgcagcaggttcgccagggaatgagtggatttttttctcgacagatgagattacaacgcgctaccgcaatacgatgagcaatggcgggctccaacgttctgtgattctctcagcactcatcctccttcgtgcagttacaggattctcgggcgacggccgtgccatatggtctaagaacccgaattttacaccagtcaatgaaagccagttgttcctatatgatacattccccaagaacttcttttgggggattgggacaggagcccttcaagttgagggctcgtggaagaaggatggcaagggaccctctatatgggatcattttattcatactcacttgaaaaacgtctcatctactaacggtagttcggacagttacatatttctcgagaaagatctttcagcgctcgattttattggagtgagcttctaccagttcagtatctcgtggcctcggctctttcccgatgggatcgtaacggtagccaatgctaaaggcttgcagtattactccactcttttagacgcactcgtattgcggaacattgagcctatcgtgaccctctaccattgggatttgcctctggcattacaagagaagtatggcggctggaaaaacgataccatcattgatatcttcaacgattacgcgacctactgttttcagatgttcggcgacagagtcaagtactggatcacgattcacaatccctatctcgttgcttggcatgggtacggcactgggatgcacgctcctggtgaaaagggtaatctcgctgctgtgtacacggtgggccacaaccttatcaaggctcactcgaaggtctggcataactataacacacacttccggcctcatcagaaaggttggttgtcaattactctcggcagccactggatcgagccgaaccgctccgaaaacactatggatattttcaaatgccaacaatcaatggtatctgtgcttggctggttcgctaaccccattcacggcgatggtgactatcctgaaggaatgaggaagaagttgttttccgtattgccgatcttctccgaagcagaaaaacatgagatgcgcggaaccgctgacttcttcgctttcagttttggccccaacaacttcaaaccccttaacaccatggcgaagatgggccagaacgtctccctaaacttgcgagaagccctgaactggatcaagttagagtataataatcctagaattttgatcgcagaaaatggttggtttactgattcccgtgttaagacagaagatacgactgcgatatatatgatgaaaaactttcttagccaggtattgcaagcgatccgactcgatgagattcgggtattcggatacactgcatggagccttctggacggctttgagtggcaggacgcttatacaattcgacgcggacttttctatgtggactttaactccaagcagaaggaaaggaagcccaagtcatccgctcactattacaaacagatcattagggagaacggcttctccctgaaggagtcgactcccgatgtccaaggtcaatttccctgtgatttctcatggggagtgaccgaatccgtcttgaagccagagtccgtggccagcagccctcagttctcggacccacacctgtacgtctggaatgctacgggtaaccgtctcctccatagagtcgaaggcgttcgattgaaaacccgaccggctcagtgcaccgacttcgtaaacatcaagaagcaactagagatgctagccagaatgaaagtaacgcattatcggttcgctttggattgggcaagtgtccttccgaccggaaacttgtctgctgttaatcggcaagctctacgttactaccgatgtgttgtttctgaaggtcttaagctcggcatcagcgcgatggttaccttgtactatcctactcacgcacatctcgggcttccggaacctctgttgcatgcagatggctggctgaatccttctactgcggaggcgttccaggcttacgcaggcctttgttttcaagagctcggggatctcgtaaagttgtggattacaatcaacgagccaaacagattgtcagatatttataatcggtcgggcaatgatacctacggtgccgcacataatttattggtcgcccacgctcttgcctggcgattatacgaccgccaattccgtcccagtcagcgcggtgctgtctctctgagcttacacgccgattgggccgagcctgccaacccttatgccgatagccattggcgggccgctgaaagattcttgcagttcgaaattgcctggttcgcagaaccgttattcaaaaccggagattatccggccgcaatgcgggagtatatcgccagcaagcatcggcgagggctgtcgagctcagcgctgccacggcttaccgaagctgaacggcggctgctgaagggtaccgttgacttctgcgcacttaatcattttacaactcgttttgtcatgcacgagcaacttgcaggtagtcgatatgatagcgatagggatatccaatttttacaggatatcacccgcctgtcctcgcccactagacttgcagtcatcccatggggggtgagaaagttgcttcgctgggttcgacgtaactatggtgacatggatatatacattacggccagtggtatcgacgaccaggcgctggaagatgatcgcctcaggaagtactacctcggaaagtatctccaagaggtgctgaaggcatatctcattgacaaagtgaggatcaaggggtattacgcctttaagctcgccgaagagaaaagcaagcctagattcggttttttcacgtctgactttaaggctaagagctccattcagttctacaataaggtcatttcctctcgtgggttcccgtttgaaaacagcagcagtcgttgtagtcagactcaagagaacactgaatgcacagtttgtctctttttagtccagaaaaagccactaatatttctaggttgctgcttctttagcacgcttgtcttattgctctcgatcgctatcttccagcgacaaaagcgtcgcaagttctggaaggcgaaaaacttacaacatattccgttaaagaagggcaaacgggtggtaagt

SEQ ID NO: 250615 - DNA, 3132 bp, Artificial Sequence
  Description of Artificial Sequence: Synthetic coding sequence
atgaaaccgggctgcgcagcaggaagcccgggaaacgaatggatctttttctctaccgatgagatcaccaccaggtaccgcaacaccatgagcaacgggggtctgcaacggtccgtgattctgtccgcgctgatcctgctcagggcggtgacggggttctcgggagacgggcgcgcgatctggtcgaaaaacccgaacttcactccagtcaacgaaagccaactgttcctgtacgacaccttccctaagaacttcttctgggggatcggaactggagccctgcaagtcgaaggatcgtggaagaaggacggaaaagggccgtccatctgggaccatttcattcacactcatctgaagaacgtgtcgtccaccaacggatcgtccgattcatatatcttcctggagaaggatctctcagccctcgactttatcggcgtgtcgttttaccaattctcaatcagctggccgcggctgtttccggacggaatcgtgactgtggcgaacgccaagggcctgcagtactactcaacccttctggatgctctggtgctgcggaacattgaacctatagtcaccctctaccattgggacctccctttggctctgcaggagaagtacggaggatggaaaaacgataccatcatcgatatctttaacgactacgcgacgtactgctttcagatgtttggggatcgggtgaaatactggatcaccattcacaacccttacctggtggcctggcacggctacggcactggaatgcatgctcctggagagaagggaaacctggcagctgtgtacaccgtgggccacaatctgatcaaagctcactcgaaggtgtggcacaactacaatactcacttcagaccccaccaaaaggggtggttgtccatcaccctgggctcgcattggatcgaaccgaaccggtccgagaatactatggatatcttcaaatgtcaacaaagcatggtgtccgtgctcggctggtttgcaaatcccatccatggagacggtgattaccccgaagggatgcgcaagaagctgttttcggtgctgccgatcttctcggaggcggagaagcatgaaatgcggggtactgccgacttctttgccttttcattcgggccgaacaatttcaaaccgctgaacactatggctaagatgggtcaaaacgtgtccctgaacctgagggaagctctcaactggatcaagctcgaatacaataatccgcgcatcctgatcgccgaaaatggctggttcaccgactcacgagtgaaaactgaagataccaccgccatctacatgatgaagaatttcctctcccaggtgctgcaggctatcagacttgatgaaatccgggtgttcggctacactgcatggagcctgctcgacggattcgagtggcaagacgcgtacaccatccgcagaggacttttctacgtcgacttcaacagcaagcagaaagaaaggaagccaaagtcctcggcgcactactacaaacagattatccgggaaaacggattctcactcaaagaatcgactccggatgtgcaaggacagttcccgtgcgatttctcctggggagtcactgaaagcgtgcttaagcctgagtccgtggcttcctccccacagttctcggatccgcacctgtacgtgtggaacgcaactggtaacagactgcttcatagagtggaaggagtgcggctcaagacccgcccagcccagtgcacggattttgtcaatatcaagaagcaactggaaatgctcgcaaggatgaaggtgacccactacaggttcgccctggattgggccagcgtcctccccactggaaacctctctgccgtgaaccgacaggcactccgctactaccgctgcgtggtgtcagaaggactgaaactgggcatctccgcgatggtgactctctactaccctactcatgcccatcttggtctgccagagccattgctgcacgccgatgggtggcttaatccctcaaccgccgaggccttccaggcttatgccggcctctgcttccaggagctcggggatctggtgaagctgtggattacgatcaacgagccaaatagactctcggacatctacaaccgctccggcaatgacacctacggggccgcgcacaatttgctggtcgcccacgctctcgcctggcggctctacgatcgccaattccgcccttcgcagagaggtgcggtttcactgtcattgcatgcagattgggcagagccggcaaacccgtatgcggactcccattggcgcgctgccgaacgctttctccagtttgagatcgcctggttcgcggaaccgctgttcaagaccggggactatccggcagctatgcgggagtacatcgcatcgaagcatcggcgcgggctttcctcgagcgcgctgcctaggctcactgaggcagagcggaggctcctgaagggtactgtggacttctgtgcgttgaaccacttcactaccagattcgtcatgcacgaacaattggcggggtcacggtacgactccgatagagatatccaattccttcaggacatcacccggctcagctcgccgactcggctcgcagtcattccttggggggtccgcaagctgctgaggtgggtccgcagaaactacggagacatggacatctacatcactgcttcaggcatcgacgaccaggcactggaagatgatcggctgaggaagtactacttggggaagtaccttcaggaggtgctgaaagcctacctgatcgacaaggtgcgcattaagggttactacgctttcaagctggcggaggagaagtcgaagcctagattcggtttctttacctcagatttcaaggcgaaatccagcatccagttctacaacaaagtgatcagctccagggggttcccgtttgagaattcatcatcccggtgcagccaaactcaggaaaacactgaatgcacggtgtgcctgttccttgtgcaaaagaaaccgctgattttcctgggatgctgcttcttctcaactctggtgttgctgctgtcgattgcaatcttccaacggcagaagcgccggaagttctggaaagccaagaacctgcaacatatccctctcaagaagggaaaacgcgtggtgtct

SEQ ID NO: 250616 - DNA, 3132 bp, Artificial Sequence
  Description of Artificial Sequence: Synthetic coding sequence
atgaaaccgggttgtgcagcgggctcgcccggcaatgagtggatcttcttcagtacggacgaaattactacccgctatcggaataccatgagcaatggagggctgcagagatccgtgatcttgagcgccctcatcctgctccgggctgtcaccggattctcgggcgacggaagggccatctggtccaagaaccctaacttcaccccggtaaacgagtcacaattgttcctgtacgacacgtttccgaaaaacttcttctggggaatcggcaccggagcgttgcaggtcgagggttcgtggaagaaagatgggaaggggccgtccatctgggaccacttcattcacactcatctcaagaacgtctcgtcgacgaacggttccagcgacagctacatcttcctggaaaaggacctgtcggcactggacttcatcggcgtctctttctaccagttctccatcagctggccaaggctcttccctgacggaatcgtgaccgtggcaaacgcaaagggactgcaatactactcgaccctcctggatgccctggtactccgcaacattgaaccaatcgtcaccctgtaccactgggatctcccactcgcgctgcaggagaagtacgggggatggaagaacgatacgattatcgatatcttcaacgactacgctacttattgtttccagatgtttggggacagagtgaagtattggattactatccacaacccttacctcgtcgcatggcatggctacggcacgggcatgcatgctcccggcgagaagggtaacctcgcagctgtctacactgtcgggcataacctgatcaaggcgcacagcaaagtgtggcataactacaacacccacttcagaccacaccaaaaaggctggctgtccataacgctgggatcgcactggatagagccgaacagatctgagaacaccatggatatcttcaaatgccagcagtcgatggtgtccgtgttgggctggtttgcaaatccgatccacggagatggcgattacccggagggaatgagaaagaagctgttcagcgtgctcccgatcttctcggaagccgaaaaacacgaaatgcgcggcactgccgactttttcgcattttcattcggaccaaataacttcaagccgctgaataccatggccaagatgggtcaaaatgtgtcgctgaaccttcgggaggccctgaactggatcaaactggaatacaacaacccaagaatcctgatcgcggagaacggctggtttaccgactcgagagtcaagacggaggacactactgctatctacatgatgaagaatttcttgtcgcaggtgctgcaagcgatccgcctggacgaaatcagagtgttcggatacactgcttggtcgttgctggatggattcgaatggcaagatgcctacactattcgccgggggctcttctatgtggatttcaattccaagcagaaagaaagaaagccaaaatcctccgcacactactacaagcaaatcatcagggagaacgggttcagcctgaaggagtccaccccagacgtgcagggacagttcccgtgcgatttctcatggggagtgactgagtcggttcttaagcctgagtcggtggcttcctcaccgcagttttcagaccctcacttgtacgtctggaatgccaccgggaatcggctgctgcatagagtcgaaggtgtccgtctgaaaacccggccggcccagtgtactgactttgttaacatcaagaaacaactggaaatgctggcccgaatgaaggtcacccactaccgattcgccctggattgggcttcggtgctcccaactgggaatctctcagctgtgaaccgccaggccctccgctactaccgctgcgttgtgtccgagggactgaagttgggcatctccgctatggtgactctgtactacccgactcacgcacatttgggactgccagagccgctgctgcacgccgacggttggctgaacccctcgaccgctgaagcattccaggcatacgcgggactgtgttttcaagaactcggggacctcgtgaagctgtggatcactatcaatgagccgaaccgcctctccgacatctacaaccggtcgggaaatgatacttacggtgccgcgcataacttgttggtggcgcacgccctggcgtggagactgtatgatcgccagtttagaccgtctcagcggggagccgtgtccctgtcactccatgccgactgggcagagcccgcgaacccatacgccgactcccattggcgcgccgccgagagattcctgcaattcgaaatcgcgtggttcgccgaaccgctcttcaagaccggagactaccccgccgccatgcgggaatacatcgcctcgaagcatcggcgcggactctcatcgtcggccctgccaagattgaccgaggcggaacggagactgcttaaaggtaccgtcgatttttgtgccctgaatcacttcactactcggttcgtgatgcacgagcagcttgcaggatcgagatacgattccgacagagatattcagtttctgcaggatatcacgcgcttgtcctctcccacccgcctcgcggtgatcccgtggggagtcaggaagctgctgagatgggtgagacgtaattacggagatatggacatttacataacggcctcaggaattgatgaccaggcgcttgaagatgataggcttcggaagtactacctgggaaaatacctgcaagaagtgcttaaggcgtacctgattgacaaagtgcggatcaaggggtactatgcctttaaacttgcggaagaaaagagcaagcctcggttcgggtttttcacgagcgacttcaaagcaaagtcatccatccagttttacaacaaggtgattagctcaagaggattcccgtttgaaaattcctcgtcccgctgttcgcagacccaggaaaacaccgaatgcaccgtgtgtctgtttctggtgcaaaagaagccgctgatctttctgggttgctgcttcttctcgactctggttcttctgctcagcatcgcgatcttccagaggcaaaagcgcagaaagttctggaaagccaaaaacttgcagcacatccctctcaagaaaggcaagcgtgtggtttcc

SEQ ID NO: 250617 - DNA, 3132 bp, Artificial Sequence
  Description of Artificial Sequence: Synthetic coding sequence
atgaaaccaggctgcgcagctggctctcccggcaacgaatggatcttctttagcacggatgaaatcactactcgttatcgcaacaccatgtccaacggagggctgcagagatcagtgatactatctgccttaatcctcctgcgcgctgtaaccggcttcagcggcgatggcagggctatttggagtaaaaaccccaatttcacaccggtaaatgagtcccagctcttcctgtacgatacgttcccgaagaacttcttctgggggattggtactggcgcgctccaagtcgaaggcagttggaagaaagacggtaaaggcccatctatatgggatcatttcatccacacacatctaaaaaatgtgagttctacaaatggcagttccgattcttacatcttcctggaaaaggatctgtcggccctggactttatcggcgtctctttctatcagttttcaattagctggcctaggctattccctgacggaatcgtgacagttgccaatgccaaagggcttcaatactactctactcttttagacgcgctcgtgcttagaaacattgaaccaatcgtgactctctaccactgggatctgccactcgcattacaagaaaaatacggcggatggaaaaacgacaccatcattgacatcttcaatgattacgcaacctactgttttcagatgttcggagacagagtgaagtactggataactatccataatccttatttggtcgcttggcacggctatggaactgggatgcatgcccccggcgagaagggcaacctcgcagccgtctacaccgtgggtcataatctgatcaaagctcactcaaaggtgtggcataactataacacccacttccggccccaccagaagggctggctttccatcactttaggcagtcattggattgagccaaatcgttccgagaacaccatggatattttcaaatgccaacaatccatggtttccgtcctgggttggtttgccaacccaatccatggcgacggtgactatccggaagggatgcgaaagaaactgttttccgtgctacccattttctccgaggctgagaaacatgagatgcgcggaacggccgatttttttgctttctctttcggacctaacaatttcaagcccctgaacaccatggccaaaatgggccaaaacgtgtcactcaatttgcgagaagctctcaattggatcaaattagagtacaataaccccagaatactaatcgccgagaatggatggttcacagattctagagtcaagactgaggacactacagcgatctatatgatgaagaatttcttatcacaagtcctgcaggccattaggctcgatgagataagggtctttggatatactgcctggagtctgctcgacgggtttgaatggcaggatgcctatacaattagacgcggcctcttttatgtcgatttcaattctaaacaaaaggagaggaaaccaaaatctagtgcccattattataagcagatcatcagggaaaatggtttcagccttaaagagtccacaccggatgtgcagggccagttcccgtgcgattttagctggggcgtgactgaaagcgtgctgaagccggaatccgttgcctcaagcccacagttctctgatccacacctgtacgtgtggaacgctactggcaaccgcctgctccacagagttgagggggtaaggctgaagactcgtccagctcaatgcactgacttcgttaacataaaaaagcaacttgagatgctggcccgcatgaaggttacacattatcgattcgcccttgattgggcatccgtccttcccaccgggaatttgtcagcagtgaaccgtcaggctctccgttactatcgatgtgtcgtgtcggagggattaaagctcgggatctctgcaatggtcacactatattacccaactcatgctcatttaggcttacctgaaccacttcttcatgcagatggatggctgaatccttcaactgccgaagcgtttcaggcctacgccgggttgtgctttcaagaattgggtgatctggtgaagctatggatcacaatcaacgagcccaaccgactgtctgacatatataatcgcagtggcaacgacacctatggcgctgcccataacctgctggtggcacacgccctggcctggagactgtatgacagacagttccgaccgagtcagaggggtgcagtgagcctatcgttacatgccgactgggccgaaccagcgaatccatatgccgactctcattggagagccgcagagcgatttcttcaattcgaaattgcgtggttcgctgagccactgtttaagacaggcgattacccagcagcaatgagggaatatatcgcaagcaaacatcgacgcggattgtcctcaagcgccctgccccggctgactgaagctgagcggagattgctgaaaggcaccgtcgacttctgcgccctgaaccactttacaactagatttgttatgcatgaacagctcgcgggcagtagatatgactccgaccgcgatattcagtttttgcaggatatcacacggctgtcttctccaaccagactggccgttatcccgtggggggtgcgcaagttattgaggtgggtaagacggaattatggcgatatggacatatacatcacagcctcaggcatagacgaccaggcgctggaagatgacagactcagaaaatactacctcggaaagtacctgcaagaggttttgaaagcctatctgatcgacaaagtgcgcatcaagggctattatgcgttcaagctggcagaagagaaatccaaacctaggttcggcttcttcacgtctgatttcaaagcaaagagctccatccagttctacaacaaggtcatctccagccgcggttttcccttcgaaaatagcagttcaaggtgcagccagacccaagaaaacacagagtgtacagtctgcttattcctggtgcagaaaaagcccctgatattcctcgggtgctgtttcttctccaccctggtgctgctcctgtctatcgctatattccaaaggcaaaagaggcgcaaattctggaaagctaagaacctccagcacattccattgaagaaaggcaagcgagtggtcagt

SEQ ID NO: 250618 - DNA, 3132 bp, Artificial Sequence
  Description of Artificial Sequence: Synthetic coding sequence
atgaaacccggctgcgctgccgggagccccggcaacgagtggatttttttctccacggatgaaataactactcggtaccgcaatacgatgtccaatggtggcctgcagcggagcgtgattctgagtgcccttatactgttaagggccgtcactggatttagcggagacgggcgtgccatttggtcgaagaaccctaacttcacgccagttaacgagtcacagttgttcctatatgatacctttcccaagaatttcttctggggcattggaaccggggccttgcaggtagaggggagttggaagaaggatgggaagggtccgagtatatgggaccactttattcatacccacttgaaaaacgtcagctccacaaatggatccagtgactcttacattttcctggaaaaagatctgtccgccctagacttcatcggcgtctccttctaccagttttcgatttcttggccccggttgttcccagatgggatcgtgacagttgccaatgcaaaaggcctccagtactattctaccctgctcgatgctcttgttcttcgcaacattgagcctatcgttaccctataccattgggacctccctttagctttgcaggagaagtacgggggatggaagaatgatactattatagacatatttaacgattacgccacttattgttttcagatgttcggagaccgagtgaaatactggatcaccatccataatccctaccttgtggcttggcatggttacggtaccggtatgcatgcccccggggagaaggggaacctcgccgccgtgtacactgtggggcacaaccttataaaggcccactccaaggtgtggcataattacaatactcactttcgaccacatcagaaaggctggctttcgatcacgctgggcagccactggattgagccaaaccggtctgagaataccatggatatctttaagtgtcagcaaagtatggtgagcgtactgggctggttcgccaaccccatccacggggacggagactaccccgaaggaatgcgcaaaaagttgttctctgtgctccctattttctcagaggctgaaaagcacgaaatgagaggaacagcggacttttttgcgtttagtttcggcccgaataactttaaaccccttaacactatggctaaaatgggacaaaacgtctcactgaatctgcgcgaggccctgaactggatcaagctggaatacaataacccccggatcctaattgccgagaatggctggtttactgattctcgggtgaaaactgaggatacgaccgccatttacatgatgaagaacttcctctcccaggtcctgcaagctatcagactagatgagattagggtgttcggctataccgcctggagccttttagacggattcgaatggcaagacgcctacacaatacgacgcgggttattctacgtcgacttcaacagtaagcagaaggaaaggaaacccaaatccagcgcccactactacaagcagatcatcagagagaacggattttccctaaaagaatcaactccagacgtgcaaggacagtttccgtgcgacttctcatggggcgtcactgagtctgttctcaagccagagtccgtcgcctctagcccacagttctccgaccctcacctgtacgtgtggaacgctactggcaatagactgctgcacagagtggagggcgtccggctgaagacgaggcctgctcaatgtaccgacttcgtgaacattaagaagcagttggaaatgttggcacggatgaaggtcacacattaccgctttgccctggattgggcttcagtgctccccacagggaatctctcagctgttaatagacaagctctacgctactaccgctgcgtggtgtccgaagggcttaaacttgggatttccgccatggtgacgctgtattatccaacacacgcccacctgggcctcccagagcccttgctgcatgcggacgggtggttgaacccgagcacggccgaggcctttcaggcatacgcgggtctctgctttcaggagttgggagacttagttaagctctggatcaccattaatgagcccaataggctgagtgatatctataatcgttctggcaacgatacatatggcgccgcacataacctgctcgtggcccacgccctagcctggcggctttatgacaggcagttcagaccatcacagaggggtgctgtttcgcttagcctccatgcagattgggctgagcccgcaaatccatatgctgattcccactggcgcgcagccgagcgctttctgcaatttgagatcgcctggttcgctgagcctctctttaaaaccggcgactacccagcggctatgagggaatatatagcctctaagcaccgcagaggtctaagcagttccgctctaccccgcctgactgaagcggagagacggttgctgaagggcacagtggatttttgcgcactcaaccactttaccactagatttgtgatgcatgagcagctggccggaagccggtacgatagcgaccgcgacatacagtttttgcaagacattaccaggctgagtagccccactcgtctagccgtgatcccttggggcgtccggaaactgctcaggtgggtacggcgcaactatggcgatatggatatctatatcaccgccagcggaattgatgaccaggccctggaagatgaccgattgcgcaagtattacctggggaaataccttcaggaagtgctgaaggcatacctgatcgacaaggtccggattaaaggatactatgcttttaagctggctgaggaaaaatctaaacccaggttcggcttcttcacctccgacttcaaggcaaagagctcaatccagttttataataaagtcatctcctcgcgcgggttcccctttgaaaacagctccagcaggtgcagccaaacacaggagaataccgagtgcactgtctgccttttcctggttcagaaaaagcctctgatcttcttaggatgttgcttcttttctaccctcgtcctgctgctgtctatcgccattttccagcgccaaaaaaggagaaaattttggaaagccaagaatctacaacatatacccctaaaaaaggggaaacgagtagtgtcc

SEQ ID NO: 250619 - DNA, 3132 bp, Artificial Sequence
  Description of Artificial Sequence: Synthetic coding sequence
atgaagcccggatgcgcagctggaagccctggtaacgaatggatcttcttcagcactgacgaaataaccaccagatatagaaacacgatgagcaacggaggcctgcaaaggtcagtcatacttagcgcgcttattctcctgagggctgttactgggttctcgggagacggtagggcgatttggtcgaagaaccctaactttacccctgtcaatgaatcgcagctcttcctctatgacacgttccctaaaaacttcttttggggaatcgggaccggagcacttcaggtggaaggatcgtggaagaaggatgggaaaggcccatcgatctgggaccacttcatccacactcatctcaagaacgtgtcatcgaccaacggttcttccgattcatacatctttcttgaaaaggatctctccgccctcgatttcatcggtgtgtccttttatcagttttccatttcgtggcctagactgtttcccgacggtattgtgacggtggctaatgcaaagggtctgcaatactactctactctccttgacgccctggtcctcagaaacatagaaccgatagtgacgctgtaccattgggaccttccactggcacttcaagagaagtacggaggttggaagaacgatacgattattgacatattcaacgattacgctacttactgttttcaaatgtttggcgatcgcgtgaaatactggatcaccatccataatccttatctcgtagcatggcatggttacggaactggcatgcatgcgcctggcgaaaagggaaaccttgcggcagtctacaccgtcggacacaacctcataaaggcccactccaaggtctggcacaattacaacacgcattttcgccctcatcaaaaggggtggctttcaattaccctcggttcgcactggattgaacccaatcgttcagagaacaccatggacattttcaaatgtcagcagtcgatggtttcggttctgggctggtttgccaacccaattcacggggacggagactaccctgaaggtatgagaaaaaagctctttagcgtattgcctattttctccgaagcagaaaaacacgaaatgcggggaaccgcggactttttcgccttttcgtttggtccgaacaatttcaagccgctgaacaccatggcaaagatgggtcagaatgtgtcgctgaatctgcgcgaggcactgaactggataaagctggagtataacaatcctaggatactgattgccgagaacggatggtttactgattcaagagtgaaaaccgaagataccactgccatttacatgatgaagaattttctttcacaggtcctgcaagcaatcaggcttgatgagattcgcgtgtttgggtacaccgcctggagccttttggatggatttgaatggcaagatgcttacactatcagacgggggcttttctacgtggactttaactcaaagcaaaaggaaagaaagcccaagtcctcggcgcactactacaagcaaatcattcgtgaaaatggttttagcctgaaggagagtactccagatgtgcaaggccagtttccgtgtgatttttcgtggggggtgactgaatcagtgctgaaaccagaatccgttgcgtcgtcgccacagtttagtgatccccacctgtacgtgtggaacgcaaccggcaaccggctcctgcatcgtgtggaaggagtgagactcaagacccgcccagcacaatgtaccgattttgtcaacatcaagaagcagctggaaatgcttgcacggatgaaagtgacccattacagattcgcactggactgggctagcgtgttgcctaccggaaatctctctgcggtgaaccgtcaggcgctgagatactaccgctgtgtggtgagcgaagggcttaagctgggtatctccgcaatggtgactctgtactacccgactcatgcacatcttggcctgccagagcctcttttgcatgccgatggttggctgaatccaagcactgctgaagcgttccaggcatacgcaggactctgttttcaagaactgggcgacctcgtgaagttgtggattaccatcaacgagcctaataggctgtccgacatttacaatcgatcgggaaacgatacctacggagcagcccacaacctgctggtggcacatgcactcgcatggaggctttatgatcgccaattccggccatcccagagaggagcagtgtccctctcattgcacgcagattgggcggaacctgcaaacccctacgccgactcacactggcgtgcagcagaacgttttctgcaatttgaaattgcctggttcgcggaacccctgtttaagaccggtgattaccccgcagcaatgagggaatacatcgcgtctaaacatcgacggggtctttcctcttcggcactcccgagactgactgaagccgaacgacgtttgctgaaggggactgtggacttctgcgcactgaaccacttcaccactaggtttgtgatgcatgaacaactcgctggatctcgctacgattcagacagagacatacagttcctgcaagatattactcgtctttcatccccgactcgactggcagtcatcccatggggtgtgcgcaaacttcttcgctgggtccgccgcaattatggagacatggacatttacatcactgcttccgggattgatgatcaggcacttgaggacgaccggcttagaaagtattacctcgggaagtacctccaagaggtgctgaaagcatacttgattgacaaagtgcgaatcaagggttactacgcctttaagctcgcagaggaaaagtccaaaccacggtttggctttttcacgtccgatttcaaagcaaagtcctcgatccagttctacaataaggtaatatcatcccggggtttcccctttgagaattcatcgtcgcgctgtagccaaacccaggaaaacaccgagtgcacggtgtgcctgtttctcgttcagaagaaaccacttatctttctgggatgttgctttttctccactttggtgctcctgctctcgattgcgatattccaaagacaaaaaagacggaagttttggaaggccaagaacctgcagcatattccactgaaaaagggaaaacgcgtcgtgagc

SEQ ID NO: 250620 - DNA, 3132 bp, Artificial Sequence
  Description of Artificial Sequence: Synthetic coding sequence
atgaagcccggatgcgcagcaggcagccctggaaatgagtggatatttttctctacagatgaaataaccactcgatatcgcaacacaatgtctaatggggggcttcagcgctctgtcattctgtctgctctgatcctgctgcgggccgtcaccggtttcagcggggatgggcgagccatatggtcaaagaacccaaattttacacctgtcaatgaatctcagctcttcctttatgatactttcccaaagaacttcttctggggaatagggacgggcgccctgcaggtcgagggctcctggaaaaaagacggaaaagggccatcgatttgggatcacttcatccatacacacctcaagaacgtttcctctaccaatggcagttccgacagctatatttttctcgagaaagacctgtccgccctcgactttattggtgtgagtttttatcagtttagtattagttggccccgactcttcccggatggtatagtgaccgtcgctaacgcaaagggactgcagtactactccactctgctcgatgctctagtgctgagaaacatcgagcccatagtcactctttatcactgggatcttcccctggcgctgcaggagaaatacggtggttggaagaatgacacgattatcgatatttttaatgactacgccacttattgctttcagatgtttggtgacagggttaaatactggatcaccattcacaatccctacttggtggcgtggcatgggtacgggactggcatgcacgcaccaggtgagaagggcaacttggccgctgtttacacggtcgggcataacctaattaaagcacactccaaggtttggcataactataatactcattttagaccccaccagaagggatggttgagcataacccttgggagccactggattgagccgaaccgcagtgagaacacaatggatatcttcaaatgccagcagtccatggtatctgttctaggttggttcgctaaccccattcacggagatggcgactatcccgagggaatgagaaagaaactgttttctgttctcccaattttttccgaagcagagaagcacgagatgagggggaccgctgatttcttcgccttcagcttcggtcctaacaatttcaagcccttgaacacaatggctaagatggggcaaaatgtgagtctgaatctgagagaggctttaaactggatcaagctggagtataacaacccaagaatactgatcgctgaaaacgggtggttcactgatagtcgtgtaaagaccgaggacactaccgccatctatatgatgaaaaactttctgtctcaggtattgcaggcaattcgcctagatgagatccgggtgttcggctacacagcttggagcctgctggatggatttgaatggcaggatgcgtataccatccggcgcgggcttttctacgtggattttaattccaagcagaaggagcgcaagcccaagagctcggcccattattacaagcagataatccgggagaacggcttttcactgaaggagagcaccccagatgtccagggtcagttcccctgcgacttctcctggggcgtgacagaaagtgttctgaaaccggagagtgtcgcctcgagcccccagttctccgatccccacctgtatgtgtggaacgctactgggaatcgccttctgcaccgcgtggagggagtcaggttgaagactcggcctgcacagtgtaccgacttcgtaaatatcaagaagcaactggaaatgctggcccggatgaaagtcacccactacaggttcgccctggactgggctagcgtactgccaacagggaacctcagtgctgtgaacaggcaggcgctgcgctactacaggtgtgttgtaagcgaggggcttaaactagggatttccgcaatggtgactctatactatccaactcacgctcaccttggcttacctgagccactgcttcatgctgatggatggctcaatccgagtaccgctgaggccttccaggcctatgccggcctttgctttcaggagctgggggatctcgtgaagctatggattactattaacgagcctaacaggctgagtgacatctacaacaggagcgggaacgatacttatggtgccgcacataacctgctagtggcacacgcgttggcttggcgtctctacgataggcagttcaggccctcgcagagaggcgccgtgagtctgtccctgcacgcagactgggccgagccagccaacccttacgccgattctcactggcgggcggctgagaggtttttgcaattcgagattgcgtggtttgctgagcccctgttcaagaccggcgattaccccgccgcgatgagagagtatatcgccagcaaacaccgcaggggcctgtctagctccgctctgcctaggctcaccgaggccgaacgccgtctcctgaaaggcaccgtagacttttgcgccctcaaccactttacaaccagattcgtcatgcatgaacaattggcaggttctcgatacgacagcgatagagacattcaattcctgcaggacataactcgcctgagttctccaactagactcgcggtgattccctggggcgtaaggaagttgctgaggtgggtgcggagaaactatggtgacatggatatttacataacggcaagcggcatagatgatcaggcgctggaagatgatcgactgcggaagtattatctcggcaagtatctgcaggaagtcctgaaagcctatctgatagacaaagtccggattaaaggatactacgcctttaaactcgcagaagagaagagcaaacctcggttcgggttcttcacctccgattttaaggctaagagtagtatacagttctataataaggtgatctcatccaggggatttccctttgagaattcgagttctagatgtagccagacccaggaaaataccgaatgtaccgtgtgtctcttcctggtccaaaaaaagcccctgatattcctgggttgctgttttttttctactctggtgctgctactcagcatcgccatctttcaaagacagaagcgacggaagttttggaaggcgaagaacctgcagcacatcccgctcaaaaagggcaaaagggttgtgagc

SEQ ID NO: 250621 - DNA, 3132 bp, Artificial Sequence
  Description of Artificial Sequence: Synthetic coding sequence
atgaaacctggctgtgccgctggtagccctggcaatgaatggatattctttagcaccgacgaaattaccactcgatacaggaatactatgtctaacggtggtttgcagcgctcagtgatcctgagcgcacttattctgctgcgggcggtgaccggattctcgggagatgggagagcaatctggtcaaagaacccaaactttaccccggtgaacgagtcgcaactgttcctttacgacactttccctaagaatttcttttggggcatcggcacgggtgctctgcaagtggaaggatcctggaagaaggacgggaagggaccttcgatatgggatcatttcattcatacccaccttaagaacgtgtcgagcactaacggatcgtcagattcgtacatttttcttgaaaaggatctgtccgcacttgatttcatcggtgtctcgttttaccagtttagtataagctggcctagactgtttcctgatgggattgtgactgtggcaaacgcgaaggggctccagtactattcgaccctgctcgatgccctggtgttgaggaacattgaacccatcgtcactctctaccattgggatctgccattggcccttcaggagaaatacggaggatggaagaatgataccatcattgacattttcaatgattacgcaacttattgtttccaaatgtttggagatcgtgtcaagtattggatcaccattcataatccctaccttgtggcgtggcacggctacggtactgggatgcatgctccaggggaaaagggaaatctggcagcagtttacactgtgggacataatctgataaaggcgcattccaaggtttggcataactacaacacccattttaggccacatcaaaagggctggctgagcattaccctcggatcccactggattgaaccaaacaggtcggagaacactatggatatctttaagtgtcaacagtctatggtttcggtgctcggatggtttgccaatcctatccatggtgatggggactacccagaagggatgcgcaagaaacttttttcagtgctgcctatcttttcagaggcagaaaaacacgaaatgcggggcactgccgacttttttgcgttcagctttgggcccaacaatttcaaaccactgaataccatggcgaagatgggacagaatgtgtcactcaacctgagggaggcactgaactggattaagctggaatacaataatccccgaatcttgatcgctgaaaatggctggttcactgattcacgtgtaaagactgaggacactaccgccatttacatgatgaagaacttcctttcccaagtcttgcaagccatacgactggacgagattagagtgttcggatacacggcgtggtcacttctggatggttttgagtggcaggatgcatacactattcgccgcggactgttctatgtggactttaactccaagcaaaaggagcgcaaaccaaagtcatcagcacactactataagcagattattcgcgaaaacgggttctccctcaaagagagcacgccagatgtgcaggggcaatttccctgcgacttttcatggggagtgaccgaatccgtcctgaagcccgaatctgttgcatcatcgcctcaattttctgatccccatctctacgtgtggaatgccactgggaaccggcttctgcatagagtggagggtgtgcgtcttaagactagacccgcacagtgtaccgactttgtgaacataaagaagcagctggagatgctggcgagaatgaaggtgacgcactaccgcttcgcacttgattgggcatcagtgctgcccaccgggaacctgtcagcagtgaaccgccaggcactgagatactaccgttgcgtagtctcagagggattgaaactcgggatttcagcaatggtgaccctgtactaccccactcatgcacatctgggccttccagaacctcttctgcatgcggatggatggctgaacccgtccacggctgaggcctttcaggcctacgcaggcctgtgttttcaggaacttggcgacctcgtgaaactttggataaccattaacgaacccaacaggctctccgatatctataatcgctcagggaatgacacttatggagcggcacacaacttgctggtggctcacgcacttgcatggcgactttacgaccggcagttccggccttcgcaacgtggagcagtgagcctgagcctccatgcagactgggcagaaccagccaacccttacgcagactcacattggcgggcagcggaacgcttcctccagtttgaaattgcatggtttgcagaaccccttttcaagaccggtgactaccctgcagcaatgcgtgaatacatcgcgtccaaacatagaagaggacttagcagctccgccttgcctagactgaccgaagcggaacgcagactcctgaaaggaactgtggatttttgcgcccttaaccatttcactaccaggttcgttatgcatgaacagcttgcggggagcagatacgattcggatcgggatatccagtttcttcaggatattactagactctcgtcgcctactcgccttgcagtgatcccttggggggtgcggaagctcctgcgctgggtccgccgaaactatggtgatatggacatctacataaccgccagcggtattgatgaccaagcactggaggacgatagattgcggaagtactacctgggaaagtatctgcaagaagtcctgaaagcatacctgatcgacaaggtgcgtattaagggttactacgcatttaagctggcggaggaaaagtcaaaacctcggtttggttttttcaccagcgactttaaagcaaagtcgtcgatccagttttacaataaggtcatttccagccgcggttttccctttgagaactcgtcgtcccggtgttcacaaactcaagaaaataccgagtgcaccgtgtgtctgtttcttgtccaaaagaagcctctgatctttctcggatgttgctttttctccacgctggtccttctgctttcgatcgccatatttcaacgccaaaagagaaggaaattctggaaagccaagaatcttcaacacatcccattgaagaaagggaagagagtcgttagc

SEQ ID NO: 250622 - DNA, 3132 bp, Artificial Sequence
  Description of Artificial Sequence: Synthetic coding sequence
atgaagccgggttgcgccgcagggagcccggggaacgagtggatctttttctcgaccgacgagattaccaccagataccgcaataccatgtccaatggaggattgcaacggagcgtcatcctgtcagcgcttattctgctccgcgcagtgactggcttctcgggagatgggcgcgcgatctggtccaagaatcccaacttcacccccgtgaatgagagccagctgttcctctacgatacctttccgaagaactttttctggggcatcggaacgggggccttgcaggtggaggggtcgtggaagaaggacgggaaaggcccatcgatttgggaccacttcatccacactcatctgaagaacgtgtcatcaactaacggaagtagcgattcatacatcttcctcgaaaaggatttgagcgccctggacttcattggagtgtccttttaccagttttccatctcgtggccacgcctgtttccagatggcatcgtgactgtcgccaatgctaagggcctccagtactacagcaccctcttggacgcccttgtgctgcggaacatcgaacccattgttactctttaccactgggacctgccgctggccttgcaagagaaatacgggggatggaaaaatgatactatcatagacatcttcaacgattacgctacctactgcttccaaatgtttggagatagagtgaagtattggatcaccatccacaatccgtacctggtggcctggcatggctacgggactggaatgcacgcgcccggcgagaagggaaacctcgcggcggtgtatacggttggacacaatctgatcaaggcccattcaaaagtgtggcacaactataacactcacttcagaccgcatcaaaaaggctggctctccatcacccttggctcacattggatcgagcccaacagatccgaaaacaccatggatatcttcaagtgccaacagagcatggtgtccgtgctgggatggttcgccaacccgatccatggagacggagactaccctgaaggcatgaggaagaagctgttcagcgtccttccgatcttctctgaggccgaaaagcacgagatgcggggcaccgctgatttctttgcattttcgtttggaccgaataactttaagccgctgaacactatggctaaaatgggtcagaatgtctcgcttaacctgcgcgaggcactgaactggattaagctggaatacaacaaccctcggatcctgatcgctgagaatggatggtttactgactcgcgcgttaagaccgaggacacgaccgccatctatatgatgaagaatttcctgagccaggtgctgcaggcaatacggcttgatgaaatccgcgtctttggatacactgcctggtcgctccttgatggattcgaatggcaggatgcatacaccatcaggagaggactgttctatgtggactttaactcgaagcaaaaggagcggaaaccgaaatcctcagcccactactacaagcaaatcatccgagagaacgggttcagcctcaaggaatcgactccggatgtgcaaggacagttcccatgcgacttctcctggggggtgactgagtcggtgctgaagccagaatcagtggcatccagccctcagttctccgatccacatctgtacgtctggaacgccaccggaaacagactgctgcaccgggtggagggagtgagactgaaaacccggccggcgcaatgcacggacttcgtgaacatcaagaagcaactcgagatgcttgctcgcatgaaagtcacccattacaggttcgcactggactgggcttcggtgctgccgactggcaacctctccgccgtgaatcggcaggcgcttagatactaccgctgtgttgtgtcggaggggctgaaactgggaatcagcgccatggttaccttgtactaccccacccacgcacacctgggattgcctgaacctctgctccatgccgacggatggcttaacccttcgactgctgaagccttccaagcatatgctgggttgtgctttcaagagctgggcgacctcgtgaaactctggatcacgatcaatgaaccgaatcgattgtcggacatctacaatagatcggggaatgacacttatggagccgcccacaacctcctggtggcgcatgcgctggcctggaggctgtatgacaggcaattccggccgtcacagcggggagcagtgtcactgagcctgcacgccgactgggcggagccggccaatccatacgctgactcccactggcgcgcagcggagagattccttcagtttgagatcgcttggttcgcagagccgctgttcaaaacgggcgactacccggctgcgatgagggagtacattgcctcgaagcaccgccgaggcctctcctcctccgctctcccacggctgactgaggctgagagacgcctgctcaagggaactgtggatttctgcgcactgaaccactttaccactcgcttcgtcatgcacgagcagctggctggaagccgatacgactctgatagagacatccagttcctgcaggacatcactcggttgtcctcgccaactcgcctcgcggtgatcccgtggggcgtgagaaagctgttgcgttgggtgcggaggaactacggtgatatggacatttacatcactgcctcaggaatcgatgatcaagctctcgaagatgaccgcctgcggaagtactacctcggaaagtacctgcaggaggtgttgaaggcttatctgatcgacaaggtcaggatcaagggatactacgccttcaaactggccgaagaaaagagcaagccgcgattcggatttttcaccagcgactttaaggctaaatcctcgattcagttctacaataaggtgatcagcagccgcggcttccctttcgaaaactcgtcgtcgcgctgctctcaaactcaagagaacactgaatgcactgtctgcctgttcctcgtgcagaagaagccactgatcttcctgggctgttgcttcttctcgaccctggtgttgctgctgtcgatcgcgatcttccagcggcagaagagacggaagttctggaaggctaagaatctgcagcacatccctctgaagaagggcaagagggtggtgtcg

SEQ ID NO: 250623 - DNA, 3132 bp, Artificial Sequence
  Description of Artificial Sequence: Synthetic coding sequence
atgaagcccggttgcgcagctggtagtcctggcaatgaatggattttttttagtactgacgagatcacaaccaggtacagaaatactatgagcaacggtggactgcaaaggtcagtaatcctcagtgctctgatccttcttcgcgcagtcaccggcttcagcggagatggccgcgcaatttggagcaagaatcccaatttcacccctgttaacgaaagccagcttttcttgtacgatacattccccaaaaacttcttctggggtatcggaaccggtgccctccaagtggaaggttcatggaagaaggacggtaagggcccttcaatctgggatcatttcatccacacacaccttaagaacgtatcttccactaacggtagctctgattcttacattttccttgagaaggatctgagcgcactggacttcatcggagtttccttctatcagttcagtatctcttggccccgcctgttccctgacggtatcgtgaccgtggcaaatgccaaaggcctgcaatattactctactctgttggacgctctcgtgttgcgcaacatcgaacctattgtgaccctgtatcactgggacctgcctctggccctgcaagaaaaatacggcggctggaaaaacgacacaattattgacatcttcaacgactacgctacttactgcttccagatgtttggagatcgtgtgaaatactggatcaccatccataacccttaccttgtggcttggcatggctatggaacaggcatgcatgcccctggagagaaaggcaacctcgcagctgtctacactgttggtcacaatttgatcaaagcccacagtaaggtctggcataattacaatactcacttcagacctcaccagaaaggttggcttagcattacactgggcagccactggattgaacctaatcgtagtgagaacactatggacatctttaagtgccagcagagtatggttagcgtcctgggttggtttgccaaccctattcacggagacggtgactatcctgagggcatgaggaagaaattgttctccgtcctgcctattttctcagaagccgagaagcacgagatgcgtggtacagccgatttctttgcttttagcttcggacctaacaattttaaaccccttaacactatggccaagatgggacaaaacgtctccttgaatctcagagaggccttgaattggatcaagctggagtataacaatccccgcattttgatcgcagagaacggatggttcaccgactccagagtcaagacagaagacacaactgccatatatatgatgaaaaatttcttgagtcaggtactgcaagccatccgccttgacgaaattagggtattcggatatactgcatggtccctgctggacggttttgagtggcaggacgcttacaccatcaggcgtggcttgttttacgtcgactttaactccaagcagaaagaaaggaaacccaagtccagcgcccactattacaaacagatcattagggagaacggtttctctctcaaggagtcaacaccagatgtgcagggccagttcccttgcgactttagctggggagtgaccgagtccgtgctgaaacccgagtccgttgcctcatctcctcaattttctgatccccatctttacgtctggaacgccactggtaaccgtctgttgcacagggtggagggcgtaagattgaagactagacctgcacaatgtacagactttgtcaatatcaagaaacagctcgaaatgctcgctcgcatgaaggtcactcactacaggttcgccttggattgggcctctgttctccctactggtaaccttagcgctgtaaacaggcaggccctccgttattaccgctgcgtggtctcagaaggcctgaagctgggcatctctgccatggtgacactgtactatccaacacatgctcacctcggactgcctgagcctcttttgcatgctgatggctggctgaatccttctaccgctgaagctttccaagcctatgctggtctgtgcttccaggagctcggtgatcttgttaagctctggattaccatcaatgagccaaacaggctgtccgacatctataaccgcagcggtaacgacacttacggtgcagcccataatctgttggttgctcatgcacttgcatggcgtttgtatgaccgccagttcaggcccagccagaggggcgccgtatccttgtctttgcacgctgattgggccgagccagctaacccctacgccgactcccactggcgcgctgccgagcgtttcctccaattcgagatcgcatggttcgctgagcccttgtttaagacaggtgactatcctgcagccatgagggaatacatagcttccaagcacaggcgtggcctttcatcttctgctcttccaagactcaccgaggctgaacgtcgccttctgaagggtacagtggatttttgcgccctgaaccatttcaccacaagatttgtgatgcatgagcagctcgctggatctcgttatgacagcgatagagacatccagttcctgcaagatatcaccagactctcctctcccactcgcttggctgtgatcccttggggcgttaggaagttgctccgctgggtcaggcgtaactatggtgatatggatatatacataaccgcctcaggtatcgatgaccaagccctggaggatgacaggctgcgtaaatactacttgggtaaatacctccaagaggtgttgaaggcctatctcattgacaaggtgaggataaagggctactacgcattcaagttggccgaggagaagagcaagcctaggttcggcttttttacctcagacttcaaagcaaagtcatccatccagttctataacaaggtgatctccagtaggggattccccttcgaaaacagctcttctcgttgctcacaaacccaggaaaacacagagtgtactgtatgtctctttcttgtgcaaaagaagcctctcatcttcttgggctgttgcttcttctctacactggtcctcctcctctccatcgctatttttcagcgtcaaaagcgtcgcaagttctggaaggcaaagaaccttcagcacatccctctgaagaaaggaaaacgtgtggtcagc

SEQ ID NO: 250624 - DNA, 3132 bp, Artificial Sequence
  Description of Artificial Sequence: Synthetic coding sequence
atgaagcctggatgcgctgcggggagccccggtaatgagtggatatttttttcgaccgacgagataacaacaaggtaccggaataccatgtccaatggaggcctgcagcgttccgtgatcctttcggccctgattctgctccgagcggttactggcttctcaggtgacgggcgcgccatttggagcaagaacccaaatttcactccggtcaacgagtcacagctgttcctgtatgacaccttcccgaagaattttttctggggcattggcacgggagccctgcaagtggagggcagttggaagaaagacggcaagggccccagtatatgggaccatttcatccacacacatctcaagaatgtgtcctcaaccaacggttcgagcgactcttacatattccttgagaaggacctgtcagccctggactttatcggcgtgagtttctatcaatttagcatctcgtggccgcgactgtttccggatggcatagtgaccgtcgccaatgcgaagggccttcagtattactcgaccctgcttgacgcactggttctgcgcaacatcgagccaatcgtgacgttgtatcattgggatctgcctctggccttgcaggagaaatacggagggtggaagaacgacacgattattgatatatttaacgattacgctacttattgttttcagatgtttggggatcgggttaagtactggattacgattcacaacccgtaccttgtcgcctggcacggttacggcacgggaatgcatgccccaggggagaaaggcaacttagcggcggtttacaccgtcgggcacaacctcattaaagcacatagcaaggtgtggcacaactacaacacccattttaggccgcaccagaaggggtggctttccataactttgggttcccactggattgagccaaatcgatctgagaacacgatggacatcttcaagtgtcaacaatccatggtgagcgttctgggttggtttgccaaccctatccatggagatggcgattacccagaggggatgcgtaagaagctgttctctgtactccccatcttctccgaggctgagaagcatgagatgagggggacagccgatttttttgcatttagtttcggaccaaacaatttcaagcctctcaatacaatggcgaagatgggccagaatgtctctctgaacctccgcgaggcactgaattggataaagctggagtacaacaacccccgaatattgatagctgagaacggctggtttaccgatagccgggtgaaaaccgaggatacgaccgccatctacatgatgaagaatttcctgtcccaagtactgcaggccattcgcctggatgaaattagggtgttcggatatacggcctggtcgctactcgacggctttgagtggcaggatgcatacacgatccggcgtggactgttttatgtggatttcaatagtaagcaaaaagagcggaagcccaaatcttcagcccattactacaagcagataatcagagagaacggtttctcccttaaggagagcaccccagatgtccaaggtcagttcccctgtgatttttcgtggggggtgactgagtccgtgttgaagcccgagagcgtcgcgtcaagtcctcaattttccgatccacatctgtacgtgtggaacgcgaccggcaatcgactgctgcatcgagtggaaggggtgaggcttaagacgcgtccagcgcagtgcacagatttcgtcaacatcaagaagcaactcgagatgctggccaggatgaaagtcacccactaccgctttgcacttgactgggcctctgtcctgcccacaggtaacttaagcgccgtcaatcgccaagcactgcgctactaccgttgcgtcgtaagtgaaggcttgaagctaggaattagcgcgatggtcacattgtactatcccactcacgctcatttgggcttgcccgagccactgctgcatgccgacggttggctgaacccgagtactgccgaggcgtttcaggcctacgctggcttgtgcttccaagagctgggagacctcgtgaaattgtggataactatcaacgagccaaatcgcctgtcagacatatacaacaggtcaggaaacgacacgtatggagctgctcacaacttacttgtggcccatgccttggcctggcgcctgtacgacaggcagttccgcccctcgcaacgcggagcagtaagtttgtccctgcacgctgattgggcggaaccggccaacccatatgccgattcgcactggcgggccgccgagcggttcctccagttcgagattgcgtggttcgcagagcccctattcaagacaggagattatccagcagctatgcgcgagtacatcgcatccaaacaccgtagaggcctgtcgagttcggcactaccgagactgaccgaggcggagcggcgtctgttgaagggcacggttgatttttgtgccctgaatcattttactacaaggtttgtgatgcatgagcagctggcaggcagtcgctatgatagtgaccgcgacatccagttcctccaggacatcacgcgactgagctcgcctacgaggctggccgtgattccctggggcgtccgtaagttgctgcggtgggtgcgtcggaattatggcgacatggatatttacatcaccgcctctggcatcgatgatcaggccctcgaagacgatcgtctccggaaatactatctgggaaagtacctacaggaggtgttaaaagcctacctgatcgacaaagttcgaatcaaaggttactacgccttcaagctggccgaagagaagtcgaagcctcgctttggcttcttcacttccgactttaaggcgaaaagcagcatccaattctataacaaggtgatctcctcgcgaggcttcccgtttgagaactcatcctcgcggtgctcgcagacacaagagaacaccgagtgcacggtgtgcctgtttctggtccaaaagaagcccctgatcttcttgggctgctgcttttttagcacgctagtgttgctcctatctatcgcaatctttcaacgacagaagcggagaaaattctggaaagccaagaatctgcagcacatcccgctcaagaaaggcaaaagggtggtctcg

SEQ ID NO: 250625 - DNA, 3132 bp, Artificial Sequence
  Description of Artificial Sequence: Synthetic coding sequence
atgaagccgggatgcgcggccggatcaccaggcaacgaatggatattcttctctacagacgaaattaccacccgatatcggaatacaatgagtaacggcgggctccagcgctctgtcatcctgagcgctctgatcctgctcagagccgttacagggttcagcggcgacggccgagctatctggagcaaaaaccccaacttcacccccgttaacgaaagccagttgtttctgtatgacacattccccaagaacttcttttggggcattgggactggtgcactacaggtcgaaggcagctggaagaaggacggaaagggcccttcaatctgggatcatttcattcatactcacctgaagaatgtttcttccaccaacggatcctcagattcatacatattccttgagaaagacttatcagctttagactttattggggtcagtttctaccagttcagcatttcttggccacgcctcttcccagatggaatcgtgacagtggccaacgcaaaggggctccaatactactctactttactggatgccctggttttgcgcaatatagagccgattgtgactctgtaccattgggatctgcccttagcactgcaggaaaagtatggtgggtggaagaacgacacgatcatcgatattttcaatgactatgccacttattgtttccagatgttcggcgatcgggtaaagtactggatcaccatccacaatccatatctggtggcatggcacggctacggcaccggcatgcacgcacccggcgaaaagggaaacctggccgccgtgtatacagtagggcataacctgataaaggcgcacagcaaggtctggcataattataacacacactttcggcctcaccagaagggttggctttctatcaccctgggctctcactggatagagcccaataggtcagaaaatactatggacatctttaagtgccagcagagcatggtcagtgtactgggctggttcgcaaatccaattcacggtgatggggactacccggaaggtatgcgtaagaagctcttttcagtgctgcctattttttcagaggccgagaaacacgagatgcgaggaaccgcagatttctttgctttttcatttggccctaataactttaagccgcttaacactatggccaaaatgggacagaacgtgtctttgaatctgcgtgaagctctaaactggattaaactagaatacaacaacccgcggatacttatcgctgagaacggatggttcactgactccagagtcaaaactgaagacaccacagcaatctatatgatgaagaacttcctctctcaggtcctgcaagcaatccggctggacgagatccgcgtgtttgggtacacagcatggtcacttctggacggctttgaatggcaggacgcctatactatacgacgagggctattttacgtggattttaactctaaacagaaagagagaaaaccgaagtcttccgcccactattacaaacaaattatcagggagaatggattcagtctcaaggaatccaccccagacgtacagggccaattcccctgcgatttttcctggggagtcaccgaaagcgtattgaagcctgagtcagtcgcctcatcaccgcagttctctgatccacacctgtatgtatggaacgcaacgggaaatcggctactccatagagtggagggcgtgcgcttgaagacacggccggctcagtgtacggattttgttaatattaagaaacagctggaaatgctggcgagaatgaaggtgacccactatcgctttgccctcgactgggccagtgtcctccccacaggtaacctgagtgccgtcaatcggcaggcactgcggtactataggtgcgtagttagcgaaggcctgaagctaggtatcagcgccatggtaaccctgtactatcccacccatgcccatctgggactgcctgaaccgcttctccacgcagatggctggctcaatcctagcactgcagaagcatttcaggcatatgcaggcctgtgcttccaggaactaggcgatctggttaagctttggattacgatcaacgaacctaaccgcctgtctgacatctacaatcggagcggcaacgatacttatggagcagctcataacctgctcgtcgcacatgcactcgcttggcggttgtacgataggcaatttagaccatcgcagcgcggcgctgtgagtttaagcctccatgcagactgggccgagccagctaacccgtatgccgattcccactggcgcgctgctgaaaggttccttcagttcgagatcgcctggtttgcggaacctctgtttaaaaccggcgattaccccgcagctatgcgggaatatattgcctccaaacaccggagaggactaagtagttcagcactgcccaggctcacagaggcggaacgacgtcttctgaagggaactgtggatttctgtgctctgaaccacttcaccacccgcttcgtcatgcatgaacagctggctgggagcagatatgactctgacagagacatacagtttctgcaagacatcacccgacttagctcaccaaccaggctagctgttatcccatggggcgtgcgcaagctcctgaggtgggttcgcagaaattacggcgacatggacatctacatcactgcatccggaatcgacgatcaggccctggaagatgacaggcttcggaagtactatctgggtaaatacctgcaggaggtcttgaaagcgtaccttattgacaaagttagaatcaaggggtactatgcgtttaagcttgccgaggagaagagcaaaccgagatttggattttttaccagtgattttaaggcaaagtcgtccattcagttctataacaaggtgatcagttctcgaggcttcccttttgagaacagctctagtaggtgctcccaaacccaagagaacaccgagtgcaccgtgtgtctgttcctcgtccagaagaagcctctgatcttcctgggttgctgcttcttttccacacttgtgctgctcttgtcaattgctatctttcagagacagaaacgccgaaagttctggaaggcaaaaaacctgcagcacattcctttgaagaaggggaaacgagtggtttcc

SEQ ID NO: 250626 - DNA, 3132 bp, Artificial Sequence
  Description of Artificial Sequence: Synthetic coding sequence
atgaagcctggatgcgctgcgggctcaccgggcaacgaatggatcttcttctcgacggacgaaatcaccacgcggtaccgcaacactatgtcgaacggcggactgcagcgctcagtgatcctttcggctttgatcctgctgagagcggtgactggtttcagcggagacgggagagccatctggtccaagaaccccaactttacccccgtaaacgaatcgcaactcttcctgtacgacacctttccaaagaacttcttctggggaatcggaaccggcgccctccaggtggagggaagctggaagaaggatggaaaggggccgtcgatttgggaccacttcatccatactcacctcaaaaatgtgagctctacgaacggaagctcggattcgtacatcttcctcgagaaggacttgtcggcgctcgatttcatcggagttagcttctatcagttttccatctcgtggcctaggctgttccccgacggcatcgtgactgtcgctaacgccaagggactgcagtactattcaactctgctcgatgcactcgtgcttagaaacatagaaccgatcgtgacgttgtaccattgggacctcccgctggcgctgcaggaaaagtatggaggttggaagaatgacacgatcatcgacatcttcaacgactacgcgacgtactgtttccaaatgttcggagatagagttaagtactggattactatccacaatccatacctcgtggcctggcacggatacggcacggggatgcatgcacccggagagaaaggaaatctggcagccgtttacacggtaggacataacttgatcaaggctcattccaaggtgtggcacaattacaacacccatttcaggcctcaccagaaggggtggctgtccatcaccctgggatcccactggatagaaccaaaccggtcggagaatactatggatatctttaagtgtcagcagtcgatggtgtctgtgctgggatggtttgcgaatcctattcatggagatggtgactaccctgaggggatgcggaagaaacttttttctgtgctgccgatcttctctgaggccgaaaagcacgagatgcggggcactgcggacttctttgccttctcatttggcccaaacaacttcaaacccttgaacaccatggctaagatgggacagaacgtcagccttaacttgagagaagcactgaattggatcaaacttgagtataacaatccgaggatcctgatcgcagagaacggttggttcaccgatagtagagtgaaaactgaggacactactgccatctacatgatgaagaattttctgtcccaagtcctccaagcaatcagactggacgaaatccgcgttttcgggtacaccgcatggtccctcctcgatgggttcgagtggcaagacgcctacaccatccggaggggactgttttacgtggacttcaactcaaagcaaaaagaacgcaagccgaagagctcggcgcactactataagcagatcatccgggaaaacggcttctcactgaaagaatcgaccccggacgtccaaggtcagttcccatgcgatttcagctggggcgtgaccgaatcggtgctcaagccggaatccgttgcgtcatcccctcagttttctgatccgcacctgtacgtgtggaacgccaccggcaaccgactcctgcaccgggtggagggcgtgcgactcaaaaccagaccagctcaatgcaccgacttcgtgaacatcaaaaaacaactggagatgctggcgcgcatgaaggtaactcactaccgcttcgccctggactgggcctccgtgttgcccaccggaaacttgtccgcggtgaacaggcaagctcttcgctactaccggtgcgtcgtgtcggaaggactcaagctggggatttccgccatggtgactctttactaccctacgcatgcgcatctcgggctgcccgagcctctgctccatgccgatggttggctgaatccgtcaaccgccgaagccttccaggcatacgctggactgtgcttccaggaactgggagatctcgtgaaactgtggatcaccatcaacgaaccgaaccggctgtccgacatctacaaccgatcaggaaatgacacttacggagcagcacataatctgctggtggcgcacgccctggcatggcgcttgtacgacagacaattccgcccatctcaacggggagcggtgtcactttccctgcacgcagattgggctgaaccggctaacccgtacgccgacagccattggagggcagcagaaagattcctgcagttcgagatcgcatggttcgccgaacctctgttcaaaactggtgattacccagcggccatgagagagtacatcgcatccaagcacagacgcggccttagctcttcagccctcccccgcctgactgaggctgaacgccggctgctgaaagggacggtcgatttttgcgccctcaatcacttcaccacccggttcgtgatgcacgagcagttggctggatcgcgctacgacagcgatcgagacatccaattcctgcaggacatcacccgactctcctcacccaccaggttggccgtgatcccgtggggcgtccggaagctgctgagatgggtgcgccggaattacggagatatggacatctacataaccgccagcgggatcgatgaccaggccctggaggatgacaggctgcgtaaatactaccttggcaagtacctccaggaagtgctgaaagcctaccttattgacaaggtccggatcaagggttactacgcgtttaagctcgccgaagaaaagtcgaagccgcgctttggtttcttcacttccgactttaaggcaaaatcgtcgattcagttctacaataaggttattagctcacgcggatttcctttcgagaattcatccagccgctgctcgcaaactcaggaaaatactgagtgtactgtctgtctttttctggtgcagaagaagcctctcatcttccttggctgctgctttttctcaacccttgtgctgctgctgtccatcgccatcttccaacgccagaaacggcggaagttttggaaggcgaaaaaccttcagcacattccgctcaagaaaggcaagagggtcgtttcc

SEQ ID NO: 250627 - DNA, 3132 bp, Artificial Sequence
  Description of Artificial Sequence: Synthetic coding sequence
atgaagccaggatgcgcagccggctccccgggcaacgagtggatcttcttctccaccgacgagatcacgacccgatacagaaacactatgtcaaacgggggccttcagagaagcgtgatcctgtccgccttgatcctgttgcgcgccgtgaccgggtttagcggggacggaagagcaatctggtcaaagaatccgaacttcactccggtgaacgagtcccagctgttcctgtacgacaccttccctaagaacttcttctggggaatcggaactggggcattgcaagtggaaggctcatggaaaaaggacggaaaaggaccatcgatctgggatcacttcatccatactcatctgaagaatgtgtcgagcacgaacggatcctccgattcgtacattttcctcgagaaggacttgagcgctctcgactttatcggagtgtcattctaccagttttctataagctggccgcgcctcttccctgatggcatcgtgaccgtggcaaacgccaagggactgcagtactactcgaccctgctcgatgctctcgtgctgcggaacatcgagcctatcgtgaccttgtaccattgggacctcccgctggccctgcaagagaaatatggtggatggaagaacgataccatcattgacatcttcaacgattacgctacctactgctttcagatgttcggcgatcgtgtgaagtactggatcactatacacaacccgtaccttgtggcatggcacggttacggcaccggcatgcacgcccccggagaaaaggggaatctggccgccgtgtacaccgtgggacacaacctgatcaaagcccacagcaaggtctggcataactacaacacccacttccgcccgcaccagaagggttggctcagcatcaccctcggttcacattggatcgaacctaacagatcggaaaatacgatggatatcttcaagtgtcaacaatcaatggtgagcgtgctcgggtggttcgcaaatccaatccacggtgacggcgactacccggagggaatgaggaagaaactgttctccgtgctccccatcttttcggaagcagaaaaacacgaaatgcgggggactgccgacttcttcgccttctccttcgggccgaacaacttcaaacccctcaatactatggcgaaaatgggccagaatgtctcactgaacttgcgggaggctctgaactggatcaagttggaatacaacaatccgcggatcctgatagcggaaaacggctggtttacggacagccgcgtaaagactgaggacactacggcaatttacatgatgaagaatttcctctcgcaagtgctgcaggcgatcagattggatgagatccgggtgttcggatataccgcgtggagcttgctggacggatttgaatggcaagacgcctacactatccggcgggggctcttctacgtggatttcaatagtaagcaaaaggaacggaagccgaaatcatctgcgcattactacaagcagattatccgcgagaacggattctccctgaaggagtcaactccagatgtccagggacaattcccatgcgacttttcgtggggagtcactgagtcggtgctgaagcctgaaagcgtggcaagctcgccacagtttagcgacccgcacctctacgtctggaacgccaccggcaatagactgctgcacagagtggagggcgtgaggctgaaaactcggcctgcccaatgcaccgatttcgtgaacatcaaaaagcagctggaaatgctcgctcgcatgaaagtgacgcactataggttcgcattggactgggcatcggtgttgccgaccggaaatctttccgctgtaaacaggcaggctctgcgatactaccgatgtgtcgtctctgagggcctgaagctgggtatctcagcgatggtcaccctgtactacccaactcatgcgcatctgggtctgccggaacctctgctccatgccgatggatggctgaatcccagcacggccgaagcatttcaagcctatgcgggcctgtgctttcaggaattgggagatcttgtgaagctctggattaccattaatgagccgaaccggctgtccgacatctacaataggtccgggaatgatacttacggcgccgcacacaacctgctggtggcacatgcccttgcatggcgcttgtacgatcggcagttccggccctcacaaagaggagccgttagcctttccctgcatgcggactgggctgaacctgcgaacccatacgcggactcccactggcgcgccgctgagcggttcctgcagttcgagattgcttggttcgcggaacctctgttcaagaccggagattacccagcggccatgagggaatacatcgcttccaaacaccgccgcggactctccagttcggcgctgccaagactgactgaagcagaacggaggttgctgaaagggactgtcgatttttgcgcactgaatcactttaccactagattcgtgatgcacgaacagctggcgggatccagatacgactcggaccgggacattcaatttctgcaggatattactagactctcgtcgccgactagattggccgtaatcccgtggggtgtgcgcaaattgcttcgctgggtgcggagaaactacggagacatggacatctatatcactgcctcgggaatcgacgatcaggcattggaggacgaccgcctcaggaagtactaccttggtaagtatctgcaggaggtcctgaaagcctacctcatcgataaggtgcgcatcaagggatactacgcattcaagctggcagaagagaagtccaagccgcgctttggtttcttcacttccgatttcaaggcaaagtcatccatccagttctacaataaggtcattagctcccgtggattcccattcgagaattcgagcagccggtgctctcagacccaggaaaataccgagtgcaccgtgtgcctcttcctggtgcaaaagaagccactcatctttctgggatgttgtttcttttccactctcgtcttgttgctctcgatcgctatctttcaacgtcagaagaggcggaagttctggaaagcgaagaatctccagcatatcccactcaaaaaggggaaaagagttgtgtcc

SEQ ID NO: 250628 - DNA, 3132 bp, Artificial Sequence
  Description of Artificial Sequence: Synthetic coding sequence
atgaaaccgggatgcgctgcaggcagcccaggcaatgaatggatctttttttccactgatgaaatcactaccagatatagaaataccatgtctaacgggggacttcaacggagcgtgattctgtctgctctcattctgctcagggcggtcacggggttttctggcgatggccgggccatctggtcaaagaatcctaattttactcctgttaacgaaagtcagttgttcttgtatgatacctttccaaagaactttttttggggtattggaaccggcgcgctgcaagtggaaggctcttggaagaaagatggaaaaggcccttctatttgggatcacttcatccatacgcatctcaagaacgtaagttctaccaatgggagctccgatagctatatattcttggagaaggatctttctgcactggactttatcggcgtgtccttctatcagttcagcatatcatggccgagattgtttccagatggtatagtgaccgtggctaacgccaaaggactgcagtactactctaccctcctcgatgctcttgtgctgcggaacatcgagcccattgttactctctaccattgggacctgcccctggcccttcaagaaaaatatggaggctggaaaaacgatactataatcgatatctttaacgactacgccacgtactgctttcagatgttcggagaccgggtgaaatattggatcactatccacaatccatatctggtagcctggcatggctatggcacagggatgcatgctccaggtgagaaaggaaacctggccgctgtttacacagtgggccacaacctgatcaaagcccactctaaagtttggcacaattacaacacccactttagacctcaccagaaaggctggttgtcaatcaccctcggatcccattggatcgagcctaatcggagcgaaaacaccatggacatctttaaatgccaacagtccatggtttccgtactcggttggttcgccaatcccatacacggcgacggcgattaccctgaaggcatgcggaaaaaactcttcagtgtactgccaattttctccgaggcagagaagcatgaaatgcggggcactgccgacttcttcgcgttttccttcgggccaaataattttaaaccgctgaacactatggcgaagatgggacagaatgtgtccctcaatttgagggaggcactgaactggattaagctcgagtataataacccgaggatcctgatcgcagaaaatggctggttcactgacagcagagtcaagacagaagataccactgccatatatatgatgaagaacttcctgagccaggttcttcaggctatccgactcgatgagatccgggtgttcggctatactgcatggtcactgctcgacggtttcgaatggcaagacgcctacaccattcgaaggggcctgttttatgtggatttcaacagtaaacagaaggagagaaagcctaagagctccgcccactattacaaacaaattatacgagagaacggctttagcctgaaggaaagtacccctgacgttcaggggcagtttccatgcgacttctcatggggtgtcaccgagtcagtgctgaagccggaatccgtggctagcagtcctcagttttctgatccccacctgtatgtgtggaatgccaccggcaaccgactgctgcatcgagttgagggcgtgagactcaagacacggccagcacaatgcacagacttcgtgaacatcaagaaacaactggagatgctggcgagaatgaaagtgactcattataggttcgcactcgattgggcgagcgttctgccaactggcaatctgagtgcagtgaaccgacaggcccttaggtattatcggtgtgtggtatctgaaggcttgaagctgggtatttccgctatggtcaccttgtactaccccacacacgcccacctgggcttgcctgagcccctgctgcacgctgacggttggctgaacccctcaactgcagaggctttccaggcctacgcagggctgtgcttccaggagctgggcgatctggttaagctgtggatcacaattaatgagcctaacaggttgtcagatatctataaccgctccgggaatgacacatatggtgccgcccataatctgttggttgcccacgctttggcctggcgcttgtacgatcgccagttccgccccagccaacgcggtgccgtatcactgtcacttcacgctgactgggctgagcctgccaatccatacgccgactcccattggagagccgccgagagattcctccagtttgaaatcgcgtggttcgccgagcctctgttcaagaccggcgattatcctgccgctatgcgggaatacattgcaagtaaacaccgccggggccttagctcaagcgcactcccaaggttgaccgaagctgagaggcgcctgttgaagggtacggtggatttctgcgcactgaatcattttacaaccaggttcgtgatgcacgagcagctcgccggttccagatacgactccgaccgcgacatacaattcctgcaggacataaccaggctgagcagcccgaccagactcgctgtcattccctggggcgttcggaagctgctgcgctgggttcggaggaattatggtgatatggacatttatataaccgcgtccgggattgacgaccaagcactcgaggatgacagacttaggaagtattaccttgggaaatatttgcaggaggtgctcaaggcttacctgatcgataaggtcagaattaagggctactacgctttcaagctggctgaagaaaagagtaaaccccgcttcggcttcttcacgagcgacttcaaagcaaagtccagcatacaattttataacaaagtaatcagtagtcgggggtttcctttcgagaacagcagttcaagatgctctcagacccaagaaaacactgaatgcacagtatgccttttcctggtgcaaaaaaagcccctgatctttctcggctgctgtttcttctctactcttgtcctgttgctgtccatcgccatcttccagcgccagaagaggagaaagttctggaaggccaagaatctgcagcacatccctctgaagaaaggaaagagggtggtttct

SEQ ID NO: 250629 - DNA, 3132 bp, Artificial Sequence
  Description of Artificial Sequence: Synthetic coding sequence
atgaaaccaggatgtgcagcaggcagcccggggaatgaatggattttcttctccaccgatgaaatcaccactcgttaccgaaacacgatgtcgaatggtggtctgcaacggtccgtgatactgagcgcactgattcttttgagggctgtcaccggattctcgggagatggcagagcaatatggtcgaagaaccctaactttactcccgtcaatgaaagccagctgttcctctatgacacgttccccaagaatttcttctggggaatcggtaccggagctctgcaagtggaaggttcctggaagaaggacggcaaggggccctccatttgggaccactttatccacacgcatcttaagaacgtctcctcgaccaacggatctagcgatagctacattttcctggagaaggatctgagcgcacttgatttcattggcgtgtccttttaccagttttccatcagttggcccagactcttcccagacggaatcgtcactgtcgcaaacgcaaaaggccttcaatactactcgactttgcttgatgcactggtgctgagaaacatcgaaccgattgtcactctgtaccactgggatttgccccttgcgctccaagagaaatacggcggttggaagaacgatacgattattgacatctttaacgactacgcaacctactgttttcagatgtttggtgaccgagtcaagtactggattaccatccataacccttacctggtggcctggcatggatatggcaccggtatgcatgcgcctggcgaaaaaggaaacctggcagccgtgtacactgtgggacataacctgatcaaggcacattcaaaggtgtggcacaattacaatacccattttagaccacaccaaaaaggttggctctccattaccctgggatctcattggattgaacctaacagatcggaaaataccatggatatctttaagtgtcagcagtcgatggtgtccgtcctcggctggtttgctaacccaatccatggggatggcgactaccccgaaggaatgaggaaaaaactcttctccgtgcttcccattttcagcgaagccgaaaagcatgagatgcgggggaccgctgatttctttgcgtttagttttggccctaataactttaaaccacttaacacgatggcaaagatgggacaaaacgtcagccttaaccttcgtgaagccctcaattggatcaagctggaatacaacaatcctagaatccttattgcagaaaacggatggttcaccgattccagagttaagactgaagataccacggcaatctacatgatgaagaattttctctcgcaagtgctgcaagctattcggttggacgaaataagagtgtttggatacaccgcatggtcgcttctcgatggattcgaatggcaagatgcttacactataaggcggggtttgttctacgtggatttcaattctaagcaaaaggagcgtaagcctaagagctccgcacattactacaagcaaatcatcagagaaaatggtttctcccttaaggaatcgaccccagatgtgcagggacaattcccatgcgacttctcctggggagtcaccgagagcgtgcttaagccggaatcggtcgcctcatcgccacaatttagcgatccgcatctttacgtttggaatgctacgggaaaccggcttcttcatcgcgtggaaggcgtgcgcctcaagactcgccccgcccagtgtaccgattttgtcaacattaagaagcagctggagatgttggcacgcatgaaagtcacgcactaccggtttgcgcttgattgggccagcgtccttcctaccggaaacctttcggcagtgaaccgccaagcacttcggtactacagatgcgtggtgtccgaggggcttaagctgggtatctccgcaatggtgactctttactaccctacccacgcgcatctgggactgcctgagccgcttctgcacgccgatggttggctgaacccaagcaccgccgaagcatttcaggcctacgcaggcctgtgtttccaagaacttggggaccttgtgaagctgtggatcaccattaatgaacctaatcgcctgtccgatatctacaatcggtcgggaaatgatacctacggggcagctcacaacttgctggttgcacatgcgctggcatggaggttgtacgatcgacaatttcgcccctcacagcgcggagccgtttccctgtcgttgcacgcggattgggccgagcctgcaaacccgtacgcagattcccattggcgcgcagcagagcgcttcctgcaatttgagatagcatggttcgcagagcctcttttcaagaccggggactaccccgcagcaatgcgggaatacatcgcaagcaaacatagacgagggctgtcgtcgtcagcactccctcgacttaccgaggcagaaagacgactcctgaagggcaccgttgatttctgtgcgctgaaccactttactactagatttgtcatgcacgagcagcttgcaggatcccgttacgatagcgatagagatatccagttccttcaagatattactcgtctgtcgtcccctactcggctggcagtgatcccttggggagtcaggaagttgctgcgctgggtgcggagaaactacggggacatggatatctatatcaccgcgagcggtattgacgatcaagcacttgaagatgaccggttgagaaagtactaccttggaaagtaccttcaagaagtcctgaaggcatacctgattgacaaggtgaggattaaagggtactacgcattcaaactggcagaggaaaaatcgaagccgcgatttggatttttcacttcagactttaaggcaaagtccagcatccaattctacaataaagtcatctcctcaagaggtttcccatttgaaaacagcagcagcagatgctcgcagacgcaggaaaacacggagtgcactgtgtgtctgtttctggtgcagaaaaaacccctgatttttctcggttgctgcttctttagcaccttggtactgctgctctcgatagcaattttccagcgccagaaaagacggaagttttggaaggccaaaaaccttcaacatattcctctcaagaaaggaaaacgggttgtctcg

SEQ ID NO: 250630 - DNA, 3132 bp, Artificial Sequence
  Description of Artificial Sequence: Synthetic coding sequence
atgaaacccggctgtgccgcgggatcccccggcaatgagtggatttttttttctacagacgaaattacgacccggtatagaaataccatgtccaacggtgggttgcagagatccgtaattctgtccgctcttattctgttgcgcgctgttacaggcttttccggcgatggcagagcgatttggtctaaaaacccaaacttcactcctgtcaacgagtctcaactcttcctgtacgacacatttccaaaaaacttcttctggggcattgggacaggagcgcttcaagtcgaaggatcctggaagaaagacggcaagggcccctctatatgggaccactttatccacacacatttgaaaaacgttagtagcaccaatggtagcagcgacagttatatcttcctggagaaagacctttctgctttggactttatcggcgtttcgttttaccaattctctatcagctggcctcgcctgtttccagacggtatcgtgactgtagcaaacgctaaaggcctccagtattactccacacttctggacgccctggtgcttcgcaacattgagcctattgtgacgctttatcattgggatctcccactcgccctgcaggaaaaatatgggggctggaagaacgacacaatcatcgatattttcaatgattatgccacctactgtttccagatgtttggcgaccgagtgaaatactggattactattcataacccatacctagtggcgtggcacggatatgggactggaatgcatgcccctggagaaaaaggcaacctagccgccgtgtataccgttggacacaatctgattaaggcacatagtaaagtgtggcacaactacaacactcacttcagacctcaccaaaaaggctggctgtcaatcaccctcggttcgcattggattgagcccaatcgcagtgaaaacacaatggatatcttcaaatgccagcagtctatggtgtcggtcttgggctggttcgccaacccaatacatggagatggcgattaccccgagggtatgcgcaaaaagctgttcagcgtgctgcctattttttctgaagcagagaagcatgagatgagagggacagccgatttttttgcattttcttttggacccaacaactttaaaccattgaataccatggccaagatggggcagaatgtatccctgaacctccgggaagctcttaattggatcaagctcgagtataataatccccgcattctcatcgctgagaatggatggttcacagattcccgcgtgaaaactgaggatactactgccatatacatgatgaaaaactttctcagtcaggtgctccaggcaatccgtttggacgaaattcgcgtattcgggtacaccgcctggtccctccttgatggtttcgagtggcaggacgcgtacaccatacggcgaggcctcttctatgtagattttaattcaaagcagaaagagcggaagcccaaatctagtgcacattactataagcagattattcgagaaaacgggttttccttgaaggagagcacccctgacgtccagggacagtttccttgtgacttttcttggggcgtaaccgaaagcgtgctgaagccggagagtgtggcctcaagcccacagttctctgatcctcatctctatgtttggaacgctaccggcaaccgactgttacacagggtggagggtgtgcgtcttaagacccggcctgcgcagtgcacggacttcgttaacattaagaagcagctcgagatgctcgcgcgaatgaaagtgacacattaccggtttgcactggattgggcgtcagtactccctacgggaaatttgtcggcagtaaaccgacaagccctccggtactaccggtgcgtcgtcagcgaaggtctaaaactgggcattagcgccatggtgaccttatattaccccactcacgctcatcttggacttcctgaaccgctactgcacgctgacggctggctcaatccgtctactgcagaggcctttcaagcctatgcgggcctttgttttcaagagctgggggatctcgtgaagctgtggatcactataaacgaacccaaccgattgagtgacatttacaacaggtcaggcaatgacacctacggggccgcgcacaatctcttagtggcccacgccctggcatggagactttatgaccggcagttccgcccctctcaacgtggtgccgtgtcactaagtttgcacgcagactgggccgaaccagcaaacccctacgcagatagccattggagggcagcagaacgctttctgcaattcgaaattgcctggttcgccgagccactgtttaaaactggggattatcccgcagcaatgagggagtatattgcctccaaacacaggcggggtctgtcgtcctccgccctgccaaggctaaccgaagcagagcgacgactcttaaaagggacagtagacttctgtgctctcaatcactttaccacccgatttgtcatgcacgagcaactggccggctctcgatacgactccgaccgcgacatccaatttctgcaagacattaccaggctgagctctccaactaggctggcagtgataccatggggcgtacgtaagcttctacggtgggtgcggagaaattacggggatatggatatttacattaccgcgtccggcatagatgaccaggctctagaagacgatcgcctgagaaagtactacctcggaaagtacctgcaggaagtactgaaagcatatctcatagataaggtcagaataaaaggctactatgcattcaaactagctgaggaaaagtccaagcctagattcgggtttttcaccagtgacttcaaagctaagtcatctattcagttctataataaagtgatatcctccaggggatttcctttcgagaacagcagttcccgctgttcacagacgcaggaaaataccgaatgcactgtctgtttattcctggtgcagaaaaagccactcatctttctgggatgttgtttcttttccaccctggtgttactgctgtcaatcgcgattttccagcgtcaaaagcgtagaaaattctggaaggctaaaaaccttcagcacattcctctaaagaaagggaagcgtgttgtgagc

SEQ ID NO: 250631 - DNA, 3132 bp, Artificial Sequence
  Description of Artificial Sequence: Synthetic coding sequence
atgaagcccggatgtgcagctgggtccccagggaatgagtggattttcttctctacagatgagataactacacggtataggaacactatgagtaatggaggtctacaaaggtctgtcatactgtctgctctgatattgctgagggctgtgacaggctttagcggagatgggcgagctatctggtctaagaaccctaattttacgcctgttaatgagtcacagctttttctgtatgacacttttcccaaaaatttcttctggggcatcggcacgggggccctccaagtggaaggttcttggaaaaaggacggcaaaggcccatcaatttgggaccattttatacatactcacctgaagaacgtctcctctactaacggttcttctgactcctacattttcctcgagaaggacctgtccgccctggatttcatcggcgtttctttctatcaattctctatttcttggcctcggctcttccctgatggcattgtgacagttgctaatgctaaagggctccagtactacagcacactgctggatgccttggtgttgcgtaatattgagccgatcgtgaccctgtatcactgggatctgcccttggcactccaggagaaatatggtggatggaaaaacgacacgattatcgacatttttaacgactacgcaacctactgcttccagatgtttggtgacagggttaagtattggattactattcacaacccatatctggtcgcttggcatggttacgggacggggatgcacgcccctggagaaaaaggaaacttggcggcagtgtatacagtcggccataatctgattaaggctcatagcaaggtgtggcacaactacaacactcactttcgcccacatcagaaaggctggctttctatcaccctgggttcccattggattgaaccaaaccgatcggagaacaccatggacatctttaaatgccaacaaagtatggtgagcgtcctagggtggttcgccaatccgattcacggagatggggattacccagagggaatgcgcaaaaagctcttttcagtgctccctatcttctccgaggcagaaaagcatgagatgagagggactgctgacttctttgccttttcatttggtcctaataacttcaaaccactgaacacgatggccaagatggggcagaatgtgtccttgaacctgagggaggccctcaattggataaaactagagtacaataacccacggatcttgattgcagaaaatggttggtttaccgatagcagggtgaagactgaagacaccacagccatttacatgatgaaaaatttcctgtctcaggttctacaggctatacgtctggacgagatacgcgttttcggatacactgcatggtcgctccttgacggcttcgagtggcaagatgcttatacgattagaaggggcctgttctatgtggactttaattcaaagcagaaggagaggaagcctaagtcctctgcgcactactataagcagattattagggagaatggcttctccctcaaagagtctacacccgacgtgcagggccagtttccctgtgatttctcctggggggttaccgagtctgtactcaagcccgaatctgtggcttcctccccccaattctctgacccccatttgtacgtgtggaatgctacagggaatcgacttttgcatagagtggagggcgttagattgaagactagaccagctcagtgcacagattttgtcaacatcaagaaacagctcgagatgctagctcggatgaaggtcactcattaccggtttgcactggattgggcaagtgtgcttcccacaggtaatctctcagctgtgaacaggcaggccttgcgatactacagatgcgtagtgtcagagggtctgaagctcggaattagtgcaatggtgacgctctactatcctacccacgcacacctaggtttgcccgaacccctgctgcacgccgacggctggctgaacccaagcaccgcagaggcctttcaggcgtatgccggtctctgcttccaggagctgggcgatctagtgaagctctggatcaccattaacgaacccaaccgactcagtgacatctataaccgcagcgggaatgacacgtatggagcggcccacaatctcctggtcgcccatgccctcgcttggcggctgtacgatcggcagttcaggccttctcaaaggggtgcggtcagcctgtcattgcacgcggattgggccgagcccgctaacccctacgcagattctcactggcgggccgccgagcggtttctgcagtttgagattgcttggttcgcagaacctttgtttaagaccggtgattatcctgcagctatgcgagagtatattgcttccaagcaccggagggggctgagttcctctgcactgccacggttaacagaagcagaacgccgtttgttaaaaggtaccgtggatttctgcgcgctaaatcattttactacccgttttgtcatgcatgagcaattggcgggatctagatacgacagcgatagggatatccagttcctgcaggacattacgcgactgtctagccccacacggttagcagtgattccctggggtgttcgcaaactcctgagatgggtgagacggaactacggagacatggacatttatataacagcttccgggattgatgaccaggcgttagaggacgaccgtcttcgtaaatattatttgggtaaatatctacaggaggttctgaaggcatatctcattgacaaagtacgcattaaaggatattatgccttcaagttggcggaggaaaaatcaaagcccagatttgggttttttacatctgactttaaagctaaaagctcaattcagttttacaacaaggtaatatcgagccgcgggtttcccttcgagaactcctcttccaggtgttcgcagactcaagaaaacacagaatgtacagtgtgtttgtttcttgttcagaaaaagcccctgatcttcctggggtgttgctttttctctactctagtcctcttactgtccatcgcgatctttcagcgtcagaaacggaggaaattctggaaagcaaagaacctgcagcacattcccctgaagaagggcaagcgcgttgtatca

SEQ ID NO: 250632 - DNA, 3132 bp, Artificial Sequence
  Description of Artificial Sequence: Synthetic coding sequence
atgaagcctggatgcgccgccggaagcccgggtaacgaatggattttcttctccaccgacgagattactacccgttaccgcaacacgatgtcgaatggagggctgcagcgctcagtgatcctgagcgcacttattctgctccgcgcggttaccgggttctctggagacggcagggcaatctggtccaagaatccgaacttcactccggtgaacgagtcacagctctttctgtacgatacctttcccaagaatttcttctggggaatcggaaccggagccctccaggtcgaagggtcgtggaagaaagatggcaagggtccgtcaatctgggatcatttcatccatactcacctcaagaacgtctcgtccaccaacggatcgtcggattcgtacattttcctcgaaaaggacctgtcagcactcgacttcatcggagtgtcgttttaccaattctccatttcttggccgcgcctgtttcctgatggaattgtgaccgtcgctaatgcaaaaggactgcaatactactcgactcttcttgacgccctcgtgctcaggaacatcgaacctatcgtcaccctgtaccactgggacctgcctttggccctgcaagaaaagtacggcggatggaagaacgatactatcatcgatatctttaacgactacgcaacttactgcttccaaatgttcggggaccgcgtcaagtactggatcaccatccacaatccgtacctcgtggcctggcacggctacggtaccggaatgcatgcccctggagagaagggaaacctggccgccgtctacactgtaggccataatttgatcaaggcgcatagcaaagtgtggcacaattacaacacccactttcgcccacaccaaaagggctggctgtcaatcacccttggttcccactggatcgagccgaatcgatcggagaacactatggacatctttaagtgccagcagtcaatggtgtcggtgttgggctggttcgctaatccgattcatggagacggtgattacccggagggaatgaggaagaagttgttctccgtgctcccgatcttctcggaggcggagaaacacgagatgcggggaactgcagacttttttgctttctcctttgggccgaacaatttcaagcctctgaatactatggccaagatgggacaaaacgtgtctcttaacctgcgggaagcgctgaattggatcaagctggaatacaacaatccgaggatcctgatagcagaaaatggctggttcaccgattctcgggtgaaaacggaggacactactgctatttacatgatgaagaacttcctgtcccaggtgctgcaggccatccggctggacgagatccgcgtgttcggctacaccgcatggtcgctgctcgatggctttgaatggcaggacgcatacaccatcagacgtggactgttctacgtggactttaactcgaaacagaaggaaagaaaaccgaagagctccgcccactactacaagcagatcatccgggaaaatggattcagtctgaaggaatcaacgccagatgtgcaaggacagtttccgtgtgatttctcgtggggggtgactgaaagcgtgctgaagcccgaatccgtggcgtcctccccccagttttcagacccccatctttacgtttggaacgcaaccggaaatcggttgctgcatcgggtggaaggagtcagactcaagacgaggccggcccagtgtactgatttcgtgaacatcaaaaagcagctcgaaatgcttgcgagaatgaaggtcacccattatcggttcgctctggattgggccagcgtgctgcccaccggaaacctgagcgccgtgaatagacaagcactccggtactaccggtgcgttgtttccgaagggctgaaactgggaattagcgcgatggtgactctctactacccgacgcacgcccacctgggtttgccagaaccactgctccacgcggacgggtggctgaacccatcgaccgcggaagccttccaggcttatgccggattgtgcttccaagaactcggtgacttggtgaagctgtggattactatcaacgagccaaaccgcctgagcgacatctacaaccgctcaggcaacgacacttacggagcggctcataacctgctggtcgcgcacgcgcttgcttggcgcctctacgatagacagttcagaccatcccagcggggagctgtcagcctcagccttcatgcagattgggccgagcctgctaacccctacgccgatagccactggagagcagccgagcgcttcctgcagttcgagatcgcctggtttgcggaaccactgttcaaaactggcgactacccagccgcgatgcgcgaatacatcgcctccaagcaccgacgcgggctgtcatcctcagctctgccgcggctcaccgaggcggaaagacgactcctgaagggaactgtcgacttctgcgcactgaaccacttcactaccagatttgtcatgcacgaacagctggccggttcccggtacgattcggatcgcgacatccagttcctgcaagacatcacccggctcagtagcccgacccgcctggcggtgatcccttggggcgtccggaaactcctgcgctgggtgaggagaaactacggagacatggatatctacataacggcttcaggcatcgacgaccaggccctcgaggacgaccggctgcggaagtattacttgggaaaatatcttcaggaggtgctcaaggcctacctcatcgacaaggtcagaatcaaaggctattatgcctttaaactggccgaagagaagtccaaaccacgctttggattcttcacctcagacttcaaggcgaagtcgtcgattcaattctacaataaggtgatctcaagccgcgggttcccgttcgagaactcgtcctcgcgctgctcccaaacccaagaaaatactgagtgcaccgtctgcctcttccttgtgcagaagaagccattgatcttcctgggttgttgtttcttctcgactctggtgctcctgttgagcatcgcaatcttccaaagacagaagaggcgcaaattctggaaagctaagaacctgcagcatatccctctcaaaaaaggcaagcgggtggtcagc

SEQ ID NO: 250633 - DNA, 3132 bp, Artificial Sequence
  Description of Artificial Sequence: Synthetic coding sequence
atgaagcctggttgtgccgccggatcaccaggaaatgagtggatctttttctcaactgatgaaattacgactagatatcgcaacacaatgtcaaacggcggtcttcagagaagcgttatcctcagtgctttgatccttctgcgggccgtcacagggttttcgggagatgggcgggctatctggtccaaaaacccaaattttactccagtgaacgagagccaactgtttttgtatgacacctttccaaagaactttttctggggaattggaactggggccctgcaggtcgaggggagctggaagaaggatgggaaaggaccatctatttgggatcacttcatccacacgcacctaaagaacgtgtccagcactaatggatcgtccgatagctacatattcttggaaaaggacctgagcgccctggactttatcggtgtctcgttttaccagtttagcatcagctggcctcggctctttcctgatggcatcgttacagtggctaatgcaaagggcctgcagtattacagtactttgctggatgcactagtactgagaaacatcgagccaatagttaccctgtatcattgggatctgcccttagctttacaagagaagtatggagggtggaagaatgatactatcattgacatctttaatgattatgccacttattgttttcagatgtttggtgatagagtcaagtattggatcaccatccacaatccatacctagtcgcttggcacggttacggcacagggatgcatgctccaggcgagaaagggaatcttgccgcggtatataccgtagggcataatctgatcaaagcccacagcaaggtgtggcataactacaacacacactttagaccacatcagaaggggtggctcagtatcaccctcggcagtcattggattgaaccgaaccgctccgagaatacaatggatattttcaagtgccagcaatctatggtctccgtgctcggctggttcgccaatcctattcatggggacggcgactaccccgaagggatgcgaaaaaagctgttttccgtgctgccgatcttcagcgaggcagaaaaacacgagatgagaggtacagcggacttcttcgccttctctttcggcccaaacaactttaaacccctgaatactatggccaagatgggacagaatgtctctctgaacctgcgggaagcactgaattggattaaactagagtacaacaacccccggatcctgatcgcggagaatggctggtttaccgattcaagagtgaaaaccgaagacaccacggcgatatacatgatgaaaaattttctgtcacaggtactgcaggccattcggctagatgagattagggtctttggttacaccgcgtggtcgctcctcgacggctttgagtggcaggatgcgtacactatccgaaggggtcttttctatgtggacttcaattctaagcagaaagagaggaagccaaagtcgtccgctcattactataaacagataattagggagaacggattctcactgaaggaaagcacaccggatgtgcaaggccaatttccttgtgatttcagctggggcgttactgaatcagtgcttaagcccgagtcagtggcctcaagtcctcagttttccgaccctcacctctacgtgtggaacgcaaccggcaacaggctactgcacagggttgagggggtgaggttgaagacaaggccagcccagtgcacagatttcgtgaatattaagaaacagttggagatgctggcgcgaatgaaggtgacccactatcgcttcgcccttgattgggcaagcgtgctgcccacaggaaacctcagcgcagtcaatcgccaagcactgcggtattacaggtgcgtggtgtctgaaggcctgaaactgggaatcagcgctatggtgaccttgtactacccaacccacgcacacctgggcttgcccgaacccctcctgcacgctgacggatggctgaatccaagcacggcggaggccttccaagcctacgccgggctgtgtttccaggaactaggcgacctagtgaaactatggatcacgattaatgagcccaaccgacttagcgacatctacaatagatccggcaacgatacctacggagccgctcacaatttgttggttgctcacgctttagcctggcggctgtatgatagacaattccgcccatcacagcgcggagcagtgtcattgagccttcacgcggactgggccgagccggcaaacccttatgcggactctcactggcgcgcagcggaaaggttcctgcagttcgaaatcgcttggtttgcagaaccactgttcaagacaggtgactaccctgctgccatgagagagtatattgcctccaaacacaggcgaggcttatcctctagcgcacttccacggctcacagaggcagagagacggctcttaaaaggaacagtggatttctgcgcgttgaaccactttaccacacgctttgtgatgcacgagcagctggccggatcccgctacgactcagaccgcgacattcagttcctccaggacatcacacggttgtcttcacctacccggctcgcggtaattccatggggggtccggaagcttttacgatgggtccggaggaactatggtgatatggatatctacatcactgcaagtgggatagacgatcaggcccttgaggacgaccgcctgcgcaaatattatctaggaaaatatctgcaggaggttctcaaagcatacctgatcgataaagtgcgtataaaaggttattatgcttttaaactggctgaggagaagagcaagcccagattcggcttttttacaagcgacttcaaggccaaaagctccatccagttttataataaggtgatcagttcacgtgggtttcccttcgagaattcgtcctcaagatgtagtcagactcaagaaaacaccgagtgcaccgtgtgtctctttctggtacagaaaaaaccgctcatcttcttgggctgttgctttttctccacccttgtattgcttctgagcatcgcaattttccagagacagaagagacggaagttctggaaggctaaaaacctgcagcatattccgttgaaaaagggcaaacgagtggtgtct

SEQ ID NO: 250634 - DNA, 3132 bp, Artificial Sequence
  Description of Artificial Sequence: Synthetic coding sequence
atgaagccgggatgcgcagctgggagtccggggaacgagtggatcttcttttcgaccgacgaaatcaccactagataccgcaacactatgtcaaatggaggcctgcagagatcggtgatcctgtccgcactcattttgctgagagccgttactggattttcgggcgacggccgcgcaatctggtccaaaaatcccaatttcacgccagtgaacgaatcacaactgttcctgtacgatacctttccaaagaatttcttttggggcatcggtaccggtgctcttcaagtcgagggatcatggaagaaggacggcaaagggccctcgatctgggaccatttcatccacacccacctgaagaacgtctccagcaccaacggaagctcagactcctacatcttcctcgagaaggacctgtcggctctggacttcatcggcgtctccttttaccagttctcaatctcctggccaaggctctttcctgacggaatcgtgaccgtggcgaacgcaaagggattgcagtactactccactctgctggatgcgctcgtgctgcggaatatcgaacctatcgtgactctctaccactgggaccttccactcgctctgcaggagaagtatggcggatggaaaaatgacaccatcattgatatcttcaacgactacgccacttactgcttccaaatgttcggcgatagagtcaagtactggatcaccatccacaatccttacctggtggcctggcatggctatggtactggaatgcacgcacccggggaaaagggcaacctggccgcagtgtacacggtgggacacaatcttatcaaagctcactcgaaagtgtggcataactataacacccatttcagacctcatcagaagggctggttgtcaatcactttgggctcccattggatcgagccgaatcgttcagaaaacactatggacatcttcaagtgccaacaatccatggtgagcgtgcttggatggtttgctaacccgatccacggagacggagattatccagaagggatgagaaaaaagttgttctcagtcctcccaatcttctcggaagcggaaaaacacgaaatgagaggcaccgccgacttcttcgccttcagcttcggacctaataacttcaagccacttaacactatggccaagatgggacagaacgtctccctgaacctgagagaagcattgaactggatcaagctggagtacaacaatccgcgcatcctcatcgccgagaacggatggtttaccgattcccgggtgaaaaccgaggacacgaccgccatctacatgatgaagaacttcctgtcgcaagtgttgcaggcaatccgcctggatgagatccgggtgtttggatacacggcgtggtcactgctggacggtttcgagtggcaggacgcgtacaccattcggcgcggactgttctatgtggacttcaactcgaagcagaaggagcgtaagccgaaatcctcagcccattactacaaacagattatcagagaaaacgggttttcgctcaaggagtccacccccgacgtgcagggccaatttccttgtgatttttcctggggcgtgactgaatccgtgctgaaaccagaatcagtcgccagctcgccacagttctcggatccgcatctgtacgtgtggaacgcaaccgggaaccggttgctccaccgggtggaaggagtgagactgaaaacgcggccggcacagtgcaccgacttcgtgaacattaagaagcagctggagatgcttgcccggatgaaggtgactcattaccgcttcgctctggattgggcatcggtgctgccgactggaaatctctccgccgtgaaccggcaggccctgcgctactaccgctgcgtcgtgagcgaaggactcaagttgggcatctcggcaatggtgacgctctattacccaactcacgcacatctcggcctgccggagccactgctccacgcggacggttggctcaatccttcgactgcggaagccttccaggcatacgccgggctctgcttccaggagttgggtgacctcgtgaagctgtggatcactattaacgaaccaaaccggctgtcggatatctacaatagatcgggaaacgacacttacggagctgcccacaacctgctggtggcccacgctctggcctggcggttgtacgatcgccagttccgaccctcccagagaggtgctgtgtccctttcgttgcacgccgactgggcggaaccggccaacccatacgccgacagccattggcgggccgcggagaggttcctccaatttgagatcgcctggtttgcggaaccactgtttaagactggagattaccctgccgcaatgcgcgaatacattgcctcgaagcatcggcggggactgtcatcgtccgcattgccccggttgactgaagcagaacgcaggctccttaagggaactgtggacttctgcgccctgaaccactttaccacgagattcgtgatgcatgagcagctcgctggatcacgctacgactccgatagagatatccagttcctgcaggatatcactagactctcgtcccctacccggctggcggtgatcccttggggagtccgcaaactgctgaggtgggttcggcggaactacggagacatggatatctacatcactgccagcggaatcgatgaccaggctctcgaagatgaccgcctgagaaagtactacctcggaaagtacctgcaggaagtcctcaaagcctacctgatcgacaaagtgcgtatcaaaggatactatgccttcaagctcgccgaagaaaaatcaaagccccgctttgggtttttcactagcgacttcaaagctaagtcctccattcaattctacaataaggtgatctcatcgaggggattcccgttcgaaaactcctcctcacgctgctcccaaacccaggagaacaccgaatgtacggtctgtctcttccttgtccaaaagaagcctctgatcttcttgggatgctgctttttctcgactctggtgctgctcctgagcatcgcgatcttccagcggcaaaagagacggaagttctggaaagccaagaatctgcagcacattcccttgaaaaagggcaaacgcgtggtgtca

SEQ ID NO: 250635 - DNA, 3132 bp, Artificial Sequence
  Description of Artificial Sequence: Synthetic coding sequence
atgaagccagggtgcgccgctggctctccgggaaatgaatggatctttttctccacggacgaaatcaccaccagataccgcaacaccatgtctaatggtgggctgcaacggtcagtaatcctgtccgccctgatactcctcagggcagtgaccggtttctccggagacgggcgggctatctggtccaagaacccgaactttacgcctgtgaatgagagccagcttttcctgtacgatacttttccaaaaaacttcttttggggcattggaaccggagcgctccaggtcgaggggagctggaaaaaggatggaaaaggcccatcgatttgggaccatttcatccatacccatctcaagaatgtttcgagcaccaacggcagctcagactcgtacattttcttggaaaaagacctttccgcactggactttatcggcgtgagcttctaccaatttagcatcagctggccgaggctgttcccggatggcatcgtgaccgtggcaaacgcaaagggactgcaatactatagcactttgctggatgcgctcgtgctgcgcaacattgagccaattgtcactctgtaccattgggacctccccctggcactccaagaaaagtatggaggatggaagaacgacaccatcatagacatcttcaacgattacgccacttactgcttccagatgttcggtgaccgggtgaagtactggattaccatacataatccgtacttggtggcatggcacggatacggcaccgggatgcacgctccgggcgaaaagggaaacctggcggccgtctacactgtcgggcacaatctcatcaaggcacacagcaaggtgtggcacaattacaacacgcacttccggccgcaccaaaagggatggctttcgatcacgttgggatcgcattggatcgagccgaaccggtctgagaacaccatggacatctttaagtgccagcagtcgatggtgtccgtgctgggctggttcgcaaaccctatccacggtgacggagactacccggaggggatgcgcaaaaagctgttttcggtgctgccaattttctcggaagccgaaaaacacgagatgcggggcactgccgatttcttcgccttttcgtttggccctaacaatttcaagcctctcaacactatggcgaagatgggacagaacgtgtcactgaatttgagagaagcgctcaactggatcaaacttgaatacaataacccccgaatcctgatcgcggaaaatggatggttcactgacagcagagtcaagactgaggacaccactgccatctacatgatgaagaatttcctctcgcaggtgctgcaggcaatccgcctcgatgaaatccgggtgttcggctacaccgcctggtccctgctcgatgggttcgaatggcaggacgcctacactatcagacgcggcctcttctacgtggatttcaattccaaacagaaagaacggaaaccgaagtcgagcgcccattactataagcagatcatacgggagaacgggttctccctgaaggagtcgaccccggatgtgcaaggacagttcccctgcgatttctcatggggtgtgaccgagtctgtgcttaaaccggagtcagtcgcatcttccccccaattctcggaccctcacctgtacgtctggaacgcaactgggaatcggctccttcaccgggtcgaaggggtcagactgaaaacgcgacctgcgcaatgtacggacttcgtgaacatcaaaaaacaactcgaaatgctggctcggatgaaagtgacccattaccgcttcgctctcgattgggcgtccgtgctccctacggggaacttgtccgccgtgaacagacaggcattgcgctattacagatgtgtggtcagtgagggtctgaagctgggtatctccgcgatggttaccctctactacccaacgcatgcgcacctgggactccctgagccactcctccatgccgacggatggctcaacccgtccaccgccgaggcttttcaagcgtacgccggtctgtgcttccaggagctcggggatctcgtgaagctgtggatcaccatcaacgaaccgaatcgcctgtcggacatctacaatagatcgggcaatgatacttatggggcggcccacaacctgttggtcgctcacgcccttgcgtggcggctgtatgacaggcagttccgcccgtcccaaagaggagcagtgtccctgtcactgcatgctgattgggccgagccagctaatccgtacgcggatagtcattggcgagcggctgaacggtttctgcagttcgaaatcgcctggttcgccgaaccacttttcaagaccggcgactacccggccgccatgagggagtacatcgcttccaagcaccgcaggggactgtcctcaagcgcactgcctcggctgaccgaagccgagaggcgcctgttgaagggtaccgtggacttttgcgcgctcaaccacttcactaccagatttgtgatgcacgaacagctcgctggctccaggtacgatagcgatagggacatccagttcctccaagacatcacccggctctcgtcgccgacccggctggcagtgattccttggggagttcggaagctgctgcgctgggtccgcagaaattacggagacatggacatctacatcactgcatccggaatcgacgatcaggcgctggaagatgaccgcctgagaaaatactacctgggaaagtacctccaagaagtgctcaaggcgtatttgatagacaaggtgcgcatcaagggatactacgcctttaagctggccgaagaaaagtcgaagcctcgttttggattcttcacttcggacttcaaggccaaatcctcaatccagttctacaacaaggtcatttcctctcgtggattcccgtttgaaaactcgtcctcacgctgcagtcaaacccaggaaaacactgaatgtaccgtttgtctcttcctggtccagaagaaacctctgattttcctcggatgctgcttcttttccactttggtgttgctgctgtcaatcgccatcttccaacgacagaaacggcgcaagttctggaaggcgaagaatctccagcacatcccgctgaaaaagggcaaacgtgtcgtctcc

SEQ ID NO: 250636 - DNA, 1506 bp, Artificial Sequence
  Description of Artificial Sequence: Synthetic coding sequence
atgtcatgcccagtgccggcatgctgtgcgcttctgctggttctcggtctttgtagggcaaggccgagaaatgcgcttctcctccttgcagatgatggtggatttgaatccggtgcatacaataactcagccatcgcaacccctcatctggatgcactggcgcgcaggagcctgcttttcagaaacgcctttacgtccgtgtcgtcatgctcccctagccgggcatctctgctcaccggtctgcctcagcatcagaatggtatgtacggactccaccaggacgtgcaccatttcaattcgtttgataaagtgcggtcactgccccttcttctcagccaagcgggggttcgcaccgggattattggcaaaaaacatgttggtcccgagactgtgtacccgttcgactttgcttatactgaagaaaatggatcggtccttcaagtgggacgaaacatcacgcggatcaagctcctggtgagaaagtttctgcaaactcaggacgaccgtccttttttcctgtacgtggcgttccacgatccacaccgatgtggacactcgcaacctcagtacggcaccttttgtgaaaagttcggtaacggagagtcaggcatgggacgcatccccgactggactcctcaagcatacgatccactggacgtgctggtgccttactttgtgccgaacactcctgctgccagagcagatcttgccgcacagtacactactgtgggacggatggatcaaggcgtgggtttggttctccaagaactgagagacgctggggtcctgaacgacactctggtcatcttcaccagcgataacggtataccatttccctcggggcgaactaatttgtactggccaggtacggcagagccacttctggtttcatcacctgaacatcctaagcggtggggtcaagtgtcagaggcctacgtgagccttcttgatttgacgcctactattcttgactggttttccattccttacccttcgtacgcaatctttggatcgaaaaccatacacctcaccggccgcagcttgctcccagcgctggaagcagaacctctgtgggcaaccgtgtttggcagccagtcacaccacgaagtcaccatgtcctacccgatgcgttcggtccaacataggcattttaggcttgtgcataacctgaacttcaagatgccttttcctattgatcaagacttctacgtgtcccctacgttccaggacctcctgaatcggactaccgcggggcagccaaccggatggtacaaggacctgcggcactactattaccgtgctcgctgggagctttacgatcgaagcagagatccgcacgaaacccaaaacctggcaactgatccgcggtttgcccagcttttggagatgctgcgggatcaacttgcaaagtggcaatgggaaacgcatgatccttgggtgtgtgcaccagatggagtgcttgaagagaagctgtcgccccaatgtcaaccactgcataacgaactc

SEQ ID NO: 250637 - DNA, 1506 bp, Artificial Sequence
  Description of Artificial Sequence: Synthetic coding sequence
atgtcctgccctgttcccgcgtgttgtgccttgctgctggtcttggggctgtgtcgcgcacgtccgagaaacgccctgctgctcctggccgacgatggtggctttgagtccggtgcatataacaactccgccatcgcgaccccgcacctggatgccctggcgagacgctcgctcctgttcagaaatgcgttcacttcggtaagctcctgctccccttccagagccagcctgctgacaggcttgccccagcaccaaaatggcatgtatggactgcatcaggacgtccatcacttcaactccttcgacaaagtaagatccctacccctcctgctgtcgcaggccggagtccgcaccggtattatcggtaagaagcacgtcggcccagaaacggtttaccccttcgacttcgcctacactgaggagaacggatcggtactgcaggttggaagaaacatcacccgaatcaagttgctggtccgtaagttcctacaaactcaagacgaccgtccctttttcctttacgttgctttccacgatccccaccgctgtggacattctcagccccaatacggtaccttctgcgagaagttcggaaacggcgagagcggcatgggtcgcatccccgattggaccccccaagcctacgatccgctcgacgttctggtcccctacttcgtgcctaacactcccgccgcccgtgccgacctggctgctcagtacaccacagttggtaggatggatcagggcgtcggtttggtcctgcaggagctgagggacgccggtgtgctgaacgataccctcgtcatcttcacctccgataacggcattcctttcccgagtggtcgcaccaacctctattggcccggaaccgccgagccccttctggtgtcgtctcctgagcatcccaagagatggggacaggtgagcgaggcgtacgtatcacttctcgaccttaccccgacgatcctggactggttctccatcccctaccctagctacgccattttcggttctaaaaccatccatttgacaggacgatctcttctccccgctctcgaagctgagccgctctgggccacagtttttgggtcacaatcgcaccacgaggtcaccatgtcctaccctatgcgcagcgttcaacaccgtcacttccgtctggtccataacctcaacttcaaaatgcctttccccattgatcaagatttctacgtttcgccgaccttccaggacctcttgaatcggaccaccgccggccagcctacggggtggtataaggatctgcgccattactactatcgcgcgcgttgggaactctacgaccgttcccgcgacccacacgagactcagaaccttgctacggatccacggttcgctcagctcctagagatgttgcgggatcaattggctaagtggcagtgggagacgcacgacccttgggtgtgcgctcccgatggcgtactcgaggagaagctcagcccccagtgccagcctctgcataacgagctt

SEQ ID NO: 250638 - DNA, 1506 bp, Artificial Sequence
  Description of Artificial Sequence: Synthetic coding sequence
atgtcgtgtccagtccctgcctgctgcgcattgttattagtcttgggcctatgccgcgctaggcccagaaatgctctgctcttactcgcagacgatggtggtttcgaatccggggcatataacaacagtgctattgctacgccacatcttgatgcacttgctcggaggtcactgcttttccgaaacgcattcactagtgtttcaagttgttccccctccagggcttcactcttaactgggctgccacaacatcagaacggtatgtacggactgcaccaggatgttcatcatttcaacagttttgataaggtaaggagcttacctcttttgctttcccaagccggagtcaggactggtatcatcggaaagaaacacgttggtccagaaacagtctatccgtttgacttcgcttatacagaggagaatgggagtgtccttcaggttggcaggaatattacaagaatcaagctgcttgttagaaaatttctccaaacacaagacgataggccattcttcctttacgttgcttttcacgatcctcataggtgtgggcattcccagccacagtacggaactttctgtgagaaatttgggaacggagagtcaggtatgggtaggattccagattggactccacaggcctacgatcctttggatgtcctggtcccatatttcgtgcctaacactcccgctgcaagggcagatcttgctgcccagtacaccacggtgggaaggatggatcaaggagttgggctggtgcttcaagaacttagggacgcgggcgtgttgaacgacacattagtgatctttacctcagataacgggatcccattccccagtggacgaactaatctttactggccaggtaccgccgagcccttgttagtttcttcccctgaacatccgaagagatggggacaggtgtccgaagcttatgtctcattacttgatcttactcctaccattcttgattggttctcaatcccttaccctagctacgctatattcgggtctaagaccattcaccttacaggccgatccctgttaccagcacttgaagcagaacccctttgggcgaccgtcttcggatctcaaagccaccatgaggtcactatgagctatccaatgaggtccgtccagcatcgtcatttccgtcttgttcacaacttaaacttcaagatgccatttcccatcgatcaagacttttacgtgtcgccaactttccaggaccttcttaacaggacgactgcaggccagcctaccggctggtacaaggacctcaggcattattattacagagcacgatgggaattgtatgacaggtctagagatcctcatgaaactcaaaaccttgctacagatcctaggtttgcccaactgttggaaatgctccgcgatcagctggcaaaatggcagtgggaaacacacgatccctgggtctgcgctccagatggagtcttggaggaaaagttaagtcctcaatgccagccacttcataacgaactc

SEQ ID NO: 250639 - DNA, 1506 bp, Artificial Sequence
  Description of Artificial Sequence: Synthetic coding sequence
atgtcgtgtcccgtcccagcgtgttgtgcgctccttctggtcctgggcctgtgtcgtgcccgcccacgcaacgcgctccttctcctggccgatgatggtggttttgaatcgggtgcgtacaacaactccgcgatcgcaacccctcaccttgatgcacttgcacggagatcgcttcttttcaggaatgcctttaccagcgtctcgtcttgtagcccatcccgtgcaagccttctgacggggcttccccagcaccaaaacgggatgtacgggctccaccaggatgtgcatcactttaactcgttcgataaggtcaggagcctcccgctcctgcttagccaagcaggagtgcgcactgggatcatcggtaagaaacatgtgggccccgaaaccgtctaccctttcgattttgcatacactgaggaaaacggaagcgtcttgcaagtgggtagaaatatcacgagaatcaaacttctggtgcgcaagtttctgcaaacccaggacgaccgtcctttctttctttacgtggcattccatgatcctcataggtgtggacactcacagccccagtacgggactttctgtgaaaagtttggaaacggcgagagcggaatgggacggatcccagattggacccctcaggcatacgatcccctggatgtccttgtgccatactttgtccccaacactccagcggcccgcgccgatttggcagcacaatacacgaccgtgggaagaatggatcaaggtgtggggcttgtgcttcaggagttgcgcgacgctggcgtcctgaatgacactcttgtgatctttacctcggataacggtatcccatttccttccggaagaaccaacctgtactggcctggaaccgcagaacctctgctcgtctcttccccagagcatcctaagagatggggtcaagtgtcggaggcatacgtgtcgttgttggacctgacccctactatattggattggttttccatcccgtacccttcctacgcaattttcggttcaaaaactatccatctgactgggcgttccctgttgcctgcccttgaagcagagccactctgggccactgtgttcggatcacaatcccaccatgaagtgactatgagctacccaatgagatctgtgcaacacaggcattttagactggtccataatctcaactttaagatgccatttccgattgatcaggacttttacgtgtcacctacctttcaagatttgctgaaccgaactactgcaggacaacctaccggatggtataaggatctcagacactactactatcgggcacgatgggaactttatgataggtcgcgggatcctcacgagactcagaatcttgctactgacccacggtttgcacaactccttgaaatgctgcgcgaccagcttgctaagtggcagtgggagacgcacgatccttgggtctgtgcaccagacggtgtgctggaagaaaagctctcccctcagtgccaaccactgcacaacgaactc

SEQ ID NO: 250640 - DNA, 1506 bp, Artificial Sequence
  Description of Artificial Sequence: Synthetic coding sequence
atgtcctgtcctgtaccagcctgctgcgccctcctgttggttctggggctttgtagggcccgaccgcggaacgctctcctgctgctggccgacgatggtgggttcgaatcaggagcatacaacaactcggctatcgcgacgcctcacctcgacgcgcttgcgcgcagatcactgcttttccgcaatgccttcacttctgtgagctcatgctccccctcaagggcctcattgctgaccggactccctcagcaccagaatggaatgtacgggctgcaccaggacgtgcatcacttcaactcgtttgacaaagtgagaagcctccctctgcttttgagccaggcaggagtgcggaccggaatcataggaaaaaagcatgtgggaccagagactgtctacccgttcgatttcgcctacactgaggagaatggctcggttcttcaggtcggacggaacatcacccgtatcaagctcctggtgagaaagttcctgcagacccaagacgaccgcccgttttttctgtacgtggcctttcatgacccgcaccgctgcggacactcccagccacagtacggtacgttttgtgaaaagttcggaaacggagaatccgggatggggcggatcccggattggacgcctcaagcctacgacccgctggacgtgcttgtgccgtatttcgtgccaaacaccccagcggcacgcgcggaccttgctgcacagtatactaccgtgggaagaatggatcaaggcgtcggccttgtactgcaggaactccgggacgctggagtcctgaacgatactctggtgatctttacctcggataacggcatccccttcccttccggcaggactaatctgtactggccaggcaccgcagaaccactcctcgtctcatcgccggagcaccctaagcgctgggggcaagtatcagaagcgtacgtctcgctgctggacctcactccgactattttggactggtttagcattccgtatcctagctacgccatcttcgggagcaaaaccattcatctgactggccgctccctgctgccagccctcgaagccgaaccgctgtgggctaccgtgttcggctcgcaatcgcaccacgaggtgactatgtcctacccgatgagaagcgtgcaacaccgacacttccgcctggtccataatctgaacttcaaaatgcctttcccgatcgatcaggacttttacgtctcacctaccttccaagatttgttgaaccggaccactgcgggtcaaccgactggctggtacaaggacctgcggcactactactaccgggcaagatgggaattgtacgaccggtccagagatccgcatgagactcaaaatctggcgaccgatccaaggttcgcacagctgttggagatgcttcgcgatcagctggccaagtggcagtgggaaacccatgatccctgggtgtgcgctccggacggtgtgctggaagaaaagctgtcaccacaatgccagcccctccataatgagctc

SEQ ID NO: 250641 - DNA, 1506 bp, Artificial Sequence
  Description of Artificial Sequence: Synthetic coding sequence
atgtcatgccccgtgcctgcctgttgtgccctgctgctggtgcttgggctttgccgcgcaagaccccgaaacgccctccttttgctggccgacgacggcggattcgagtccggcgcctacaataactcagcaatcgccactccacacctggatgcgcttgccaggcggtccctgctgttcaggaatgcctttacctcagtgtcgagctgtagtccatctcgggccagcctactgacaggcctaccccagcaccagaacggaatgtacggtcttcatcaagacgttcatcatttcaactctttcgataaagttcggagcttgcctctcctcctgtcacaggcaggggtcagaactggcatcataggaaagaagcatgtgggccctgagaccgtatacccgttcgactttgcgtacacagaggagaatggtagcgtgctgcaggtcggtaggaacatcacgcggattaaacttctggttagaaagtttttgcagacccaggatgatcggcccttttttctgtatgttgcatttcatgacccgcataggtgtgggcactcacaacctcaatacgggaccttttgtgagaagtttggcaatggcgaatccggcatggggagaattccggattggactcctcaggcttatgacccacttgacgtacttgtgccatatttcgtaccaaatacgccagccgcaagggcggatctcgcggcacaatacactacagtcggcagaatggatcaaggagttggactggtgctgcaggagctgcgcgacgcgggcgtgctgaacgacacgctggtcatttttacatccgacaatggtattcccttcccctctgggagaaccaatctctactggccaggcaccgcagagcccctgcttgtgagctcacctgaacacccaaagagatggggccaggtgagcgaggcatatgtgtctcttctggacctgacccctaccattctggactggttttcaattccttacccatcatatgccatcttcggatccaagacgattcatctcactggccgctcacttctccccgccctggaggctgagcctttgtgggccaccgtcttcggctctcagagtcatcacgaagtcacgatgagttatcctatgaggtctgtccagcacagacacttcagactcgttcacaacttgaatttcaaaatgccttttcccattgatcaggacttctatgtctcacccacctttcaagacctactcaataggaccaccgccgggcagccgaccggatggtataaggatctgagacactactactacagggcacgctgggaattgtacgatagaagccgcgacccacatgagacacaaaatctggcaaccgaccctagatttgcacagcttctggagatgttgcgggatcagctcgctaagtggcaatgggagacacacgatccatgggtctgtgcacccgatggggtgctcgaggaaaaactgtctcctcagtgtcagcccttgcacaatgaactg

SEQ ID NO: 250642 - DNA, 1506 bp, Artificial Sequence
  Description of Artificial Sequence: Synthetic coding sequence
atgagctgtcccgtgccagcctgctgcgctctgctcctggtgctcgggctgtgccgcgctaggcccagaaacgccctgttgttactagccgacgacggaggatttgaaagcggggcatataacaactcagcaattgccaccccgcatctggacgccctggcacggaggtcattgttgttcagaaatgcatttacaagcgtcagctcctgctccccgtctcgggcgagtctgctgaccggtctgccacagcaccagaatggcatgtacggtctgcaccaggatgtccatcattttaattcttttgacaaggtgcgcagtctacccctactgctgtctcaggcaggcgtcaggacagggattattggaaagaagcacgtgggtcccgagacagtgtacccctttgacttcgcctacaccgaggagaatggttctgttctgcaagtgggcagaaacattacaagaataaagctcttagtgaggaagttcctacaaacccaggacgacagacccttctttttgtacgtcgcatttcacgacccgcaccgctgcgggcactcccaaccacagtacggcaccttttgcgagaagtttggcaatggagagagtggaatggggcggattccagactggacccctcaggcctatgacccactagacgtgctagtgccctacttcgtccccaatacaccggccgcaagagctgacttggccgcgcaatacaccacagtgggccgaatggatcagggggtgggattagtgttgcaggaactgcgcgatgcaggggtgttaaatgacacccttgtgatctttacttcggacaatgggatacctttcccgagcggacgaacaaacctgtactggcccggaacagccgagcctctgttggtcagctctccagagcaccctaagcgttgggggcaggtgtccgaagcgtacgtctctctgctggacctcacgcccaccattctggactggttctctatcccatatccaagctacgcgatcttcgggagcaaaaccattcacctcactggccgatctttactgccggccctggaggcagaacccctttgggccaccgtcttcggcagccagagccatcacgaggtgactatgtcctaccccatgcggtccgtccaacacagacacttcagactagtccacaatctgaacttcaaaatgccctttcccatcgatcaggacttctacgtgtcccctacatttcaggacctccttaatagaacaactgcggggcagccgactggttggtataaggatcttaggcattactactatcgggcaaggtgggagctgtacgatcgctccagagatccgcacgagacccagaatcttgcaactgatcccagatttgcccaactcctggagatgcttagagaccaactggccaagtggcaatgggagactcatgatccatgggtttgcgctcccgacggggtcttggaagagaagttaagccctcagtgccagccacttcacaatgaactt

SEQ ID NO: 250643 - DNA, 1506 bp, Artificial Sequence
  Description of Artificial Sequence: Synthetic coding sequence
atgtcgtgcccagtcccagcatgctgcgcgctgcttctggtgctcgggctctgccgggccaggccaagaaacgcgctcctcctgctggctgacgatgggggattcgagtcaggtgcctacaacaactcagctatcgccaccccgcacctggacgccctggcacggagatcactgctgttccggaacgctttcacctctgtgtcctcgtgctccccatcccgggcatcgctcctcaccggactgccacagcatcaaaacggcatgtacggattgcaccaagacgtgcatcatttcaactcgttcgacaaagtcagatcactccctcttctgctgagccaggctggagtgaggactggaattatcggaaagaagcatgtgggacctgaaacggtgtacccatttgatttcgcctatactgaagaaaatgggtcggtgctgcaggtcggaagaaacattacccgcatcaaactcctggtgcggaagttcctgcagacgcaggacgatagaccgttcttcctgtacgtcgcctttcatgacccgcaccgctgtggacactcacagccccagtacggaaccttctgcgagaaatttggaaacggggagtcaggtatgggcagaatcccggactggaccccgcaggcgtacgacccactggatgtcctggtgccttacttcgtcccgaatacgccggcagctcgcgcggacctggcggcacagtacaccaccgtcggaaggatggatcagggtgtcgggttggtgctccaggagctgagagacgccggagttctgaatgataccctggtgatcttcaccagcgacaacgggatacctttcccttcgggaaggactaatctctactggcctggtacggccgagccgctgctcgtgtcatccccggagcacccgaagcgatggggccaagtgtcagaagcctacgttagcctgctcgatctgactccaacgattctggattggttctccattccttacccgagctacgctatcttcggcagcaaaaccatccatcttacgggtcggagtttgctgccggctcttgaagccgaaccactgtgggccaccgtgttcggatcccaatcgcaccatgaagtgaccatgtcgtacccgatgcggagcgtccagcatcgccacttcagactcgtgcacaatctgaacttcaagatgccgttcccgatcgatcaagacttctatgtgtcacccacttttcaggacctcctgaaccgcactaccgctgggcagccgaccggatggtacaaagatcttcgtcactactactaccgggcgcgttgggagttgtatgaccggtcccgcgatccgcacgaaacccagaacctggccaccgacccccgcttcgcccaattgctggaaatgcttcgggatcagcttgcgaaatggcagtgggagacgcatgacccttgggtgtgcgcgccagacggcgtgctggaggagaagctgtcacctcaatgccagccactccacaatgagctc

SEQ ID NO: 250644 - DNA, 1506 bp, Artificial Sequence
  Description of Artificial Sequence: Synthetic coding sequence
atgtcctgtccggttccagcatgttgcgcgcttcttctggtcctgggactctgccgtgctcgcccccgtaacgcgctgcttctgctggcagatgatgggggatttgaaagcggtgcatacaataactcggcgattgcaaccccacatctcgacgcactggcgcggagatcccttctcttccgaaacgcatttacctccgtctccagctgctcccccagcagagcatctctgctgaccggtctgccacagcatcaaaatgggatgtacggtctgcatcaggatgtccaccatttcaactcatttgacaaagtgcgatcgctgcccctcctcctgtcgcaagcaggtgtgcgcactgggatcatcggtaagaaacatgtcgggcctgaaaccgtgtacccttttgattttgcctacacggaagagaacggatctgtccttcaggtgggtcggaacatcactcggatcaagctccttgtccggaaattccttcaaactcaagatgaccggccgttttttctctacgtcgctttccatgaccctcatagatgtggacattcccagccccaatatggaactttttgtgagaagtttggcaacggtgagtcgggtatgggcagaatccctgactggactccacaagcctacgatcctcttgatgtgctggtgccttactttgtgcctaacactcctgccgccagagcagatcttgcagcacaatataccactgtgggcagaatggatcagggagtcggacttgtccttcaagaactcagggatgcaggagtcctgaacgacactctcgtcatctttacctccgataatggaattccttttccatccggaagaaccaatctgtactggcctggcaccgcagagccacttctcgtctcgtcccctgaacatcctaaacggtggggtcaagtgtccgaggcctatgtgagcctgttggacctcactcccaccatattggattggttcagcataccttacccaagctacgcaattttcggtagcaaaaccattcatctgactggaagatccctgctgccggcattggaggctgaacctctgtgggcaaccgtgtttggttcccaaagccaccatgaagttaccatgtcgtacccaatgcggagcgttcaacatagacattttagacttgtgcacaacctgaactttaagatgcctttccctatcgatcaagatttctacgtttcgcctacgtttcaggacctgctgaatcgcaccaccgcaggtcagccaaccgggtggtacaaggatctgcggcattactactaccgtgcgcggtgggaactgtacgaccgatcacgggacccacacgaaacccagaatcttgccaccgatccaagatttgcccaactgcttgaaatgcttcgggatcaacttgcaaagtggcaatgggagactcatgatccttgggtgtgcgcacccgatggcgtgctggaagaaaagttgagccctcaatgtcaacccctgcataatgaactt

SEQ ID NO: 250645 - DNA, 1506 bp, Artificial Sequence
  Description of Artificial Sequence: Synthetic coding sequence
atgtcatgtcccgtgcctgcgtgttgtgcgctgctgctggtgctgggactgtgtcgggcacggccaagaaacgcattgctcctgctggccgacgatggaggttttgaaagcggggcatacaacaactcggccatcgcaacccctcatctcgatgcacttgcacggcgatcgctcctctttaggaatgcatttacttcggtgtcgtcctgttcgccaagcagagcatcgttgcttaccggtctgcctcagcaccagaacggtatgtacggtctgcatcaagacgtgcatcatttcaattcatttgacaaagtgcgctcgctgccactcctcttgtcccaggcaggtgtaagaactgggataattggcaagaaacacgtgggtcctgaaactgtgtacccctttgatttcgcttacactgaggagaatggatccgttcttcaggtggggcgcaacattaccagaataaagctcctggttcggaagttcttgcagactcaggatgatcgccccttttttctgtacgtggcctttcatgatccccataggtgtggacattcgcagccccagtacggcaccttttgtgagaagtttggcaatggtgaaagcggtatgggaaggattcctgattggactcctcaggcatacgatcctcttgacgtcctggtgccttactttgtgcctaataccccagcagcgagggccgacctggcagcccaatacaccactgtgggccgaatggatcaaggagtgggtctggtgctgcaggagctgagagacgccggtgtccttaacgataccctcgtgatcttcaccagcgataatggaattccttttccatcgggacgcacgaatttgtactggcctggaaccgcagaaccgctcttggtgtcaagccctgaacatcctaagcgatggggtcaggtgtcggaagcgtacgtttcgctgctcgaccttacgccaacgattcttgattggttcagcatcccttatccttcgtacgcaattttcgggagcaagactatccacctcaccggtcggtccctgctgcccgcgctcgaggcagagcctctgtgggccaccgtgtttggatcccaaagccatcacgaagtgaccatgtcatacccaatgcggtccgtgcagcaccgacattttcgtcttgtccataacctgaactttaagatgccatttccaatcgaccaagatttctacgtgtcacccacttttcaagatcttcttaaccgtactaccgcaggacagcctacgggatggtacaaggatctgcggcactactactaccgcgctcggtgggaactttacgacagatcccgtgacccccatgagactcaaaacctggctaccgatcctcgctttgctcagcttttggaaatgctgcgagatcaactcgcaaagtggcagtgggaaacccacgatccttgggtgtgtgcacccgatggtgtgcttgaggagaaactgtcgccccaatgtcaaccactgcataacgaactt

SEQ ID NO: 250646 - DNA, 1506 bp, Artificial Sequence
  Description of Artificial Sequence: Synthetic coding sequence
atgtcttgtccggtgcccgcatgctgtgccttgctgctggtgctcggactgtgtcgagccaggcctcggaatgccctgcttctgctggctgatgatggcgggtttgaatccggagcatataacaattctgccattgcaacgccccatctggacgcccttgcccggcggtcactcctcttccgcaatgcattcactagtgtgagttcttgttcaccttcacgggcaagtctgctgactggactgccccagcaccagaatgggatgtacggtctccatcaggatgtgcatcatttcaattctttcgataaggttcgctctttgccgttgctgctgagccaggctggtgtgcggactgggattataggcaaaaagcacgtgggacctgagacggtgtacccttttgacttcgcctatacagaggaaaatggctccgtcctgcaagtagggaggaacatcacccgaataaagttgttggtgagaaagttcctccagacgcaggatgaccgccccttcttcctgtacgtggcatttcacgacccacacaggtgcgggcatagccagcctcagtatggcaccttttgtgagaaattcggaaatggggagagcggaatgggaaggatccccgactggacacctcaggcttatgacccactggacgtgctcgtgccttacttcgtgcccaacaccccagctgctagagccgatttggcagcccagtacactacagtgggtcgaatggaccagggggtaggcctggttttgcaggagctccgagatgctggggttttgaacgacactctggtgatttttacatctgacaacggtatcccctttcctagcgggcgcactaacctgtattggccaggaaccgcagagcctctgctggtctctagcccagagcaccccaagcggtggggacaggtatccgaggcatacgtttccctgcttgatctgacccccacaatacttgattggtttagtattccctatccctcttatgccatttttggcagtaagacaattcacttgactggaagatccctgctgccagccctggaggccgaaccgctctgggccaccgtcttcggatcccagtctcatcatgaggtcacaatgagctatcctatgcgcagcgtgcaacaccgccacttccgactcgtgcacaacctgaactttaagatgccctttcccatcgatcaggacttctacgtttctccgacttttcaggatttgctcaaccgaactacagctggtcagcctaccggatggtacaaggacctgaggcattattattatcgcgcccgatgggaactgtatgacaggtccagagatccccacgagacccagaatctggccactgacccaagattcgcacagctgcttgaaatgctgagggaccaactggctaagtggcagtgggagactcatgacccgtgggtatgcgcccctgacggagtcctggaggagaaattgagtccgcagtgtcagcctctgcacaacgaactg

SEQ ID NO: 250647 - DNA, 1506 bp, Artificial Sequence
  Description of Artificial Sequence: Synthetic coding sequence
atgtcgtgtcccgtgcccgcatgctgcgctctgctgctcgtccttggcctgtgcagagctcggccaagaaatgctctgctgttattggccgacgacgggggatttgaaagtggcgcctacaataatagcgctattgccaccccccatttggacgcgcttgctcgtcggtctctgctgtttcgaaacgcatttacatctgttagcagttgtagccctagccgagcatcactgctgactgggctgccacagcaccagaatggcatgtatgggctacaccaggatgtgcatcatttcaactcatttgataaggtaaggtccctgcctcttctgctttctcaggcgggagtcaggaccggcatcatagggaaaaagcacgtagggccggagacggtgtaccctttcgattttgcctacaccgaggagaatggctcagtgttgcaagtggggaggaacataacccgaataaagcttcttgtcagaaagttcctgcagacccaagacgatcggccatttttcttatatgtggctttccacgacccccatcgatgcgggcacagtcagccacaatatggtacattctgcgaaaaattcggtaatggtgagtctggcatggggagaataccggactggacccctcaggcttacgacccactggacgtcctggtcccttactttgtgccaaacactcctgccgccagggccgacctcgctgctcagtacactaccgtggggcggatggaccaaggggtgggcctggtcctgcaggaactgagagacgcaggagtgctaaatgacacactggtcatcttcacctcggataacggaataccttttccgtccggccggacaaatctctattggcctggaactgcagaacccctcctggtctctagccccgagcaccccaagagatggggtcaggtaagcgaagcatatgtgtctctgctggacctgacacccactatcttagattggtttagtattccttatccctcctacgctattttcgggtctaagaccattcatctcacaggcaggagcttacttccagctctggaagctgagcctctctgggcgaccgtgttcggatcccagtcgcaccatgaagtgacaatgtcataccccatgaggtcagtgcaacaccggcacttccggctggtgcacaatctgaacttcaagatgccctttccaattgatcaggatttttacgtctcgccaacgttccaggacctccttaataggactaccgccggacagcccacaggctggtataaggatctaagacactactattaccgagcccggtgggagctctacgaccgaagccgggatcctcatgaaacgcagaacttggccactgatcctagattcgcccagctgctcgagatgctgagggaccagctggcaaaatggcagtgggagacacacgacccatgggtctgtgctcccgacggggtcttagaggagaagctgtcccctcagtgtcaacccctccacaatgagctt

SEQ ID NO: 250648 - DNA, 1506 bp, Artificial Sequence
  Description of Artificial Sequence: Synthetic coding sequence
atgagctgcccggttccagcatgctgcgccctcttgctggtcctgggcctctgccgcgcgcgaccgcgtaacgccctgctgttgctagccgatgacggcggcttcgagagcggcgcatataataattctgctatcgccacacctcatctggatgcactcgcccgccgcagcctgctgtttcgtaatgccttcaccagcgttagcagctgcagccccagcagagcatctctcttgaccggtctgccgcagcatcaaaatggtatgtacggcctccaccaagacgttcaccactttaactccttcgacaaagtgcgttcattgcctctgttgctgtctcaggccggtgttcgcactggtattatcggtaaaaagcatgtcggccctgaaacagtgtatccgttcgactttgcatataccgaagagaatggctccgttttgcaagttggtaggaacatcacccgcatcaagctactggttcgcaaattcctgcagacccaggacgatcgtccttttttcctctacgttgcattccacgacccccatcggtgcggacactcccaaccacaatacggtaccttctgtgagaagttcggtaacggtgagtccggtatgggtcgtatccctgactggaccccgcaggcctacgatcctctggacgtgctcgttccttactttgtgccaaacactcctgccgcacgcgcggacctggctgctcaatataccactgttggcaggatggatcagggtgtgggcctcgtgctgcaggagctccgtgacgcaggtgttctgaacgatactctggtgatcttcactagcgataacggcatacctttcccaagcggacgcaccaatctctactggccaggaacggcggagccactgctggtgagcagccctgaacatccaaaacgctggggacaggtttccgaagcttatgtctctctgctggatctgaccccaactattctcgactggttttctattccgtacccgagctatgccattttcggtagtaaaaccattcatttgaccggcaggagcctgctgcctgcgctggaggcggaaccactgtgggctaccgttttcggaagccagagccatcacgaagttacgatgagctatccgatgcggagcgtgcagcaccgccactttcgcttggtgcacaatctgaatttcaaaatgccatttccgatcgatcaggatttctatgtctcgccgacgtttcaggacctgctgaatcgtacaactgctggacagccgacagggtggtataaagatttgcgacattactactaccgggcacgttgggaactgtacgatcgcagccgggatccgcacgagacccaaaatctggcgaccgatccacggttcgcccagctgctggaaatgctgcgtgaccagctggccaagtggcagtgggagacccacgacccatgggtttgtgccccggatggcgtcctagaagaaaaactatctccccaatgccaaccgctgcacaacgagctt

SEQ ID NO: 250649 - DNA, 1506 bp, Artificial Sequence
  Description of Artificial Sequence: Synthetic coding sequence
atgtcatgcccggtgccagcttgctgcgcactgctcttggtgctggggctctgccgcgcccggcctcgcaatgcgctgctgctgcttgctgatgatggaggatttgagtccggcgcctacaacaactcggccatcgcgaccccgcatctggacgctctggcccggagatccttgctgttccgcaatgcgtttacctcagtcagcagctgctctccgtcccgggcatccctgctcactggattgcctcagcatcagaacgggatgtacgggctgcaccaggacgtccaccacttcaattccttcgataaggtccggtcgctgcccttgcttctgtctcaagccggagtgagaacgggaattatcgggaagaagcatgtggggcctgaaaccgtttatccgttcgatttcgcgtacaccgaggagaacggatcggtgctgcaagtgggcaggaacattacgcggatcaagctcttggtccggaaatttctccagacccaggacgatcgccccttcttcctgtacgtggccttccacgacccgcaccgctgcggacatagccagccgcagtacggcaccttttgcgagaagtttgggaacggagaatcaggtatgggaagaattccggattggaccccgcaagcctatgatcctctggacgtgctggttccgtacttcgtcccaaacactccggctgcgcgcgccgacctggctgcccagtacactactgtgggaaggatggatcaaggggtgggcctggtcctgcaagaacttagggacgcgggagtcctgaatgacacgctggtgatcttcacgtccgataacggaatccctttcccctctggtcgcaccaacctctactggcccggaactgcggaacctctgctggtgtcgtcgccagaacatccaaaacgctggggtcaagtcagcgaggcgtacgtgtccctcctcgacctgacccccaccatcctcgactggttctcgattccgtacccgtcgtacgcgatcttcggatccaagactatccatctcactggccgctcgctcctgccggccttggaggcggagccgctgtgggcaactgtgttcggttcgcagtcgcaccacgaggtgacgatgtcctaccctatgcgctcagtgcagcatagacatttccggctggtgcataacctcaacttcaagatgcctttcccgattgatcaggatttctacgtgagcccaactttccaggatctgctgaatcgaaccacggccggccaaccgacgggatggtacaaggatctcagacattactattacagggccagatgggagctgtacgaccgcagccgggacccccacgaaacccaaaatctggctacggacccgcgattcgcgcagctgttggagatgctccgtgaccaactcgccaagtggcagtgggaaactcatgacccgtgggtctgcgctcccgatggtgtgcttgaggaaaagctctcacctcagtgccagccgctccataacgaactg

SEQ ID NO: 250650 - DNA, 1506 bp, Artificial Sequence
  Description of Artificial Sequence: Synthetic coding sequence
atgagctgccctgtgccagcttgctgcgcactcctcctggtgctcggactttgccgcgctcgcccgcgcaacgcgctgctgctgctcgcggacgacggagggttcgaaagtggtgcatacaacaattcagcaatcgctaccccacacctggatgcacttgctagacggagcttgctgttccgcaatgcgtttacttcagtgtcgtcctgttccccttcgagagcatcgcttctgaccggactgccgcagcatcaaaatggaatgtacggcctgcatcaggacgttcaccatttcaattccttcgacaaggtcaggtccctgccgctgctgctctcgcaggccggtgtccgaactggaatcatcggaaaaaagcatgtgggacctgaaaccgtctaccccttcgacttcgcatacacggaggaaaatggctcggtcctccaagtcgggcgaaacattacccgcatcaaactgctggttaggaagttcctgcaaactcaagacgaccgcccgttctttctgtacgtggccttccacgatccgcaccggtgtggacattcacagccccaatacggcactttctgcgaaaagtttggaaacggcgagagcggtatgggccggatcccggactggaccccgcaggcttacgacccactcgacgtgctggtcccgtacttcgtgccaaatactccggcggccagagccgaccttgcagcgcaatacacgactgtgggacggatggaccagggggtgggcttggtgctccaagagcttcgcgacgctggtgtgctgaacgacacgctggtgatctttacctcagataacggtatcccgtttccgtccggacgcaccaacctctactggccggggaccgccgaaccgctcctggtgtccagccctgagcaccctaagaggtggggtcaggtgagcgaagcatacgtgtccttgttggacctgaccccaaccatcctggactggtttagcatcccgtacccgtcgtacgccatcttcggctccaagaccatccacctgaccggcagatcgctgctgccagcactggaggctgaaccgctgtgggccactgtgttcggatcccaatcgcaccacgaagtgacgatgtcgtatccgatgcgctcggtgcagcacaggcactttagactcgtgcataacttgaatttcaaaatgcctttccctatcgaccaggatttctacgtgagcccaactttccaagatcttcttaaccggactaccgcaggacagccgaccggctggtacaaggatctgcgccattactactacagagcaaggtgggaactgtatgacaggtcgcgcgatcctcacgaaactcaaaacctcgccaccgatccgagatttgcgcagttgctggaaatgcttagagatcagcttgcgaaatggcagtgggaaacgcatgatccttgggtgtgcgccccggacggggtactggaagagaagctcagcccgcagtgccagcctctgcataatgagctg

SEQ ID NO: 250651 - DNA, 1506 bp, Artificial Sequence
  Description of Artificial Sequence: Synthetic coding sequence
atgagttgtcctgtgcctgcatgctgtgccctgttgctggtgctgggcctctgccgtgctaggcctcgcaacgccctcctattgctggctgacgacgggggttttgaatctggggcctataataactctgcaattgccacccctcacctggatgctctggctcgcagatctctgctctttaggaacgcttttaccagtgtgagtagttgctctcccagtagggctagcctgctaactgggctgccacagcaccagaacggcatgtatgggctgcatcaggatgttcatcactttaattcttttgataaggtgaggtccctccctctactactgagtcaagccggggtccggactggcattataggtaaaaagcatgttggccctgagaccgtctatccattcgatttcgcatacaccgaggagaatggttcagtgctgcaagtgggtagaaacatcactaggattaaattactggttcggaagtttttgcagacacaggacgatagacctttcttcctgtatgtggccttccacgatcctcatcggtgtggacatagtcagcctcagtatggtaccttttgcgagaagtttggcaatggcgagagcggcatgggccggatccctgactggacaccacaggcttatgatcctttggacgtgctggtgccttactttgtgccaaataccccagctgccagagccgacctggccgcccagtacacaactgtgggacgcatggaccagggcgtggggctggtcctacaagagctgcgtgatgcaggcgtgctgaacgataccttagtgatctttacatctgataacggaataccattcccatccggaaggacaaatctgtattggccaggaacagccgaacccctgctggtcagttccccagaacatcccaaacggtggggacaggtcagtgaggcatacgtgtccctgctggatttaacacccactatattggattggttctccatcccttacccatcatatgctatatttggcagtaagacaatccacctgactggacgttctttactgccagctttagaggcagaaccattatgggctaccgtgttcggatcccagtctcatcacgaagtcacaatgtcctacccaatgcgtagtgttcagcaccgccatttccgactcgtgcataacctaaacttcaagatgcccttccccattgaccaggatttctatgttagtcctacatttcaggatctcctaaacaggaccaccgcaggccagcccaccggctggtataaggacttgcggcattattattatcgggcacgctgggaactgtacgatcgttccagggacccacatgaaacacagaatcttgctaccgatccaaggtttgctcagctcctggagatgctgagggaccagctggctaaatggcagtgggaaacccacgatccctgggtgtgcgcccctgacggcgttctggaggagaagctaagcccacagtgtcagcctctacataatgaactg

SEQ ID NO: 250652 - DNA, 1506 bp, Artificial Sequence
  Description of Artificial Sequence: Synthetic coding sequence
atgtcgtgcccggtcccagcttgctgtgccctgttgctcgtgctgggcctgtgtagagcccgtccgagaaacgctctcctgttgctggctgacgacggcggcttcgaaagcggagcatacaacaattccgcgatcgcaaccccgcacctggacgccctcgctcgcaggtccctgctgttccgaaatgcattcacctccgtcagttcctgctcgccttcacgcgctagccttctcacgggactgccgcagcaccagaacgggatgtacgggctccaccaggacgtccaccatttcaactcctttgacaaggtgagatcactgcctctgctgctctcgcaggcaggagtgagaacggggatcatcggaaaaaagcatgtgggaccagaaaccgtgtacccgttcgacttcgcatataccgaagagaatggctcagtgttgcaggtcggcagaaatatcactaggattaagctcctggtccgcaagttcctgcaaactcaggacgaccggccgttcttcctgtacgtggctttccacgatccgcaccggtgtggtcattcccagcctcagtacggcactttctgcgaaaagttcggaaatggggagtcagggatgggacggatccctgactggactccgcaggcttacgacccgctcgatgtgcttgtgccatacttcgtgcccaacacccctgccgcccgcgccgatctggcggcgcaatacactaccgtgggccgcatggatcaaggggtcggactggttctgcaggaattgcgcgatgctggagtgctgaacgataccttggtgatcttcacttccgacaatggaattccgtttccatccggacgcaccaacctgtactggccgggaaccgctgaaccgctgctggtgagcagccctgaacaccctaaacgctggggtcaagtgtccgaggcgtacgtttccctcctggacctcaccccgactatcctggattggttctccatcccatatccttcgtacgctatctttggatcgaaaaccatccatctgactggccggtccctgctcccagcgctggaggctgaacctctgtgggctaccgttttcggctcccagtcccaccacgaagtgactatgtcgtacccaatgaggagcgtccagcaccgccattttcggttggtgcacaatcttaactttaagatgccgttccccatcgaccaggacttctatgtgtcccccactttccaggaccttctcaatcggaccactgcaggacagccgactggatggtacaaggacctgagacattactactaccgggctagatgggaactctacgatcgaagcagggatccgcacgagactcaaaacctggcaactgacccgcgctttgcgcagctgctcgaaatgctgcgcgatcagttggcaaaatggcaatgggagactcacgacccgtgggtgtgcgccccggacggcgtgctcgaggaaaagctgtcacctcagtgccagccactgcacaatgagctc

SEQ ID NO: 250653 - DNA, 1506 bp, Artificial Sequence
  Description of Artificial Sequence: Synthetic coding sequence
atgtcctgtcccgtgccggcatgctgtgcgctcctccttgtccttggattgtgtagggcaaggcctaggaacgccctcctgctgcttgcagatgatggcgggttcgaaagcggggcatacaataacagcgcaattgcgactcctcatctggacgccttggcgaggcgctctcttcttttccgtaacgcatttacctcggtgagctcttgcagcccctccagagcctcgcttctcaccggacttccgcaacatcaaaacggaatgtacggacttcatcaagacgtccaccacttcaactcgtttgacaaggtgagaagcctgccgctcctcctttcccaggcaggcgtgcggaccggaatcattggtaaaaagcatgtgggccctgagactgtctacccattcgattttgcatacaccgaggagaacggttcggtgctgcaagttggtaggaacattactaggatcaagttgctggtgcgcaagtttcttcaaacccaggatgatagacctttctttctttacgtggccttccatgacccacaccgctgtggacactcccaaccacaatatggaaccttttgtgaaaagttcggaaatggagagtcaggtatgggtaggatccccgactggaccccccaggcgtacgatcctctggatgtgctggtgccttacttcgtccccaataccccggcagcacgagcagacctggcagcccagtacactaccgttgggaggatggatcaaggagtgggacttgtgctgcaagaactgagagacgctggcgtgctgaatgacactcttgtgatcttcacgagcgataacggaattcctttcccttcgggtcgcactaacctttactggcctgggaccgcagaacctcttctcgtctcgtccccagagcacccgaagagatgggggcaggtttcagaggcctacgtgagcctccttgatctgactcccactatccttgactggttttcgatcccttacccatcctacgcaatctttggttcaaaaacgatacacctcaccggcagatcactgcttcctgcgctggaagctgaaccgctttgggctaccgtgtttggctcacaatcgcaccatgaagtcactatgtcataccctatgagatccgtccagcacagacattttcgtctggtccataatcttaactttaagatgccatttccaattgatcaagacttttacgtttcccctacctttcaagatctcctcaacagaaccactgcgggtcagcccacgggttggtataaggaccttcggcactactactacagagcaagatgggaactgtacgatcggtcaagggatccccacgagactcaaaatctcgcaaccgaccctagatttgcacaactgcttgaaatgctcagggaccaactcgcgaagtggcagtgggagacgcatgacccatgggtgtgtgcccctgatggtgtgctggaagagaaactgtcgcctcaatgtcaacctcttcacaatgagctt

SEQ ID NO: 250654 - DNA, 1506 bp, Artificial Sequence
  Description of Artificial Sequence: Synthetic coding sequence
atgagctgccctgtgcctgcttgttgtgcacttctcctggtgcttggcctttgtcgtgcgcgccccaggaatgccctgctgctcctggctgatgacggcgggtttgaatcgggagcatacaacaattcagcgatagctactccgcaccttgacgctctcgcccggaggagtctgctgttcaggaatgcatttacgtcggtgagctcgtgttcgccatcgagggcttcactgcttaccggtttgccacaacaccagaacggtatgtacggccttcaccaggacgtgcatcatttcaactcctttgataaggtgagatcattgcctttgctgctcagccaagcaggtgtccgcacgggtattatcgggaagaaacacgtgggtccggaaactgtgtatccttttgatttcgcttacaccgaagagaacggttcggtgcttcaggtcggacgcaacattacccggatcaagctgcttgtgcgtaaattcctgcaaacccaagatgaccgtcctttctttttgtacgtcgcatttcacgatccgcaccgctgcgggcacagccagccccagtacggaaccttttgtgagaaatttggtaatggggaatcaggaatgggcaggatccccgattggaccccccaggcctacgatcccctcgacgtgctcgtgccatactttgtcccaaacaccccagcagcaagagcagatttggcagcacaatacaccactgtgggacgcatggatcaaggtgtgggacttgtgctccaagaactccgcgacgctggggtgctgaacgacactcttgttatcttcacctccgataatggaatcccatttccatccggacgtacgaacctgtactggcctggtactgcagagccgctgttggtttccagccctgaacatccaaagcggtggggtcaagtctcagaagcgtacgtttcgctgttggatctcacgcctactattcttgattggttttctatcccctacccttcttacgcaattttcggatctaagactattcatctgaccgggcggtccctgctgcctgcacttgaagccgagcctctttgggcaactgtctttggatcgcaaagccatcatgaggttactatgtcgtacccgatgagatccgtgcaacaccgtcattttcgccttgtccataaccttaactttaagatgcccttcccaattgaccaagacttctacgtgagccctacttttcaagatctgttgaatcgcaccactgcaggacagccgacgggatggtataaagatcttaggcattactactaccgggcgaggtgggagctgtacgatcgatcgagggacccacatgaaacccagaacttggcaactgacccccggtttgcacagctgctggaaatgcttcgcgatcaactggcaaagtggcagtgggagactcatgatccatgggtatgcgcccctgacggcgtgcttgaagaaaagttgagcccccaatgccaaccactccataatgagctt

SEQ ID NO: 250655 - DNA, 1506 bp, Artificial Sequence
  Description of Artificial Sequence: Synthetic coding sequence
atgtcgtgtcctgtgcccgcttgttgcgccctgttacttgtgctggggctgtgcagggcccggccccgcaatgccctgcttctgttggctgatgatggaggatttgaaagtggagcctataacaactccgctatagcaacaccccatttagacgcattggcccggcgctctctgctgttcaggaatgcgtttacaagtgtctcctcttgcagcccatcaagagcttcactgctgactgggctgcctcagcaccaaaacgggatgtacgggttacaccaagacgtgcatcactttaattcatttgacaaggtgagaagcctccccctactgctcagccaggcaggagttcgtactgggattatcggcaagaaacatgttgggcccgagactgtgtacccctttgacttcgcgtacacagaagagaatggctccgtgctgcaggtgggtaggaacattactaggattaagctgctcgttaggaagtttttgcaaacacaggatgaccggcccttcttcctctacgttgcgtttcacgatcctcatagatgtggccatagtcagccccagtacgggaccttttgtgaaaaatttgggaacggagagtctggaatgggccggatccctgattggactccacaagcttatgaccctctggatgttttggttccatactttgtgccaaacacccctgcagcaagggccgacctagcggcgcagtacacaactgtcggccgaatggatcaaggtgttgggctggttctgcaagagctgcgtgacgctggagtgctgaatgatacactcgtgatcttcacatctgataatggcatcccattcccctccgggcggaccaatctgtactggccaggtaccgcagagccactgctggtcagctcgcccgagcatccgaagcggtggggacaagtatccgaggcctatgtgtccctgctggacctgacacccacgatattagattggttctcgattccctatccctcctatgctatcttcggatctaagacgatccacctgactggacgttccctgttacccgccctggaagccgagcctctgtgggcgacggtcttcgggagtcagagccaccacgaagttaccatgtcttatcctatgcgatccgtgcagcatcggcactttaggctcgtgcacaacctgaattttaaaatgccttttcccatcgatcaggatttctacgtgtccccgacatttcaggatttactgaataggactactgccggacaacccacaggatggtataaggacttgcgccactactattatagagcccgctgggagctgtacgacaggtcccgggatccacacgagacgcaaaatctggcgacagatcctaggtttgcccagctgcttgagatgctgcgggaccagttggccaagtggcaatgggaaacccatgatccttgggtgtgcgcccctgacggtgtgctagaggaaaagctgtccccccagtgtcaacccctgcataacgagtta

SEQ ID NO: 250656 - DNA, 1506 bp, Artificial Sequence
  Description of Artificial Sequence: Synthetic coding sequence
atgtcgtgccccgttccagcatgctgcgccctgttgctggtcctgggactgtgtcgcgcgcggccccgcaatgcgttgcttctgctggcagacgatggaggcttcgagtccggggcctacaataattcggccattgctacgccccacctggatgctctagcgcgcagatccttgctgtttagaaacgcattcacttccgtgagttcgtgcagcccctcgagagccagcctactgacgggcctgccccagcatcagaacggcatgtacggcctgcaccaggatgtccatcatttcaactccttcgacaaagtcagaagcctgccgctgctcctatcgcaggctggcgtgcgcacgggaatcattggaaaaaagcacgtgggtccggagacagtgtatccattcgattttgcctatacagaggagaatggaagcgtcttgcaggttggccgcaatatcacacgtatcaaattgttggtccgtaagtttctacagacccaggatgaccgtccattctttctgtacgtggccttccatgatccgcatcgatgcggacatagtcaaccccagtacggtacattttgtgaaaagtttggcaatggagagtcgggtatgggccgaatacccgactggaccccccaagcctacgatccactggacgtcctcgtcccgtacttcgtcccgaacacccctgccgcccgcgctgacttggctgcccaatacaccacggtgggtagaatggaccagggcgtgggcttggtcttgcaggagctccgagatgcaggcgtgctgaacgatacactggttatattcacgagtgacaatggaattccgttcccgagcggacgcaccaatctctattggcctggaactgccgagcctttactggtctcctctccagaacacccaaagcgttggggccaggtgtcggaggcatacgtgtcccttctggacttgacgcccacgatactggactggttttccatcccctacccgtcctacgcaatattcggctccaagacgatacacctgacgggccggagtttgctacccgcgctggaggccgagccgttgtgggcgaccgtctttgggagtcagtcgcatcatgaggtgaccatgtcatacccgatgaggtctgtgcagcaccggcactttcggctagtgcataatctgaatttcaaaatgcccttccccatcgaccaggatttctatgtgagcccgacctttcaggatctgttgaaccgtacaactgccggccagcccacaggatggtataaggacttgcgtcattattattacagagcccgctgggagttgtacgaccgctcccgtgatccgcatgagactcagaacctggccaccgatccccgattcgcccagctcttggagatgctgcgtgatcagctggcgaagtggcagtgggagacccacgatccctgggtttgcgcccccgatggagttctggaggagaaactgagcccccagtgccagccactgcacaatgaatta

SEQ ID NO: 250657 - DNA, 1506 bp, Artificial Sequence
  Description of Artificial Sequence: Synthetic coding sequence
atgagttgccctgtcccagcttgttgcgccttattgcttgtcttgggactgtgtagagctcggccgaggaatgcactgttactcctggccgatgacggtggctttgagtccggcgcctacaataattctgcaattgcaacccctcatctggacgcccttgctaggaggtcactcctgtttcggaatgctttcacaagcgtgtcctcctgctctccatccagggccagcctgctcacgggcttgccacagcaccaaaacggtatgtatggacttcatcaggacgttcaccactttaatagcttcgacaaagtgaggtcattaccactgctcctttcccaggctggagtgcggacaggtatcattggaaagaagcatgtgggcccagagaccgtataccccttcgatttcgcctacacggaggagaacggtagtgtgctacaggtggggcgtaatatcacaaggattaaactcctggtcagaaagtttctgcaaacgcaggacgaccggccttttttcttatatgtagcatttcacgacccacaccgttgcggtcactctcagccccagtacggcactttctgcgaaaagtttgggaatggagaatctgggatgggtaggattcctgactggactccacaggcatatgaccctctggacgtgctcgttccttactttgttccgaacacccctgccgcacgtgccgacctcgcagcgcagtatactacagtgggacgcatggaccagggagtgggcctggttctccaggagctgcgcgacgctggggtcctcaatgatacccttgttatatttacttcagataacggcatccccttcccatctggacgcactaatctgtactggcctgggacagctgagcctctgctagtgtcctccccggagcacccgaagcgctgggggcaggtttccgaggcgtacgtgtctttgttagacctaactcctacgatccttgattggtttagcataccgtacccttcttacgccattttcgggagcaaaaccatccatcttacaggaaggagcctactgccagcgctggaggctgaaccactttgggccactgtgttcgggagtcagtcgcaccacgaagttaccatgagctatcccatgcgcagtgtgcaacatagacactttcgcctggttcataaccttaactttaagatgccgtttcctattgaccaggatttctacgtaagcccaacgttccaagacctactaaatcgcaccaccgcagggcagcccactgggtggtacaaggacttacgacattactattacagggcccggtgggaactgtatgataggtcaagggatccacatgagacccagaatctggccaccgacccaaggttcgcccagctgctcgagatgttgcgggatcaattggcgaaatggcagtgggaaactcacgatccctgggtctgtgcccccgacggcgtccttgaagaaaaattatcccctcaatgccagccccttcacaacgagcta

SEQ ID NO: 250658 - DNA, 1506 bp, Artificial Sequence
  Description of Artificial Sequence: Synthetic coding sequence
atgtcctgtcccgtgccagcttgttgcgccctcctgctggttctcgggctctgtagggctcgccccaggaacgcgctactgcttctagccgacgacggcggctttgagtcaggcgcttacaataacagcgccattgctaccccacatctggacgcactcgccaggcgttccttgctgttccgcaacgcattcaccagcgtcagcagttgcagccccagccgggcttcattgctgaccgggctacctcagcaccagaatggtatgtatggtctccatcaggatgtgcaccatttcaattcctttgacaaagtcaggtccctacccctccttctatctcaagccggagtaaggacaggaataattggaaagaagcacgtgggtccagagactgtgtacccatttgacttcgcttataccgaagagaatggctctgtactccaggtcggccggaatataacacgtatcaagttgctcgtgaggaagtttcttcagactcaggatgaccgacctttcttcctgtacgtggcctttcacgatccacaccgctgcgggcatagccagccccaatatggcacattttgtgaaaaattcggcaatggcgagtccggaatgggaagaatccccgattggaccccacaggcctacgatcccctggacgtactggtgccctattttgtgcctaatacacctgccgcacgagcggatctcgcagctcaatacaccactgtgggccgaatggatcaaggcgtggggctagtgttacaagaacttcgggatgcaggagtgctcaacgatactctcgtgatttttacgagtgataatggaatcccctttcccagcgggagaactaatctgtattggcccgggaccgcagaaccccttcttgtttcatctcctgaacacccgaaaaggtgggggcaggtgtcggaggcatatgtgtcccttctcgacctaaccccaacaatccttgattggttttccatcccctaccctagctatgccatctttggaagcaagaccatccatctaaccggacgatccttgctgcccgccctggaagcagagccgctctgggccactgtctttggttctcagagccaccatgaagtgactatgagctaccccatgcgatctgtccaacataggcatttccgcctggtgcacaatcttaatttcaagatgccctttcccatcgaccaggacttctacgtgtctcctacatttcaggacctgctgaacaggacaactgctgggcagccaactggttggtacaaggatctgcgccattactactatcgggcccgttgggagctatatgacagaagtcgggacccacatgagacacagaacctggctaccgaccctcggtttgcgcagctgttagaaatgttgcgcgaccagctggcaaagtggcagtgggaaacccacgacccttgggtgtgcgcaccagatggcgtcctggaggagaaactgtccccacagtgccagcctctacataatgagctc

SEQ ID NO: 250659 - DNA, 1506 bp, Artificial Sequence
  Description of Artificial Sequence: Synthetic coding sequence
atgagctgtcctgtgccggcctgttgtgcacttcttcttgtgctgggactctgccgcgcccgaccacggaacgcacttctgctgcttgcggatgatggtggttttgaatcgggtgcatacaataactccgcaattgcgaccccccatcttgatgcactcgcccgtcggtcgctgctcttccgaaatgcctttacctcggtgtcatcgtgtagcccctctcgggcatcgctcctcaccggactgcctcaacaccaaaacggtatgtatgggctccatcaagatgtgcaccatttcaacagctttgacaaggtgcgatcactcccacttttgctctcacaggccggagtcaggactggaatcataggaaagaagcacgtgggacccgagactgtctacccttttgattttgcatacactgaggagaatggatcagttctccaggtcggacggaacattacccgcattaaacttcttgttcgtaaattcctccaaacccaggatgataggccttttttcctttacgtggcctttcatgacccccaccgttgcggtcactcgcaaccacaatacggcactttctgtgagaaatttggtaatggcgaatcgggtatggggagaatcccagactggactcctcaagcctacgatcccctcgatgtcctggtgccatactttgtgcctaacacccctgctgcaagagccgatcttgctgcccagtacactactgtgggtcggatggatcagggcgtgggactggtcttgcaggagcttagagacgcaggggtcctgaatgacaccctggtgattttcactagcgacaacggtatcccttttccaagcggccgcactaatctttactggcccggtaccgcagaacctttgcttgtcagctcccctgaacatccaaagcgttggggtcaagtgagcgaagcatacgtgagccttctggatctgacccctaccattctcgattggtttagcatcccctatccaagttacgcaatctttggatcaaagactattcatttgaccggcagatcactgctgccagcactggaagcggagccactttgggctaccgtctttggaagccagtcccaccatgaagtgactatgtcttaccctatgagatcggtgcaacatcgacattttaggctggtccataatctcaactttaagatgccttttccaattgaccaagatttctacgtgtcacctactttccaagatctcttgaacaggactacggctgggcaacctactggttggtacaaggatttgcggcattactattacagagcgcgctgggagctctatgatagatcgagagatccacatgaaacccaaaatcttgcaactgatcctagatttgcccaacttcttgaaatgctgagagatcaacttgcgaagtggcagtgggaaacccacgacccttgggtgtgtgcacctgacggagtgttggaggaaaaacttagcccgcagtgtcaacctcttcataacgaactt

SEQ ID NO: 250660 - DNA, 1506 bp, Artificial Sequence
  Description of Artificial Sequence: Synthetic coding sequence
atgtcttgccctgtgcccgcatgttgtgcccttctccttgtgttgggtctgtgccgtgcgagaccgagaaacgcacttctgcttctggcagacgatggaggcttcgaatcaggggcatacaataattctgcaattgcaactccgcacctcgacgccctggcccgccgaagcctgttgtttcggaatgcatttacttcagttagctcctgtagtccctccagagcttcattgctgacaggcttgccgcagcaccagaatggcatgtatggcctgcaccaggacgtgcaccacttcaactcttttgataaagtgaggtccctgccactcctgctgtcccaagctggggtccgcaccggcatcattggcaagaagcacgtgggtcccgagaccgtctatcctttcgattttgcctataccgaggagaatggctctgtattacaggtgggcagaaatataaccaggattaagctgttagttcgaaaattcctccagacacaggatgacaggccattcttcctctatgtcgcatttcacgacccacaccgatgtggccactctcagcctcaatacggaactttctgcgagaaatttggtaatggagagtccggcatgggccggattcctgattggaccccccaggcgtacgatcctctggacgtcctggtgccatacttcgttccaaacaccccagccgcacgagccgacctggccgcgcaatacaccaccgtcggacgcatggatcagggggttggactggttctgcaggaactgcgagacgccggagtcctgaatgatactctggtgatatttacttccgacaacggaataccatttccatcgggccggacgaacttgtattggcccggcacagctgagcccctgctggtcagctcgcccgaacacccgaagaggtggggtcaggtaagcgaggcatacgtgtcactgttggacctaacacccacgattttagactggttctcaatcccatatccctcttatgctatctttggctctaagacaattcatctcacgggccggagcctgctgccagccctggaagctgagcccctgtgggccaccgtgtttggttcccagagtcatcacgaggtgaccatgtcctacccgatgcggtctgtgcagcatcgccattttcggcttgttcataatctgaacttcaaaatgccatttccaatcgatcaggatttctacgttagtcctaccttccaggatttactcaataggacaactgccgggcaaccaacaggctggtataaggatctgcgacattactattaccgagcccgttgggaactgtatgaccggtcaagagaccctcacgagacccagaacctggctacagatcctcgctttgcacagttgctagaaatgctgcgggatcagctggccaaatggcaatgggaaacacatgacccctgggtttgtgcccccgacggggttctagaagaaaaactgtcaccccagtgtcagccacttcacaacgagctc

SEQ ID NO: 250661 - DNA, 1506 bp, Artificial Sequence
  Description of Artificial Sequence: Synthetic coding sequence
atgtcatgtccggtcccggcctgctgcgcccttctgctcgtcctggggttgtgtcgcgctcggccgcgcaatgccctgctgctcctcgcggacgatggcggattcgagtcgggcgcctacaacaacagcgccatcgcgactccacacctggacgctctcgccagacgttctctgttgttccggaatgcgtttacttccgtgtcctcctgctccccgtcaagggccagcctgctcactggcctcccgcaacaccagaacggaatgtacggactgcatcaggatgtgcatcatttcaacagcttcgacaaagtgaggtcgcttccgctgctgttgtcacaagcaggagtcagaacgggcatcatcggaaagaagcatgtgggacccgaaactgtctacccgttcgatttcgcctacaccgaagaaaatggctcggtgctgcaggtgggacgcaacatcacccggatcaaactgctcgtgcgcaaattcctgcaaacgcaagacgataggcctttcttcctgtacgtggccttccatgacccgcatagatgcggacactcccagccccaatacggaactttttgcgagaagtttggtaatggcgaatctgggatggggcgaatcccagactggactccacaggcgtacgatccactggacgtccttgtgccttattttgtgccaaacacgccggccgctcgggcggacctggccgctcagtacaccaccgtcggacgcatggaccagggagtgggtctggtgcttcaggaattgcgcgacgcaggggtgcttaacgataccctcgtgatcttcacctccgacaatggtatccctttcccgtcaggtagaactaacctctactggcctggaaccgccgagccgctgctcgtgagttcgccggagcacccaaagcgatggggccaagtctccgaggcatacgtctcactcctggacctgacccccactattttggactggttctcgattccgtaccccagctatgctatcttcggatcaaagaccatccacctgactggccggagcttgctgcctgcgctggaggcagagcctctgtgggcgaccgtgtttgggtcgcagtcgcaccacgaagttactatgtcgtacccgatgcgcagcgtgcaacaccggcacttcaggctggttcataacctgaattttaagatgccattcccgattgaccaggatttttacgtctccccaactttccaggacctgctcaatagaaccaccgcgggacagcccactggatggtacaaagacctccggcactactactaccgcgcccgctgggaactgtacgatagatcccgggacccacacgagacgcagaacctggcaaccgatccacggttcgctcagctcctcgagatgcttcgcgatcagctggcaaagtggcagtgggaaacccatgatccttgggtatgcgcacctgatggagtgctcgaagaaaagttgagcccgcaatgtcaaccgctccacaacgaactg

SEQ ID NO: 250662 - DNA, 1506 bp, Artificial Sequence
  Description of Artificial Sequence: Synthetic coding sequence
atgtcatgccccgtccccgcctgttgcgcgctattgttagtgctgggtttgtgcagagcccggcctcgaaacgccctgttactgctggccgacgacggtggctttgagtccggggcttataataacagtgctatagcaacaccacacctggacgcccttgcccggcggtctctactgttccgcaacgcatttacttcagtctctagttgtagccccagccgggcctctttgttgacgggactgccacagcaccagaacggtatgtacggcttacatcaggatgtccatcattttaatagcttcgacaaggtccggtctctgcccctgcttttgtctcaggccggagtgcgtaccgggatcatcgggaagaagcacgtcggacccgaaacagtgtatcccttcgacttcgcatacaccgaggaaaatggatccgtgctccaggttgggcgaaacattacaaggataaagttgctcgtgcgcaaatttctccaaactcaggatgatagaccattttttttatatgtggctttccatgatccacatcggtgcgggcacagccagccacagtacggcaccttttgcgaaaagttcggcaatggagagtctggcatgggccgcattcccgactggacaccacaggcgtacgaccctctggatgttctggtgccctactttgtcccaaatacccctgccgcccgtgccgacctggcagcacagtataccaccgtgggaaggatggatcagggcgtcggtctggtcctccaggaactacgggacgcaggggtgctgaatgataccctggtgatcttcacctctgataatgggatcccctttccaagtggaagaacaaatttgtattggcctgggaccgcggaaccattgctcgtctccagtccagaacacccaaagaggtgggggcaggtgagtgaggcctatgtctctttattggatctgacacctacaatcctggactggttcagtatcccctacccctcgtacgcgatttttggctcgaagaccattcacttgactgggcggtctctcctgccagcactcgaggccgaaccgctgtgggctacagtgttcggctcacagagccaccacgaggtgacaatgtcatatcccatgaggagcgtgcagcaccgacattttcggttagtgcacaatcttaacttcaagatgccttttccgattgaccaggacttttatgtgagtcctaccttccaggatctcttaaacaggactacagccggtcagcctacgggatggtataaggacctaagacactactactacagagcgcggtgggagctttacgaccgatcacgggacccacacgagacccaaaacctggccaccgatcctcgctttgcccagttacttgaaatgctgcgggaccagcttgcgaagtggcagtgggaaactcatgatccatgggtttgtgcccctgatggggttctggaagagaaactgagccctcagtgtcagcctctccataatgagtta

SEQ ID NO: 250663 - DNA, 1506 bp, Artificial Sequence
  Description of Artificial Sequence: Synthetic coding sequence
atgagttgccctgtaccagcatgttgcgctctcctgctggtgctaggtctctgtcgtgccaggccccggaatgccctactgctgcttgccgacgacgggggcttcgagtctggagcttacaacaactccgccattgcaacaccccatttggatgcactggctaggaggtcactcctctttcgtaatgcgttcacgagtgtctcctcctgttcaccgagtagggcaagcctcttgactggcctgccccaacatcagaacggcatgtatggcctgcatcaggacgtgcaccacttcaattcttttgataaggttcgaagcctgccactgttgctcagtcaggctggcgtcagaaccgggataatcgggaagaagcacgtgggcccagagactgtgtatccattcgattttgcctatactgaggagaacggaagtgtgttgcaggtcggcagaaacatcaccaggataaagctgctggtcagaaaatttttgcagacccaggacgacaggccgtttttcttgtatgtagcattccacgacccccaccggtgtggacattctcagccacagtacggaaccttttgcgagaaattcggaaatggcgagtctgggatggggagaatacccgactggactcctcaagcctatgaccctctggatgttctggtcccatacttcgtccctaacactcccgcagcaagagcagacctcgccgcacagtacacgacagtgggacgaatggaccagggggttggactggttctccaagagctgcgggatgcgggtgtgctaaacgataccctagttatcttcacgtctgataacggtatcccttttccgtccggacggaccaatctgtattggcccgggaccgcagaaccactgctagtgtcctctcctgaacacccaaagaggtggggccaggtgtccgaggcatatgtgagcctgttggaccttactccaaccattctggactggttcagcatcccctaccctagctacgcaatttttgggagtaaaaccatccacctgacaggtaggtcattgttgccagcgctagaggctgagcctttatgggcgacggtgtttgggtcccagagccaccacgaggtgaccatgtcctatccaatgcggtccgtgcagcacaggcacttcaggctcgtgcataacctgaacttcaaaatgccattcccgatcgaccaggatttctacgtgagccccacattccaggatttactcaaccgcactaccgctggacagccaacaggatggtacaaagacctgagacactactattatcgtgctcgctgggagttgtatgatcggtcaagagatccacacgagactcagaacctcgcgacagatcctcgcttcgcccagctgttggaaatgctgagggatcagctggcaaaatggcagtgggaaacccatgacccgtgggtgtgtgcacccgatggggttttggaggaaaagttgagccctcagtgtcaacccctgcacaatgagttg

SEQ ID NO: 250664 - DNA, 1506 bp, Artificial Sequence
  Description of Artificial Sequence: Synthetic coding sequence
atgagctgccctgtgcctgcctgctgcgccctgctgctcgtgctcggactgtgtcgcgcccgcccgcgcaacgcccttttgctgctggccgacgacggagggttcgagagcggcgcatacaacaatagcgccatcgccaccccccatctggatgctctcgcccgccgctcgctccttttccggaacgcgttcacttcggtaagcagctgttcgccttcgcgggcaagcctcctgactgggctgccccagcaccagaacggcatgtacggactccaccaggacgtgcaccatttcaattccttcgataaggtgagatcgcttcccctgctcctgtcccaagcgggggtcaggactggaatcatcggtaagaaacacgtcggaccggaaacggtgtacccattcgacttcgcctacaccgaggaaaacggctccgtgctgcaagtcggtcgcaatatcacgcgcatcaagctcctcgtccggaaatttctgcagacccaagacgaccgcccttttttcctgtacgttgcattccacgacccccataggtgcggccattcgcaaccacaatacggcacgttctgcgagaaattcggtaatggagagtcaggtatggggagaatcccggactggactccacaggcatacgacccactcgatgtgctcgtgccgtacttcgtcccaaatacccctgccgctcgcgcggacctggccgcgcagtacactactgtgggacgcatggaccagggcgtcggactggtcctgcaagaactccgcgacgcaggagtgcttaacgatacccttgtgatcttcactagcgacaatggcattccatttccctcgggacgcaccaacttgtattggccgggcactgccgaaccgctcctggtgtcatcaccggaacatccgaagcggtggggacaagtctctgaagcctatgtcagcctcctggaccttactcccactattctggactggttttcaattccataccccagttacgcgatcttcgggtccaagactatacatctgactggtcggagcctgctgcctgctctggaggccgaaccgttgtgggcgactgtctttggatcccagtcacaccacgaagtcactatgtcatacccaatgaggtcggtccaacacaggcacttccgccttgtccacaaccttaactttaagatgccgttcccgatcgatcaggacttttacgtgtcccctaccttccaagacctgcttaacagaaccactgccggccagcctaccggctggtacaaggatctgagacattactactatagagcccgctgggaactgtacgatagatctcgcgatccgcatgagactcagaacctcgccacggatccacgctttgcacaactgcttgaaatgctgcgcgaccagctcgcgaagtggcaatgggagactcatgatccctgggtgtgtgccccggacggggtgctcgaggagaaactgtcgcctcaatgccagccactgcataacgaactg

SEQ ID NO: 250665 - DNA, 1506 bp, Artificial Sequence
  Description of Artificial Sequence: Synthetic coding sequence
atgtcttgccctgtgcctgcctgctgtgccttgcttctggtgcttgggctgtgtagagcacggccacgcaacgcgcttttgctccttgctgatgacggcggtttcgagtcaggagcgtacaacaattcagcaatcgcaactccccatctggacgcactggcacgccggtcccttctttttcgcaacgcatttacttccgtgtctagctgttccccatcgagagccagcctgctgactggtctgcctcagcaccagaacggaatgtacggactgcaccaagatgttcatcacttcaattcgtttgataaagtccgatctcttcccctgctgctttcacaggcaggagtgcggaccggaatcattggaaagaagcacgtgggtccagaaaccgtctacccattcgacttcgcctacaccgaagagaatggatcagtcctccaggtcggacgaaacattaccaggattaagctcttggtacgcaagtttctgcagacccaggacgataggcctttctttctttatgtcgcttttcatgatcctcaccgctgcgggcattcgcaacctcaatacggaacgttctgcgagaaatttggcaatggagaaagcgggatgggtaggattcctgattggaccccacaagcatacgaccctcttgatgtccttgtgccgtactttgtccctaataccccggcagcgcgcgcagacctggcagcgcagtataccactgtcggcaggatggaccaaggtgtgggtctggtgcttcaggaactcagggatgccggtgtgcttaatgacactcttgtgattttcacctcggataacgggattccttttccatcgggaaggacgaacctgtactggccaggcaccgctgaacccctccttgtgtccagcccagaacaccccaaacgatggggacaagtcagcgaggcatacgtcagcctcctggatctgactcctactatcctggattggttcagcattccctacccttcgtatgctatctttggctccaaaactattcaccttactggtcgctccctgcttccggcgttggaagccgagcctctgtgggcaaccgtgttcggttcccagagccatcatgaagtcaccatgtcgtacccgatgcggtctgtccagcacagacacttccgtttggtgcataacctgaacttcaaaatgcctttcccaattgatcaagatttctacgtgtcccccacgtttcaggatcttctgaatagaactacggcaggtcaacccacgggctggtacaaggatctgcgtcattactactaccgggccaggtgggaactttacgatcgttccagggacccacatgaaactcaaaacctcgcaaccgacccacgctttgcccaactgcttgagatgcttagagatcaactggcaaaatggcagtgggaaactcatgacccttgggtgtgtgcaccggatggagtactggaagaaaagctctcacctcagtgtcaacctcttcataacgagctg

SEQ ID NO: 250666 - DNA, 1506 bp, Artificial Sequence
  Description of Artificial Sequence: Synthetic coding sequence
atgtcttgccctgtgcccgcatgttgtgcgttgctactggttttgggcctgtgtagggcacgaccgcggaacgcgctacttctgttggccgacgatggaggctttgaaagtggtgcctataataattcggccatcgccacccctcacctagacgcactggcccggagatcattgctctttcgaaacgcatttacaagcgtgagctcctgctcccccagccgagccagtctcctcaccggattaccccagcatcaaaacggtatgtatggactgcaccaggacgtccaccattttaactctttcgacaaagtgcgatctctgcctttgttactgtcgcaggcaggcgtgagaacagggatcattggcaagaagcacgtgggcccagaaaccgtgtaccctttcgacttcgcctatacagaggagaatgggagcgtgttgcaagtgggccggaatatcacccgaatcaagctgctggtacgaaaatttctccagacacaggacgatcgacctttttttttgtacgtggcttttcacgatccccatagatgcggtcactcccagccccaatatggaacgttttgtgagaagtttggcaatggcgaatcaggaatgggcagaattcccgattggactccccaagcatatgatccgctggacgtgcttgtcccatactttgtcccaaatactccggcagctcgagccgatctggctgcacagtacaccaccgtcgggagaatggaccagggcgtaggcctggtcctgcaagaattgagggatgctggcgtgctcaatgacacattagtcatctttacttcagacaacggcataccattcccatccggtcgtaccaatctatattggcccggcactgcggagcccctgctggtgtcctcccccgagcaccccaaaaggtggggacaggtatccgaggcctatgtctctttgttagacctcacacctaccatcctggactggtttagcatcccctatccatcatacgctatcttcggtagtaagacgattcacctgaccggtagatcactcctccctgccctggaggcggagccactgtgggcaactgtcttcggcagccaaagtcaccatgaggtcacaatgtcttatcccatgagaagtgtgcagcaccgacacttcaggttagtgcacaatctgaatttcaagatgcccttcccaattgaccaggatttctatgtatctcccacatttcaggaccttttaaatagaaccacggctgggcaaccaacaggctggtataaagacctgcgacattactactatcgagcccgctgggagctgtatgatcgaagtcgagacccccatgagacgcagaatctcgccaccgaccccagattcgctcagctcctcgagatgttacgtgaccaattagcaaaatggcaatgggagacccacgatccttgggtatgtgcccctgatggggtgttggaggagaagcttagtccccagtgccagcctcttcacaacgaactg

SEQ ID NO: 250667 - DNA, 1506 bp, Artificial Sequence
  Description of Artificial Sequence: Synthetic coding sequence
atgtcatgtccagtgccagcttgctgcgctcttcttctagtgttaggtctgtgtcgggctagaccccgcaacgccctgctgttactcgccgacgacggcggcttcgaatctggtgcgtataataacagcgcaatcgctacacctcatttggacgctttagccagacgcagtctgcttttccggaatgctttcacttcagtgtcctcatgtagtccgtcccgagcatccctgctaacgggtctccctcagcatcagaacggaatgtacggcctccaccaggatgtgcaccactttaatagctttgataaggtaaggtccctgccgttactcttgtctcaagccggggtccgcacagggatcattgggaaaaagcacgtaggcccagaaaccgtctaccccttcgatttcgcctatacagaggaaaacggcagtgtactccaggtgggcaggaacatcacccgcattaaactgctggtgagaaagttcctacagactcaggacgaccgacccttctttctatacgtggcattccatgatccacacaggtgtggtcattctcagccacagtatggaacgttctgtgagaagtttggaaacggagagtccggcatgggacggatccctgattggaccccgcaggcgtacgatcctctcgacgtgttagtgccctacttcgttccgaacacacccgccgccagggcggatctagccgcccaatacaccacggtgggacgtatggaccagggtgtgggtcttgtgctgcaggagctgagagacgccggggtgctcaacgacactctcgtgatatttacctctgacaacggaatccccttcccatcaggaagaacgaatctgtactggccaggaaccgccgaaccactgctggtgagctctcccgagcatcccaagcgttggggccaggtgagcgaagcttatgtcagtcttctcgatctcacccccactatcctagattggttttcgattccctacccctcctatgccatctttggctccaaaacaattcatctcactgggagatcccttctgccagctctggaagccgagcctctctgggccacggtttttggaagtcaatcccaccatgaggtaacaatgagctaccctatgaggagtgtgcagcaccggcactttcgtttggttcacaacctgaatttcaagatgcccttcccaattgaccaagacttctatgtatcgcctaccttccaagacctgctgaaccggaccacggccggacagccaactgggtggtacaaggatttgcgccattactactatcgcgcccgctgggagttgtacgatcgaagccgagaccctcatgagacgcaaaatctggctaccgatccccgatttgcacaactgctcgagatgctcagagatcagttggccaaatggcagtgggagacacatgatccctgggtgtgcgcgcccgatggagttctcgaggagaagctgtcaccacagtgtcagcctctgcacaatgagctt

SEQ ID NO: 250668 - DNA, 1506 bp, Artificial Sequence
  Description of Artificial Sequence: Synthetic coding sequence
atgagttgtcctgtacccgcctgctgcgccctcttactcgtgttggggctgtgtagagccagaccaaggaatgccctgctgcttctcgccgacgacggaggtttcgagtcaggtgcctataacaactctgctattgcaaccccccatctcgatgccctcgcccgtcgctcattactctttcgaaatgccttcacctcagtaagctcctgctctccaagtagggcctcactgcttacaggattgccacaacatcagaatggcatgtacggacttcatcaggatgtgcatcacttcaactcgttcgacaaggtgagatctcttcccttgttgctctctcaggccggagtgcgcacagggattatcggcaagaaacacgtgggtccagaaacggtttacccctttgatttcgcctataccgaggaaaatgggagcgtgttgcaggtggggaggaatatcacaagaatcaagctgttagtccgcaaattcctgcagacccaagacgatcggcctttctttttgtacgtggcgtttcacgacccgcaccgatgcggacactctcagcctcagtatgggaccttctgcgagaagtttgggaacggggagtctgggatgggcaggattccagactggactccgcaagcttacgatcccttagatgttctagtaccatattttgtgccaaacacacctgctgccagggcggacttggcagcacaatatactacggtaggtcgcatggaccagggtgttggactagttttgcaagaactgagagatgccggcgtcctgaacgacacactggtgatattcacctcagataacggaattccattcccatcaggccgaaccaatctgtactggcctgggactgccgagccacttctggtgagcagtcctgagcacccaaaaagatggggacaggtgtctgaggcctacgtttctctgctggatctgacgcccaccatcctggactggttttctataccctacccttcttacgctatctttggatccaagacaatccacctcaccgggcgcagcctgctgcccgctcttgaggcagagccactctgggctaccgttttcggcagccagtcccaccatgaggttaccatgagttatcccatgcgctcggttcaacaccgccattttcgcctggtacacaatctgaattttaaaatgccttttccaattgaccaggatttctacgtttcccccacatttcaagaccttctgaaccggacgacagcaggacagccaacagggtggtataaggacctgagacattactactatagggccaggtgggaattgtatgacaggagccgggatccccatgagacacagaatttggctaccgatccacgctttgcccagctgctagagatgctgagggatcaactcgccaagtggcaatgggagactcatgatccctgggtatgtgcacctgatggtgtcctggaagaaaagttaagtccgcagtgccagccgctccataatgagctg

SEQ ID NO: 250669 - DNA, 1506 bp, Artificial Sequence
  Description of Artificial Sequence: Synthetic coding sequence
atgagctgcccggtgcccgcatgttgtgcgttgctactcgtccttgggctgtgtagggcaaggccccgaaatgccctgctgctgctagcagacgatggcggcttcgagtcaggcgcctataacaatagcgcgatagcgactcctcatttagatgctctggctaggcgcagtttgctgtttcggaatgcttttacgagcgtgagcagttgcagtccaagcagggcttctcttctaaccggcctgccacaacaccagaacggtatgtatgggttgcatcaggatgtgcatcattttaatagctttgataaagtgagaagcctgccccttctgctgtcacaagctggagtgcgtaccggcatcatcggcaagaagcacgtgggccctgaaacagtttatccatttgatttcgcctatacagaagaaaatggttccgtgctgcaggttggccgaaacataaccagaatcaagctgttggtaaggaagttcttacagactcaggacgaccgaccatttttcttgtacgtagcttttcatgacccccaccggtgtgggcactctcaaccccagtacggaactttctgtgaaaaatttggcaacggtgaatctggtatgggtaggattccggattggacgccccaggcatatgacccactggacgtgctggtgccctattttgtgcccaacacccctgccgcacgggctgacctggctgcccagtataccaccgtgggcagaatggaccagggagtagggttggtgttgcaggaattacgtgacgccggggtgctaaatgatacccttgtgattttcaccagtgacaatggaatccccttccccagcgggcggacgaacctatattggcctggcacagctgagcccctgcttgtgtccagcccggagcacccaaaaaggtggggtcaggtcagcgaggcatatgtgagcctgcttgatcttacccctaccatactggactggttctccattccgtaccctagctacgccatcttcgggagtaaaaccattcacttgacaggtaggagccttctccctgcccttgaagcagagcctttgtgggcgactgtttttgggagtcagtcacaccatgaagttactatgtcttatcccatgcgctctgttcagcataggcacttccgtctcgtgcataatttgaactttaaaatgcccttcccaatagaccaagacttttacgtgagcccgacatttcaagacctgcttaatcgaacaaccgcgggtcagccaacaggttggtataaagatcttagacactactattaccgagctagatgggaactctatgacaggtcgcgtgatcctcatgagacacaaaatctcgctaccgacccacgatttgctcagcttttggaaatgctccgggatcagttagcaaagtggcagtgggaaacacacgacccttgggtctgtgcgccagacggagtgttggaagaaaagctgtccccccagtgccagcctctgcataacgagctg

SEQ ID NO: 250670 - DNA, 1506 bp, Artificial Sequence
  Description of Artificial Sequence: Synthetic coding sequence
atgtcttgccccgtgcctgcctgttgcgcacttctgctggttctcggactgtgtagggcccggcctagaaacgcacttctgctcttggcggatgacggcggcttcgaatctggggcttataacaattcagccatcgcgactccacacttggatgccctcgctaggcgcagtcttctgttcagaaatgccttcacctctgtctccagttgttcaccgagcagagctagcctgctgaccggcttgccccagcaccaaaatggcatgtacggccttcaccaagatgtgcaccattttaattccttcgacaaggtgaggtcccttcccctgctgttgtctcaagcgggggttcgaacagggatcatcgggaagaagcacgttggcccagaaacggtgtatcccttcgattttgcttacactgaggagaacggctctgtcttgcaagtggggagaaacatcactaggatcaagttgcttgttcgcaaattcttgcaaacccaggatgacagacctttttttctgtacgtggcgtttcacgaccctcatcgctgtggccactcacagcctcagtacggaactttttgcgagaaatttggtaatggggagagtggcatggggcggattcccgattggacaccccaagcctatgacccactcgatgtgctcgttccttactttgtgcctaacacaccggcagctagagccgacctcgccgcacagtatactacagtcggcagaatggaccaaggagttgggctggttctgcaggagctgcgggacgcaggagtactcaatgatacactcgtgatcttcacgtccgataacgggatcccgtttcccagcgggcgaacaaacttgtattggcctggtacggctgagcctctgctggtgtctagtcccgaacaccccaagcgatggggccaggtctcagaagcatatgtgagcctgctggacctgaccccaaccatcctcgactggtttagtatcccatacccgtcatacgcgattttcgggtccaagaccatccatctgaccggcagatccctgcttcccgcactggaggccgaaccactgtgggccacggtattcggaagccagagccatcatgaggtgactatgtcttacccgatgaggtcagtacagcaccggcacttccggctcgtgcacaacctgaatttcaagatgccattccccatcgatcaggatttctatgtttcacctacatttcaagatctgctgaaccgcaccactgcaggccaacccactggatggtataaggacctgaggcactactattaccgagcccgctgggaactctatgacaggagccgagatccccacgaaacccagaacctggcgactgatccaagattcgcccaactgctggaaatgcttagggatcaactggcaaagtggcagtgggagacacatgacccttgggtttgcgcacccgacggggtacttgaggagaagctctctccccagtgccaacccttgcacaacgaactt

SEQ ID NO: 250671 - DNA, 1506 bp, Artificial Sequence
  Description of Artificial Sequence: Synthetic coding sequence
atgtcatgtcctgttcctgcatgttgtgcattattattagttcttggactttgtagagcaagacctaggaatgcattattacttttagctgatgatggaggatttgaatctggagcatataacaatagtgcaatcgctactccacatttagatgcattagctagacgatctttactttttcgtaatgctttcacatcagtatcttcatgttctccatcaagagcatcattgttgactggattgcctcaacatcaaaatggtatgtatggacttcatcaagatgtacatcatttcaattcatttgataaagtaagaagtcttcctcttttattaagtcaagcaggagttcgaacaggaatcattggaaaaaaacatgttggtcctgaaactgtttatccattcgattttgcatatactgaagaaaatggatctgtattacaagttggtagaaacatcactcgtataaaacttttagtcagaaaatttcttcaaacacaagatgatagaccattttttctttatgtagcatttcatgatccacatagatgtggtcactcacaaccacaatatggaacattttgtgaaaaatttggaaatggagaatctgggatgggaagaatccctgattggactccacaagcatatgatccattagatgtattagttccatattttgttcctaatactccagccgcaagagctgatcttgcagctcaatatacaactgtaggtagaatggatcaaggagtgggtctagttttgcaagagcttagagatgctggagtattaaatgatactcttgttattttcacatcagataatggaattccatttccatctggacgtacaaatttatattggccaggaactgctgaacctttacttgtttcatcaccagaacatccaaagcgatggggacaagtaagtgaagcatatgtttctttattggatttaactcctactattttagattggttttctattccatatccaagttatgcaatatttggaagtaagactattcaccttactggaagatctttgttacctgctttagaggcagaaccattatgggctactgtttttggatctcaaagtcatcatgaagtgactatgtcatatcctatgagaagtgttcaacatagacattttagacttgtacataatttaaattttaagatgcctttcccaattgatcaagatttttatgtatcacctacttttcaagatcttttaaacagaacaactgctggacaaccaactggatggtataaagatttaaggcattattattatagagcaagatgggaattatacgatagatcacgtgatccacatgaaacacaaaatttagctacagacccaagatttgcacaattattagaaatgcttagagatcaacttgcaaaatggcaatgggaaacacatgatccatgggtttgtgctccagatggagtattagaagagaaattatctccacaatgtcaaccattacataatgaacta

SEQ ID NO: 250672 - DNA, 1506 bp, Artificial Sequence
  Description of Artificial Sequence: Synthetic coding sequence
atgtcttgtcccgtacccgcctgctgtgccttgctcctcgtactgggcctgtgccgggcacggcctaggaacgccctgctgctgcttgctgatgatggcggcttcgaatcaggagcttataataactcagctatagctaccccacaccttgatgcgctcgcacgcagaagccttttgttcaggaacgcctttacaagcgtatcgtcatgcagccctagcagggcttcattgctgaccggcctgccacagcaccagaatgggatgtatggtcttcaccaggatgtacatcattttaattcgtttgacaaagtgaggagtttgccattgctgctcagccaggccggcgtgagaacgggaatcatcgggaagaagcatgttggccctgagaccgtttaccctttcgactttgcatacaccgaggaaaatggctccgtgcttcaggttggaaggaatattactagaatcaagctgctggtgagaaaattcttgcagactcaggatgataggcctttcttcctctacgtggctttccatgatccccacagatgtggccactcgcaaccacagtacggcacattctgtgaaaagttcgggaacggcgagtcaggcatgggtagaattcccgactggacaccacaagcctacgatcccttggacgtgctggtgccctattttgtgcccaatactcctgccgcacgcgccgacttggctgctcagtacaccaccgtgggccggatggaccaaggcgtcgggctggtcctgcaggagctgcgggacgccggggtcctaaacgacaccctggtgatatttacaagcgataacgggattcctttcccttccggacgtactaacttgtattggcctggaactgccgaacccttgctcgtcagttcgcctgagcacccgaagaggtggggccaagttagtgaggcctatgtctccctgttggatctgaccccaaccattctcgactggttttccattccctaccccagctatgccatcttcggaagtaaaaccattcatttgacaggccggtcgctgttacccgccctggaagccgaacctctgtgggctacagtgtttggatctcagtcacaccatgaagtcacaatgtcatacccaatgcggagtgtacagcatcggcatttcagattagttcacaacctcaacttcaagatgcctttccccatcgaccaggacttctacgtaagcccaacgtttcaggacttgttgaatcgcaccacggcgggtcaacctactggatggtacaaggatctcagacactactattatagagcccggtgggagctgtacgaccgctcacgggatccccatgagacccagaatcttgcgacggatccacgatttgcgcagctcctggagatgctccgggatcaactggccaagtggcagtgggagacacacgacccctgggtgtgtgctccggacggcgtccttgaagaaaaactcagccctcagtgtcagcccctgcacaacgaactt

SEQ ID NO: 250673 - DNA, 1506 bp, Artificial Sequence
  Description of Artificial Sequence: Synthetic coding sequence
atgagttgccctgtgccagcctgttgtgcgctgttgttggttctcgggctgtgcagagcgcggccccgaaacgccctgctactcctggccgacgacggcggctttgagtccggcgcctataacaactctgcaatcgctacgccccacctggacgccctggcgcgccggagcttgctctttcgtaatgcattcacgtccgtgagttcttgtagcccaagccgagcatccctgctcacggggctaccacagcatcagaacggtatgtacgggctgcaccaggacgtccaccatttcaactctttcgacaaggtgcggtctctgcccctgctcttatcacaggcaggggtgcgaactggcataattgggaagaagcacgtgggcccagaaaccgtgtaccccttcgattttgcctataccgaagagaatggctccgtgctgcaggtgggaaggaacatcacaaggatcaaacttctggtgagaaagttcttacagactcaggacgacagaccgttttttctctacgtggcctttcacgatccacaccgttgcggccattctcagccccagtacgggacattttgcgaaaaatttgggaacggcgagtccggaatgggtagaattcctgattggacaccgcaggcgtatgatcctctggatgtactcgtgccgtattttgtcccaaacacgccggccgctagagcagacctggcagcccaatataccactgtgggccgcatggaccagggcgtcggcctcgtccttcaggaactccgcgacgccggagtcctcaacgacacacttgtgatcttcacttccgacaacggaattccgttccccagcggtcgcaccaatttgtactggcccgggaccgccgagccactcctggtgagcagcccagaacaccctaagcggtggggacaagtgagtgaagcctacgtctcactgcttgatctgacccctacaattctagactggttctcaatcccctacccttcttatgcgatctttggcagtaaaacgattcacttaacagggcggagtctgttgcctgcacttgaggctgaacccttatgggccacggtattcgggtcacaaagccaccacgaagttacaatgtcgtatcctatgagatcagtccaacatagacacttccgactcgtgcataatctgaatttcaaaatgccctttcccatagatcaggatttttacgtcagccctacttttcaggacctgctaaacagaacgactgcaggccagcccactgggtggtacaaggacctgcgtcactactactatagggcccgctgggagctttacgacagatcaagggatcctcatgagacccaaaatttagctacagatcctcgatttgcgcagctgcttgagatgttgcgcgatcagcttgcaaaatggcagtgggaaactcatgacccatgggtgtgcgcacccgacggggttcttgaagagaagctgagcccccagtgccagcctctccataacgagctc

SEQ ID NO: 250674 - DNA, 1506 bp, Artificial Sequence
  Description of Artificial Sequence: Synthetic coding sequence
atgtcttgtcccgtgccagcctgttgtgcactgctgctagtgttgggcttatgtagagctaggccacgcaatgctcttctgctgctagccgatgacggtgggtttgagagtggggcttataataattccgcaattgcgacaccacatctggacgcccttgcgcgcagaagcctgctgtttcgcaacgcttttacgagcgtatcgtcctgcagccccagccgcgcatctctgctcacaggactcccccagcaccagaatggcatgtatggcctgcaccaggacgttcaccacttcaactccttcgacaaggtccgcagcttgccacttttgctgagccaggccggagtgcgcactggtattattgggaaaaaacatgtcggcccggagacagtgtaccctttcgattttgcatacaccgaggagaatggatccgttctgcaggtgggcaggaatattactcgcattaagctgttggtccgcaaattcctccagacccaggatgaccggccattttttctgtacgtggcattccacgaccctcatcggtgtggacactcccaaccccaatacggaaccttctgtgaaaaatttggcaacggtgagtcaggaatgggccgcattccagattggacaccacaggcctatgacccacttgacgtgctcgtcccttattttgtgcccaatacccccgcagcgagggccgacctggctgcacagtataccaccgtgggccgaatggatcagggagttggtttggtgttgcaggagctgagagacgcgggggttctaaatgacacactcgtgatattcacctcagataatggaatacccttcccgtctggaaggaccaatctctactggccgggtaccgcagagcctttacttgtgtcaagtcccgaacaccccaagcgttggggccaggtgagcgaagcctacgtgtccttgctcgaccttaccccgaccattcttgattggttctccatcccttacccgtcctacgctatctttggctcaaagacgatccatcttaccggtagaagtttgcttccagcattagaggcagaacccttatgggccaccgtgttcgggtctcagtcccaccacgaggtgacgatgagttacccgatgagaagcgtgcagcaccgccatttcagattggtacataacctaaactttaaaatgccttttcctatcgaccaagacttctacgtgtcgcccaccttccaagatctgcttaatcgcacaactgccggccagcccaccggctggtataaggatctgaggcattattattatcgcgctcgctgggagttgtatgatagatccagggatccccatgagacccagaatctggccactgatccccgcttcgcgcagctattggagatgttgcgcgatcaacttgcaaaatggcagtgggagacgcacgacccatgggtgtgcgctcctgacggggtgttggaagagaagttgtcccctcagtgccagcccctccacaacgagctt

SEQ ID NO: 250675 - DNA, 1506 bp, Artificial Sequence
  Description of Artificial Sequence: Synthetic coding sequence
atgtcttgcccggtgcccgcttgctgcgccctgcttctggtcctgggtctctgtcgcgcccgcccacgcaacgcactcctgttgctcgcggatgacggcggattcgagagcggtgcatacaacaatagcgcaatcgctacccctcacctggacgccctcgctcgaaggtccctgctcttccgcaacgccttcacttcagtcagttcctgtagcccgagccgcgccagcctgttgaccggtttgcctcagcaccagaacgggatgtatggactgcaccaggacgtccatcactttaactcctttgataaggtgaggtccctccccctgctgttgtctcaggctggcgtcagaactggtatcatcggaaagaaacacgtcgggccagaaaccgtctacccgttcgacttcgcctacaccgaggagaacgggtcagtgttgcaggtgggccgcaacataacgcggataaagctgcttgtccggaaattcctccagacccaggacgacaggccatttttcctctatgttgcgttccatgatccacataggtgcgggcattcacagccgcagtatggcacattctgcgagaagtttggcaatggcgagagcggcatgggtcggataccagattggactccacaggcttacgatccgctggatgttctggtgccttacttcgtccccaataccccggctgcccgcgcagatctggccgctcagtatacgaccgtgggcaggatggaccagggagtgggattggtgcttcaggaactcagagacgcaggcgtactgaacgatactctcgtaatattcacaagcgacaacgggatcccattccctagtgggcgcaccaacctctactggcccgggacggcagaacccctcctcgtaagctctccagaacatcctaagaggtgggggcaggtgtctgaggcctacgtttccctgctcgacctgaccccaacaattctggattggttttccatcccatatccttcctatgccatatttggtagcaagactattcacctgacagggcggagcctgctcccggctctggaagcagaaccgttgtgggctacagtgttcggcagtcagagccaccacgaggtgacaatgtcttatccaatgaggagcgttcagcatcgacattttcggcttgtccataatctcaatttcaagatgccgtttcctatcgatcaggatttttacgtttccccaacatttcaggatctgctgaacagaaccaccgccggtcagcccacgggctggtacaaagatctgaggcattattattaccgagctcgatgggagctgtacgataggtcaagagatccccatgagactcaaaacctggctacagatccacggtttgcacagctgctggaaatgcttagagaccagcttgctaaatggcagtgggagacccacgacccatgggtgtgtgccccagacggggtgctggaggagaaattgtcacctcagtgccaacctctgcacaatgagctc

SEQ ID NO: 250676 - DNA, 1506 bp, Artificial Sequence
  Description of Artificial Sequence: Synthetic coding sequence
atgtcatgccccgtgcccgcatgctgtgcgctcctgctggtcttgggactttgcagggcgcgtccgcggaacgctctgctgttgctcgccgatgatggtggctttgagtcgggggcatacaacaactccgcgattgctactccacatctcgatgctctggccaggagaagccttctgttcaggaatgcatttacctccgtctcgtcctgtagcccttcccgcgcaagcctgttgaccggactcccacagcatcaaaacggaatgtacgggctgcaccaagacgtccaccacttcaactcatttgacaaagtgcgatcgctgccgctcttgctgtcacaagcgggtgtgcgcaccggaatcatcggcaaaaagcacgtgggtccagaaaccgtttacccatttgatttcgcatacaccgaggaaaacgggtcggtgcttcaagtgggaaggaacattacccgaattaagctgctggtgcggaagtttttgcagacgcaagacgatcggccgttttttctttacgtggcctttcatgacccccatagatgtgggcattctcaaccacagtatggcacgttctgtgagaaattcgggaacggagaatccggaatggggcggatacctgactggactccgcaagcgtacgatccattggatgtgctggtcccatactttgtccctaacaccccagcagccagagcagacctggcggcccaatacactactgttggaagaatggatcagggagtgggactcgtgctgcaggaactgcgggacgcaggggtccttaatgacacgctcgtcatattcacctcagataatggcattccttttcccagcggacgcaccaacctttattggcctgggactgcagagccgctcctcgtttcgagtccagaacatcctaagcgatggggtcaagtctccgaagcatacgtgagcctcctcgatcttacccccactattcttgattggttctcgatcccttacccgtcctacgcaattttcggctccaagacgatacacctcacgggtcgcagtctccttcctgccctggaagcagaaccgttgtgggcaaccgtgtttggtagccaatcccatcacgaagtgactatgtcgtaccctatgcgatcagtgcagcatcgtcactttagacttgtgcataatctcaactttaagatgccttttccaattgaccaggacttttacgtaagtccaactttccaagatctgctcaatcggaccaccgcaggtcagccaactggctggtacaaggacctccgacattactactatcgcgccaggtgggagctgtacgatcggtcgcgtgatccccatgaaactcaaaaccttgcaacggatcctcgatttgcccagctgttggaaatgctgagagatcagttggcaaagtggcagtgggaaactcatgacccgtgggtctgtgcccctgatggtgtgctggaagagaaactgagcccacaatgtcagccgcttcataatgagctg

SEQ ID NO: 250677 - DNA, 1506 bp, Artificial Sequence
  Description of Artificial Sequence: Synthetic coding sequence
atgtcctgtccggtgccggcttgttgcgccctcctgctggtgctggggttgtgccgggcccgccctcgcaatgcgctgctcctccttgctgacgatggaggatttgagtcaggagcatacaacaacagcgcaatagccaccccgcacctggacgccttggcacggaggtcactgctttttagaaacgcattcacttcagtgtcgtcctgctctccgagccgcgcgtcgctcctgaccggactgccacagcatcaaaacggcatgtatggtttgcatcaagatgtccatcacttcaactcattcgataaagtgagatcgctccccctgctcctgagccaggcgggagtcaggaccgggatcatcggtaagaagcacgtgggaccggagactgtctacccgtttgatttcgcctacaccgaggagaatgggagcgttcttcaggttgggagaaacattactcgcatcaaattgctggtccggaagttcttgcaaactcaggatgatcgcccgttcttcctttacgtagcctttcatgacccgcatcggtgcggccactcgcagcctcaatatggaactttctgcgagaagttcgggaacggagaatccggaatgggtcggatcccggactggacccctcaggcctacgaccccttggacgtgctggtgccctacttcgtcccgaatactcccgccgcaagagcggacctcgccgcacagtataccaccgtcggcaggatggaccagggagtgggactggtgcttcaagagctcagagacgcaggagtgcttaacgatacgctggtgattttcacgtccgataatggcatcccgttcccgtccggacgtactaacctgtactggccagggaccgcggaacctctgctcgtgtcctcacctgagcacccgaaaagatggggacaggtgtccgaagcatacgtgagcttgctggacttgaccccaacgatcctggattggttcagcatcccctacccgtcgtacgcaatcttcggaagcaagaccatccacctcactggtcgctcgctgctgcctgccctcgaagcagaacctctgtgggctaccgtattcggcagccaatcccaccacgaggtgaccatgtcataccctatgagaagtgtacaacacagacattttcgcctggtgcacaatctgaatttcaagatgccatttcctatcgatcaagacttctacgttagcccaaccttccaagacctgctgaaccggactactgctggacaaccaactggctggtacaaggacctgcggcactactactaccgggctcggtgggaactttacgaccgctccagagatccacatgaaacccaaaacctcgctacggacccacgttttgcgcagttgctggaaatgctcagggaccagctggcgaagtggcagtgggaaacgcatgacccgtgggtgtgcgcgccagatggcgtgttggaagaaaagctgtccccccagtgtcagccacttcacaatgaactg

SEQ ID NO: 250678 - DNA, 1506 bp, Artificial Sequence
  Description of Artificial Sequence: Synthetic coding sequence
atgtcttgccctgtcccagcctgttgcgcgctgcttttggtgctcggtctctgtcgagctagacccaggaatgccctactgctgctggctgatgacgggggattcgaatcgggcgcatataataatagtgctattgctactccccacttggatgcattggccagaaggagcctcctgttcaggaatgcatttacatccgtcagctcttgctcaccttctcgcgcctccttactcaccggcctgccgcaacatcagaatgggatgtacggcttgcaccaggatgtgcatcactttaatagcttcgacaaagtgaggtctctgcctctgctcttatcgcaggccggcgttagaactggcatcatagggaagaaacacgttggcccagagacagtgtaccctttcgattttgcctacacggaggagaatgggtcagtgttacaggtagggcggaacattacacgtatcaagctgcttgtcagaaaattcctgcagacacaagacgatcggcctttttttctatatgttgcattccacgacccacatcggtgcggccactcccagccgcagtacggtaccttctgcgaaaagttcggtaacggcgaatctggcatgggcagaatccctgactggacacctcaagcctacgaccccctggatgtcctggtgccctattttgtgccgaataccccagccgctcgggctgacctcgcagctcagtacacaacggtgggccgaatggaccagggggttggcctcgttctgcaggagctgagagatgccggggtgctgaacgacaccttggtgatcttcacatccgataacggcattcccttcccttcaggcagaactaatttatattggcccggtactgcggaacctctgctggtgagttcccccgagcacccgaaaagatggggacaggtgtctgaagcatacgtttctctcctggacctgacgccgaccattcttgactggttctcaatcccctacccgtcttatgctatctttgggtccaaaaccattcacctaaccggacgatcactgctgccagctctagaggctgagcccctgtgggcgaccgtctttggatctcagagtcaccatgaggttactatgagctaccctatgcgatctgtacaacatagacacttcaggctggtccataatttaaactttaaaatgccatttccaattgatcaggacttctatgtgtcgccaacctttcaggacctgctcaatcgcacaacagctgggcagcctaccggctggtataaggacctcaggcattactattaccgagctagatgggaactgtacgatagaagtagagaccctcatgagactcagaacctagcgaccgacccgagattcgcccagctcttagagatgctcagagaccaactggctaagtggcagtgggagactcatgacccatgggtatgcgctccggacggagtcttggaagagaaactctcccctcagtgccagcctctccacaacgagcta

SEQ ID NO: 250679 - DNA, 1506 bp, Artificial Sequence
  Description of Artificial Sequence: Synthetic coding sequence
atgagctgcccggtgccagcctgttgcgctttgctgcttgtgctcggattgtgcagagcacgccctagaaacgccctgcttctcctggcagatgatggaggctttgagtcaggggcgtacaacaacagcgcgatcgccaccccgcacctcgacgctctggccaggcggtccctgctgtttcggaatgcgtttaccagcgtcagcagctgctccccatcccgggcttcgctcctcaccgggcttccgcagcaccagaacgggatgtacgggctgcatcaggacgtgcatcactttaacagctttgataaggtgcgtagcctgcccctgctcttgtcccaggcgggggttcgcaccggcatcatcggcaagaagcacgtgggcccggagacggtgtaccctttcgacttcgcgtacaccgaggaaaacggctccgtgctgcaggttggaagaaacataacccggattaagctgctggtccggaagttcctccagacccaagatgaccggccgtttttcctctacgtggcattccatgacccacaccgctgcgggcacagtcaaccccagtacgggactttttgcgagaagttcgggaatggagagtcgggtatggggcgaattcccgactggacgccgcaggcctacgatccgctcgacgtgcttgttccctacttcgtccccaacactccggcggcccgcgccgatttggcagcccagtacacgaccgtgggtcgcatggaccaaggagtgggactggttctgcaagaactgcgggacgcgggagtgctgaatgacaccctggtgatcttcacgtccgataacggcatcccttttccaagcggacgcaccaacctgtactggcctggtaccgcagaaccgctgttggtgtcaagccctgagcacccgaaacggtggggacaggtgagcgaagcgtacgtgtcgcttctcgacttgacccctactatcctggattggtttagcatcccatacccgtcgtatgctatcttcgggtcgaaaaccatccatttgacgggcaggtcgctgttgcctgctctcgaagcggagcccctttgggccactgtgttcggatcccagtcccatcatgaagtgactatgtcttacccgatgcggtcggtccaacaccggcacttccggctggtacacaacctcaatttcaagatgccctttccaatcgatcaggatttctacgtgtctccgaccttccaggatctgctgaataggactactgccggacaacctactgggtggtacaaggaccttcggcactactactacagagcacggtgggaactgtacgatcgatcgagggacccgcacgagactcaaaatctggctaccgacccgcggttcgcgcaactgcttgaaatgctgcgcgaccaactcgcaaagtggcagtgggaaacccatgacccttgggtctgtgcccccgacggagtgctggaagaaaaactgtcgccgcagtgccagccactccacaacgagctt

SEQ ID NO: 250680 - DNA, 1506 bp, Artificial Sequence
  Description of Artificial Sequence: Synthetic coding sequence
atgtcatgcccagtccctgcgtgctgcgccctgcttttggtgcttgggctctgtcgtgctagaccccggaacgccctgctgcttctggcagatgatggcgggtttgaaagtggcgcctacaataattctgctatcgcaaccccgcacctcgatgctctagctaggaggtcactgcttttccggaacgcatttacaagcgttagctcttgctccccttcacgcgcctccctgttgactggccttcctcaacatcaaaacggaatgtatgggttgcaccaggacgtgcaccatttcaattcgtttgataaagtccggagtctgcctctgttgttgtctcaggctggcgtgagaacaggcataataggaaagaagcatgtcggtcccgagaccgtgtacccttttgactttgcttatacagaggagaacggaagcgtgctccaggtgggtagaaacatcacaaggatcaagttgctcgtgcgaaagtttctgcagacacaggacgaccggcctttcttcttgtatgtcgctttccacgatccacatcggtgtggtcattctcaacctcagtatggaacgttctgcgagaagttcggaaacggagaatccggcatgggaagaatccctgactggacaccccaagcttatgaccccctagatgtccttgtgccatactttgttccaaatacacccgccgctagggccgacttagccgcccagtacaccacggtgggaaggatggatcagggagtgggattggtcttgcaagagttgagggacgcaggcgtgcttaacgatactctggttatttttaccagcgacaacgggattcctttcccatcgggcagaacaaacctctattggcctggtaccgcagagcctctgcttgtgagctccccagaacaccctaagaggtggggccaggtgtctgaagcttacgtaagtctgcttgacctgacgcctactatcttggattggttctcaatcccttaccccagctacgcaatcttcggatccaaaactattcatctgaccggaagatcgttgctccccgccctggaagcggagcctctttgggccaccgtttttggatctcagagccatcacgaagtcaccatgagctatcctatgaggtctgtgcagcacaggcacttccgactagtgcacaatttgaacttcaaaatgcccttcccgatcgatcaggatttctacgtctcaccgacttttcaggatctcctcaatcggactactgccgggcagcctacgggctggtacaaagacttacggcactattactatcgggctaggtgggagctgtatgaccgcagtagggatccgcatgaaacacagaacctggccacagatccacggttcgctcagcttctggagatgcttcgagaccagttggcgaaatggcagtgggaaacccatgatccgtgggtctgtgcccccgatggggtcttggaagaaaagcttagcccgcagtgccagcccctgcataacgagctt

SEQ ID NO: 250681 - DNA, 1506 bp, Artificial Sequence
  Description of Artificial Sequence: Synthetic coding sequence
atgagttgtcccgtcccagcttgttgtgccctcctcctcgtgttaggactatgcagagcgcgccctcggaacgccctattacttctggcagatgacggggggttcgaatcaggagcatacaacaactccgctatcgccactccccatctcgatgctctggcccgccgatcactactattccgcaatgcattcacatccgttagttcctgttccccttctagggcatcccttctgactgggctcccacagcaccagaatggaatgtatgggctgcaccaggatgtccaccactttaactcctttgataaagtgaggtctctgcctctacttctcagtcaggctggagttcgcactggaataatcggaaaaaaacatgttggacctgaaactgtttatccctttgattttgcctatacagaggaaaatggatccgtccttcaggtgggacggaatatcactcggatcaaactcctagttagaaaattcctacagacacaggacgataggccattctttctatatgtcgcttttcacgacccacaccggtgtggacattcccagcctcaatacgggactttttgtgaaaaatttgggaatggagaatctggaatggggcggatccctgattggactccacaggcctatgatcccctagatgttctagtcccatatttcgtccccaacactcctgcggccagggcagatctggcagctcagtatactacggtagggaggatggaccagggagtcgggcttgtgttacaagaactccgggatgccggagtcctgaacgatactttggtcatatttacttcagataacgggatacctttcccctcgggacgtacaaatctttactggcccggaacagcagaacctctcctcgttagttcccccgaacaccccaagcggtgggggcaggtttccgaagcttatgtgtccctactggatttaactccaacaatacttgactggttctcaatcccctacccctcctacgcaatctttggatctaaaacaatacatctgacagggcggtctctactcccagccctcgaggcagagccactgtgggctacggtattcggatcgcaatctcaccatgaagtgactatgtcttatccaatgaggtcagtacagcacaggcatttccggcttgtgcataacttgaatttcaaaatgccctttccaatagatcaggacttttatgtctcccctactttccaagatctccttaatcgcactactgctgggcagcctacagggtggtataaagaccttcggcattattattatagagccagatgggaactgtatgaccgcagtagggacccccatgaaactcagaacctcgctactgatcccagatttgcccagcttttagaaatgctgcgagaccagttggcaaaatggcagtgggagactcacgatccttgggtatgtgcccctgatggagtgttggaagagaaactgtctcctcagtgtcagccattgcataatgaactc

SEQ ID NO: 250682 - DNA, 1506 bp, Artificial Sequence
  Description of Artificial Sequence: Synthetic coding sequence
atgtcctgtccggtgcctgcctgttgtgcactgttgttggttcttggcctctgccgggctagaccgcgcaatgcacttctgctgttggccgatgacggaggatttgaatccggcgcctataacaattcagccatcgccactccccatcttgatgcgctggcccggcgctccctcctgtttaggaacgctttcacctcagtgtcttcatgctcaccttctcgtgccagtctgctgacaggactaccacagcaccaaaacggcatgtatggcctgcatcaggacgtccatcactttaactcttttgacaaagtgaggagtcttccactgctgctgagtcaggcaggcgtaaggactggcatcataggaaagaaacacgtggggccggagaccgtatatccctttgactttgcctatacagaggagaacgggagcgtccttcaggtcggacggaacataactcgcattaagctgctggtcaggaagttcttacagacacaggatgataggccctttttcctctacgtggcttttcacgaccctcatagatgcggacatagccagccgcaatacggcacgttttgcgaaaagttcgggaatggagagagtggtatgggtcggattccggactggactccccaggcgtatgaccccctggatgtccttgtcccttacttcgtgcccaatacgccagctgcaagagcggacttggccgctcaatatactacagttggccgcatggaccagggtgtgggccttgtgctccaggagctgcgcgatgcaggcgtgcttaacgacacactcgtcatcttcacgtccgataatggcattccgttcccatctggtagaacgaatctatactggcccggaacagccgagcccttgcttgtcagcagccccgaacaccctaaacgctgggggcaggtgagcgaggcctatgtttctctgttagatttgacgcctaccattctggattggttctccataccctatccatcttatgctattttcgggtcaaaaactatccatctgaccggcaggtctctgctgcctgcgctggaagcagagcccctctgggccactgtgttcggcagccagtcacatcatgaggtgacaatgagttatcccatgcggagcgttcaacaccgccatttcaggcttgtgcataacctgaactttaaaatgcctttccctatcgatcaagatttttacgtatctccgacattccaagatctactgaacagaacaacagcagggcagcccaccgggtggtacaaagatctgcggcactattattatagggctaggtgggagctctacgacagatcacgcgatcctcacgagacccagaatctcgctacggatcctcgctttgcccaattactggagatgctgcgcgatcaactggccaagtggcagtgggagacgcatgatccctgggtgtgtgcgcccgatggcgttttggaagagaagctttcaccgcagtgccagccactgcacaacgagctg

SEQ ID NO: 250683 - DNA, 1506 bp, Artificial Sequence
  Description of Artificial Sequence: Synthetic coding sequence
atgtcgtgtcccgtccccgcatgttgcgcactgctcctcgtgcttggcctgtgtcgtgctagaccccgaaatgcattgctgctgcttgcggatgatggtggattcgagtccggagcctacaataactcggcgatcgcgactccacaccttgatgcattggctagaagaagcctgctcttccgaaacgcctttacttctgtgagcagctgttccccctcaagagcatcgcttctcactggacttcctcaacatcaaaacggtatgtacggcctgcatcaagacgtgcatcactttaactcatttgataaggtcaggtcactgcctctgctgctttcccaggccggcgtgcggactggtattatcggcaagaagcacgtgggccccgaaaccgtgtacccttttgacttcgcctacactgaagaaaacggttcggtcctgcaagtgggaaggaacatcaccagaatcaagctgcttgtgcggaagttccttcaaactcaagacgatagaccctttttcctctacgtggcctttcatgaccctcacagatgtggacactcgcaaccacagtacggaactttttgcgaaaagttcggtaatggggaaagcggaatgggacgtataccagattggacgcctcaagcctacgaccctctggatgttcttgtcccatacttcgtgcctaatactccagccgccagagcagatctcgcagcccagtacactactgtcggtcgaatggaccaaggtgtgggactggtcctccaggagttgcgggatgcgggggtgcttaatgatactctggtaatctttacctcagataacggaataccattcccgtcaggaagaactaatctttactggcctggcaccgccgaacccttgctggttagctccccagagcaccctaaacggtgggggcaagtgagcgaagcatacgtgtccctgcttgatctgacccctaccattcttgactggtttagcattccatacccgtcgtacgcaattttcggatcgaaaactattcatcttaccggtcgatcactgctccctgcacttgaagcagaaccgctgtgggcaactgtgtttggttcgcagtcacaccacgaggtcactatgagctacccaatgcgttccgttcaacatagacattttcgactggtgcataacctgaacttcaagatgccctttcctatcgatcaggacttttacgtgtcccctacctttcaagatctcctgaatagaactaccgcagggcaaccgactggatggtataaggatctcagacattactactacagagctaggtgggaactttacgatcggtcccgtgatccacatgaaactcagaacctcgcaaccgatccccggtttgcacaactgctggaaatgctgagggatcaattggcaaagtggcaatgggagactcatgatccatgggtttgtgcccctgacggcgtgctggaggaaaagctgtcacctcaatgccaaccattgcataacgagctg

SEQ ID NO: 250684 - DNA, 1506 bp, Artificial Sequence
  Description of Artificial Sequence: Synthetic coding sequence
atgtcgtgccccgtgcctgcctgttgtgcacttctgctggtgctcggcctctgtcgtgcacggcccaggaacgcactcctccttcttgcagacgatggcgggtttgaatccggcgcctacaacaactcggctatagcaacgccccatctggacgctctggcacgcagatccctgctttttcgtaatgcgtttacctctgtgtcgtcatgttcaccttctcgagcctctctccttactggacttcctcaacaccagaacgggatgtacggacttcatcaggacgtccatcacttcaattcctttgataaggtgcggtccctcccacttctgcttagtcaggcgggagtccgtaccggcatcattggaaaaaagcacgtcggacccgaaaccgtctacccctttgattttgcctacaccgaagagaacggatcggtgctccaagtgggccgtaacattaccaggattaagctcctggttagaaagttccttcagactcaagatgaccgccccttctttctctacgtggccttccatgacccgcatcgttgtggtcattcgcaacctcaatacggaacgttttgcgagaaatttggaaatggcgaatccggtatggggagaattccggattggaccccacaggcttacgatccattggatgtgctggtcccttactttgtgccaaatacccctgcagcccgcgcagacctggcagcgcagtacacgactgtgggtcgaatggatcaaggggtgggtcttgtgcttcaagaacttagggacgcaggagtcctcaatgataccttggtgatattcacttccgataatgggattcctttcccatctggtcgcactaacctgtactggcctggtaccgcagaaccgttgctggtgtcgtccccggaacatccaaagaggtgggggcaggtgtcggaagcatacgtgtcgctgctcgatctcaccccaacgatccttgactggttcagtataccttacccttcgtatgctatctttggtagcaagactattcaccttaccggcagatcccttcttcccgcacttgaagcagaacctctgtgggcaactgtgttcggttcacaatcgcaccatgaagttactatgtcctatcctatgagatccgttcagcataggcacttccgtctggtccacaacctgaacttcaaaatgccctttcccatcgatcaagacttttacgttagcccgacttttcaagacttgctcaataggaccacggcgggtcagccaactggttggtacaaagatctgcgccactactactaccgagccagatgggaattgtacgatcggtcccgagatccacatgagactcagaacctcgcgactgatccccgatttgcgcaacttctcgagatgctcagggatcagctggccaagtggcaatgggagactcatgatccatgggtctgcgcacctgacggagtcctcgaggagaagctgtcgcctcagtgtcaaccattgcataacgaactt

SEQ ID NO: 250685 - DNA, 1506 bp, Artificial Sequence
  Description of Artificial Sequence: Synthetic coding sequence
atgtcttgcccggtgccagcgtgttgtgctttgctgttagtgctggggctttgtcgtgcaagaccacgaaacgcactattgctgttggcggacgacggtgggttcgaatcgggagcgtacaacaactcagccatagccacaccacacttagacgctctggctcgacggtccctcttgttcaggaatgcctttacgagcgtgtcatcgtgttcaccatcgcgtgcctcacttcttacaggactgccgcaacatcaaaatggtatgtacggacttcaccaggatgtgcatcatttcaattcttttgataaggtccgctcacttccgttgttgctttctcaggccggagtaagaactggaattatcggaaagaaacatgtgggacctgaaacggtgtatccgtttgatttcgcctataccgaagaaaacggctctgtgctccaggtgggaagaaatatcactagaatcaagctccttgtccgtaagttccttcagacacaagatgatcggccttttttcctgtatgtagcttttcatgacccacatcgttgtggccactcacaaccgcagtatggaactttttgtgaaaagttcggaaacggagagagtggcatgggacgaattccagactggacaccacaggcttatgatccactggacgtgctagtgccatactttgtgccgaatacgccagcagctcgagctgaccttgccgctcaatacaccactgttggtaggatggaccaaggagtaggccttgttctacaagagttaagggatgcgggggttcttaatgatacattggtgatattcacatctgacaatggaattccattcccttcgggacgtacgaatctgtattggccggggaccgccgaaccgctattagtttcgtctccagagcatccaaagcgttggggtcaagtatctgaagcctacgtctcattacttgatctgacgccgacaatcttggactggttttctattccatacccaagttatgcaatatttggttccaagactattcatctaacgggccgatcgctactgccagcattggaagcagaaccgctctgggctactgtattcggttcacaatcacatcacgaggttacaatgagttaccctatgcgatcagtgcaacaccgtcatttccgacttgtccataatttaaattttaaaatgccgttccccattgatcaagatttctatgtttcacctaccttccaagatctcctaaacagaactacagctggacaacccactggttggtataaagacttgaggcactattactatagagctagatgggaactctatgatcgatctcgagatccacatgaaacacaaaatttggctaccgatccgcgtttcgctcaactgcttgagatgctccgggatcagcttgccaaatggcaatgggaaacacatgatccatgggtttgtgcgccagatggagtgttggaggaaaagctgtcaccgcaatgccaaccactgcataatgaactt

SEQ ID NO: 250686 - DNA, 1506 bp, Artificial Sequence
  Description of Artificial Sequence: Synthetic coding sequence
atgtcctgtcctgtaccagcctgctgcgccctgcttctcgtcctgggactgtgtagagcccgtccgaggaacgcactcttgctccttgccgacgatggaggatttgagtcaggggcctacaataatagcgcgatcgccactcctcacctcgacgcattggctcgcagaagcctgctttttcgaaatgccttcacctctgtctctagctgctcaccaagtcgagcctctctgctgacagggctgccacagcaccagaatggcatgtacggcctacatcaggacgtacatcatttcaactcgttcgacaaagtaaggagtcttccactgctgttgagccaggccggggtgcgcactggaatcatcggcaaaaagcatgtcggacctgaaacagtctatccttttgattttgcctacacagaagagaatggcagcgtcctccaggttggcaggaatattaccagaataaaactcctcgtgagaaagttcctgcagactcaagacgacaggccgttttttctatatgtggctttccatgatccacatcgctgcgggcatagtcagccccagtatgggaccttctgcgaaaagtttggcaatggggagagtggcatgggcagaatcccggattggacgccccaggcatatgaccccctcgatgtgctcgttccatatttcgtccctaacacccctgccgcacgtgccgatcttgccgcccagtacaccactgtcggtaggatggaccagggtgtgggccttgttctgcaggagctgagagatgctggcgtgctcaatgatacgctcgtgatatttactagtgacaacgggatacccttcccctccgggcgcaccaacctctattggcccggtactgccgaaccactgttggtgtccagcccggagcatcccaaacggtgggggcaggtttccgaagcctatgtgtccctccttgatctaacccctaccatactggattggttttccattccctatccatcttacgctatctttggatcaaagaccatccacttaacagggcgctctctgctccccgcattagaggctgagccactgtgggctacagtgttcggttctcagtcccaccacgaggtcacgatgagttaccccatgcggagcgtccagcaccgccactttcgccttgttcataacttaaacttcaaaatgcctttcccgatcgatcaggacttttatgtgtccccaacgttccaggacctgttgaatagaactaccgcagggcagccaactgggtggtataaagatctgcggcattattattaccgggcaaggtgggagttgtacgatcggtcacgtgatccacatgaaacccaaaatctagcaaccgatccacgcttcgctcagctcctggagatgctgagagaccagttggcaaaatggcagtgggaaacccatgacccctgggtatgtgcccccgacggggtgctggaggagaaattgagcccacagtgccagccacttcataatgaactg

SEQ ID NO: 250687 - DNA, 1506 bp, Artificial Sequence
  Description of Artificial Sequence: Synthetic coding sequence
atgtcatgcccagtgcctgcctgttgcgcactgctgctggtgctgggactctgccgcgcccggccacgcaacgctctgctgctgctggcggacgacggcgggttcgaatcaggagcgtacaacaactctgcgatcgcaaccccgcatcttgatgccctggccagacgctccttgctgttccgcaacgccttcacttcggtgtcgtcttgcagcccgtcccgggcatccttgctgactggactgcctcagcaccaaaatgggatgtacggtctgcaccaggacgtgcatcactttaactcgttcgacaaagttagaagccttccactgctcctttcacaggcgggtgtgcggactggaatcatcggcaagaaacacgtgggcccggaaaccgtgtacccgttcgatttcgcctataccgaggagaatggatcagtgttgcaggttggtcggaacattactcggattaagctgttggtgcgcaagttcctccagacgcaagacgaccgccctttctttttgtacgtcgcatttcacgacccgcaccgctgcggacatagccagccgcaatacggaaccttctgcgagaaattcggaaacggagagtcgggaatgggaagaatcccggattggactcctcaggcttacgatcctcttgatgtcctggtgccgtactttgtgcctaatactccggccgcaagagctgacctggctgcgcagtacaccaccgtgggccgcatggatcagggggtgggactggtgttgcaggagcttcgcgacgccggtgtcctgaatgatactctcgtcatcttcacctcagacaacggaatcccttttccatcgggtaggactaatctgtactggccgggcactgccgaaccgttgttggtgagcagcccggaacacccaaagcgttggggccaagtgtccgaggcatacgtgtccctcctggatctgacgcctaccatcctcgactggttttcgatcccgtacccgtcatacgccatcttcggatcaaagactatccaccttaccggacggagcctcctcccagccttggaagcggaaccgctgtgggcgaccgtgttcggaagccagtcgcaccacgaggtgacgatgtcctaccccatgcggtcggtgcaacaccggcacttccgcctggtccacaatctgaacttcaagatgcctttcccgatagaccaggacttttatgtgagcccgacctttcaagatctgctgaaccggaccaccgcagggcagcccaccggctggtacaaggacctgcggcactattactaccgcgcaaggtgggaactgtacgatcggtcgagagatcctcatgaaacccagaacttggccaccgatccgcggtttgctcaactcttggaaatgctccgggaccaactggccaagtggcaatgggagactcatgacccttgggtgtgcgccccggatggtgtcctcgaagaaaagctgagcccacagtgtcagcctctgcataacgaactg

SEQ ID NO: 250688 - DNA, 1506 bp, Artificial Sequence
  Description of Artificial Sequence: Synthetic coding sequence
atgtcatgcccggtccccgcctgctgcgcgctgctcctcgtgctggggctgtgtagggccaggccgagaaacgccctgctgctgttggcagacgatggaggatttgaatccggagcctacaataacagcgcaatcgcaacccctcaccttgacgcgctcgctagacgcagcctgctgtttagaaacgcatttacctccgtttcctcctgcagcccctcgagggcttccctgcttaccggtttgccgcagcaccagaacggaatgtacggtctgcaccaggacgtccaccatttcaacagcttcgacaaagtgcggtccctgccactcctgctcagccaggccggagtgagaaccggcatcatcggaaagaaacacgtggggccggaaactgtgtacccattcgatttcgcctacaccgaggaaaacggatcggtgcttcaagtgggtcggaatatcacccggatcaagttgcttgtgcggaagtttctgcaaactcaagatgataggccgttcttcctgtacgttgcctttcacgatccgcaccgctgcggacactcccagccgcaatacggaactttctgcgaaaagttcggaaacggagagtcggggatgggacggatccctgactggacgcctcaggcctatgatcctctcgatgtgttggtgccgtactttgtgccgaacactccagcggctcgcgcagatctggcggctcaatacactactgtcggcagaatggaccaaggagtcggactggtgttgcaggaactgcgggacgcgggagtcctcaatgatacgctcgtcattttcaccagcgataatgggatcccgttcccatcgggacgaaccaacctttactggcctggcactgcagagccgctcctcgtgagctcgccagagcatccgaagcggtggggtcaggtgagcgaggcttacgtgtccctgctggatctcactccaaccatcctggactggttcagcatcccgtacccgtcatacgccatctttggctccaagactatccaccttaccggcaggtccctgctgcccgcgcttgaagccgagccactctgggctactgtgttcgggtcccaaagccaccacgaagtcaccatgagctatccaatgagatctgtgcagcaccgccacttcagactggtccacaatctcaacttcaagatgcctttcccgattgatcaggatttctacgtgtcgccgacgttccaagacttgctgaacaggactaccgcggggcagccgaccggatggtacaaggacctcaggcactactactacagggcacggtgggagctgtacgatcggtcgcgggacccccatgaaacccagaatttggccaccgacccccgcttcgcgcaacttctcgagatgttgcgcgaccagctggcaaagtggcagtgggaaacccatgacccgtgggtgtgcgcccctgatggagtccttgaagagaaactttcgccgcagtgccagcccttgcataacgaactg

SEQ ID NO: 250689 - DNA, 1506 bp, Artificial Sequence
  Description of Artificial Sequence: Synthetic coding sequence
atgtcctgtcccgtcccagcctgctgcgctcttctcctcgtcttgggcctttgtagggctcgccccagaaacgccctgctcctgctggctgatgatggtggctttgagtccggcgcttataacaattctgccatcgctacccctcatttggatgctcttgctcgtcgtagcctgctctttaggaatgctttcaccagcgtgtcttcctgttcaccttctagagccagcctgctgaccggccttccccagcaccaaaatggcatgtatggcctgcaccaagatgtccatcactttaactccttcgataaagtgaggagtctgcctctgctgctgtcccaggccggagtcaggacaggtatcatcggtaagaagcacgtcggtcccgagaccgtgtatcccttcgacttcgcctacaccgaagaaaatggaagcgtactccaggtgggccgtaatatcaccaggattaagcttttggtcaggaagtttcttcagacacaggatgatcgcccttttttcctctatgtggcctttcatgatccccaccgttgtggccactcacagccccagtatggaaccttctgcgagaaattcggcaatggcgaatccggtatgggccgcatccccgattggaccccccaggcctacgatccattggatgttctggtaccatacttcgtgcctaacacacctgctgccagggctgacctggccgctcagtatactaccgtaggtagaatggaccagggcgtgggactggttctccaggagctgagagacgctggcgtgttgaatgacactctggtgattttcactagcgataacggcatccccttcccttccggcaggacaaacctgtattggcccggtactgccgagcctctcctggtgagctcacctgagcatcctaagcgctggggccaggtaagcgaggcttatgtgtctctgctggatctgacaccaaccatcttggactggttctccatcccttaccctagctatgcaatcttcggatccaaaaccatccaccttacaggacgctccctccttcccgcattggaggctgagccactctgggctaccgtgtttggtagccagagtcaccacgaggtgaccatgtcttatccaatgagatctgttcaacatcgccacttccgcttggttcataacctcaacttcaagatgccattccctatcgatcaggatttctacgtaagccctaccttccaggatctccttaacaggactacagctggtcagcctacaggttggtacaaggatctgcgccactactactacagggcaaggtgggaactgtatgataggagccgcgatccacacgagacccagaacttggctaccgatccaagattcgcacagcttctcgaaatgctgcgcgaccaactcgcaaagtggcagtgggaaactcacgacccctgggtgtgtgcaccagatggagtgttggaggaaaagctgagcccccaatgtcagcccttgcacaacgagttg

SEQ ID NO: 250690 - DNA, 1506 bp, Artificial Sequence
  Description of Artificial Sequence: Synthetic coding sequence
atgtcctgtccggtgcccgcttgctgtgctttgctccttgttctcgggctctgccgtgccaggcctcgcaacgcgctcttgttactggcggatgacggcggtttcgaaagcggcgcctacaataattcagccatcgccacccctcacctggacgctttggcccggagaagtctgcttttccggaacgcattcacatctgtttctagctgctctccctccagggcctcgctcctgaccggactgccccagcatcagaatggcatgtatggcttgcaccaggacgtgcaccactttaactctttcgacaaagtcaggagcctccccttactcctttctcaggccggagttaggaccgggattatcggaaagaaacatgtagggccggagacagtgtacccctttgatttcgcatacactgaggaaaacggcagcgttctccaggtgggaagaaacataactaggatcaagttactggtgcgcaagttccttcagacacaggatgaccggccgttcttcctttatgtggccttccacgacccccaccggtgtgggcactctcagccccaatacgggactttctgcgagaagttcgggaacggtgagagtggaatggggcgaattcccgattggacacctcaggcatatgatcctcttgatgtgttggtaccttacttcgtgcccaatacacctgcagccagggctgacctggcagcacaatatactactgttggacgaatggaccagggggtagggctcgtcttacaggagctgcgggacgccggggtgctgaacgacaccttggtcattttcaccagcgacaatgggatcccatttccctctggccgtaccaatttgtattggccaggtaccgctgagcctttactggtgtcttctccagaacatcccaaacgatggggccaggtgagcgaagcctacgtgagtctcttagacctcacccccaccatcctggattggttcagtatcccttatccaagctacgcaatcttcggctcaaagacaatacatctcactggacggtctttactgcccgctctggaggcagaaccgctgtgggccaccgtctttggttcgcaatcccaccacgaagtcaccatgagctacccaatgagaagtgtgcagcaccggcatttccgactggtgcataacctgaatttcaaaatgcccttccccattgatcaggatttttacgtttcgcctactttccaagatctcctaaaccggaccacggctggccagcctacaggctggtacaaagacctgcggcactactactaccgcgcaaggtgggagttatacgaccgatcgcgcgatccccacgagactcagaacctggctactgatccgcggttcgcgcagcttttggagatgcttagggatcagttggccaagtggcagtgggaaacccacgacccatgggtctgcgccccggacggcgtgttggaggagaagttgagtcctcagtgccagccccttcataacgagctc

SEQ ID NO: 250691 - DNA, 1506 bp, Artificial Sequence
  Description of Artificial Sequence: Synthetic coding sequence
atgtcctgtccagtccccgcctgctgtgccttactattagtgctgggcctatgtcgcgctcgcccaagaaacgcactgctcctcctagctgacgatggaggtttcgagagcggggcctataataatagcgctatagctactcctcacctggacgctctcgccaggcgttctttactctttagaaacgcctttaccagcgtgagctcatgctctcccagtagagcaagcttgctaaccgggcttccgcaacaccaaaatggaatgtacggcctgcatcaagacgttcatcactttaattctttcgataaggtccgcagtctccctttgctgttatcccaggccggtgtgcgaacagggatcataggtaagaaacatgttggcccagagacagtttaccccttcgacttcgcctatactgaagagaacggcagcgttctccaagtgggacgcaatatcaccaggattaagctgttagtccgaaaatttttacagacgcaggatgacaggcctttctttctctatgttgccttccatgatccacacaggtgcggtcatagccagcctcagtacggaaccttttgcgagaaattcggaaacggagagagcgggatgggcagaatccccgactggacacctcaagcgtacgaccccctcgacgtgctcgtcccatatttcgtcccaaatactcctgcagcccgagcagacctggcggctcagtacaccacagtcggcaggatggaccaaggcgtaggactggttctgcaggagctaagggacgctggggtgctgaacgacaccctagttatttttacaagtgataatggtatccccttcccttctgggcgcaccaatctttactggcccgggacagcagagcctctattggtgtcgagtccagagcaccctaaaaggtggggtcaggtctcagaggcctatgtgagcctgctggacctaacaccgaccatcctggattggttttcgattccgtatccctcatacgctatctttggaagtaagaccatccatctgaccggtagatcactgcttccagccttggaggcagagccactttgggcaacagtatttggatcacagtcccatcacgaagtcaccatgagctaccctatgcgcagtgtgcagcaccggcattttagactcgtgcataacctgaacttcaagatgcccttcccaatcgaccaggacttttacgtaagcccaacttttcaggacctcctgaacagaactacagccgggcaaccgacagggtggtacaaggacttacgacactattactacagggctcgatgggaactgtatgataggtcacgcgatccgcatgaaacccagaacttagctaccgatccgcgctttgcccagttgctcgaaatgctcagggatcaactcgcaaaatggcagtgggagacccatgacccatgggtgtgcgcccctgacggcgtgttagaggagaaactgtcaccccagtgccagcctctccacaatgaattg

SEQ ID NO: 250692 - DNA, 1506 bp, Artificial Sequence
  Description of Artificial Sequence: Synthetic coding sequence
atgtcctgtcccgtgcctgcatgctgcgccctgctgctcgtgctgggactctgccgggcgagaccaagaaacgctctcttactattagccgacgatggggggttcgagtccggagcatataacaattctgcaattgccaccccacatctggatgccctcgcccggcggagtctgctgttcagaaatgcttttacttctgtgtcgagctgtagcccatccagggcaagtcttctgactggattgcctcagcaccaaaacgggatgtacggcttgcaccaggacgtgcaccattttaattcttttgataaggtgagaagtctgccccttctgctatcgcaggctggagtccgtaccggcattattgggaagaaacatgtggggcctgagaccgtctatccttttgatttcgcctatactgaagagaacggatccgttttgcaagtcggtagaaatataacccggattaaactgctcgtgcgtaaattcctgcagactcaggatgatagacccttcttcctgtacgtggcttttcacgatccacatcgctgtggccactcacagccgcagtacggtaccttttgtgaaaagttcggaaatggggagtccggcatgggacggatccctgactggaccccccaggcttatgatcctttggacgttttggtgccttacttcgtaccaaatacacctgcagcgagagccgaccttgccgctcagtacacgacagtagggaggatggatcagggggtgggattggtcctgcaggaactgcgggatgcgggcgttctgaacgatactctggttatttttacgagtgataatggcataccgtttccctcgggccgaaccaatctgtattggcccggtacggctgagccactcctggtctcttctcctgaacacccaaaacgatggggacaggtcagcgaagcctacgtttccctgctggacctcaccccaaccattctggattggttctccattccatacccaagctatgcgatctttggctctaagacaatacacttaactggaagatctcttttgcctgccttggaggcggaacccctttgggccactgtgtttggttctcagagccaccatgaggtgacaatgtcctaccctatgcggagtgtacagcatcgtcacttcaggttggttcacaatcttaactttaagatgcccttcccaatagaccaggatttctatgtgtcaccaacattccaggacctgctaaatcgtactactgccggacaacctacaggatggtataaggacctgcgacactactattaccgtgcccggtgggaactgtatgaccgaagtcgtgacccacacgaaacgcagaatctcgcaacagacccacggttcgctcagctgctcgaaatgctgcgagatcagctcgccaagtggcagtgggaaacacatgatccctgggtttgcgctcctgatggggtcctggaagaaaagctgtcaccccagtgccagccgctccacaatgagctg

SEQ ID NO: 250693 - DNA, 1506 bp, Artificial Sequence
  Description of Artificial Sequence: Synthetic coding sequence
atgtcttgcccggtccctgcctgttgtgccctgctgttggtgcttggcctatgcagggcccgcccaagaaatgcgctactgttactggctgatgatgggggcttcgaatctggcgcttataacaacagtgcaatcgcgaccccacatctcgacgctctggcacgtagaagcttactgtttcgcaacgccttcacatctgtgtcatcttgcagcccaagccgggctagtcttctgaccgggctgccccagcaccagaacggaatgtacggattgcaccaggatgtgcatcatttcaattccttcgacaaagtgaggagcctgccactcctgttgagccaggccggagtgcgcaccgggattattggcaagaagcacgttggcccagagaccgtttacccgttcgattttgcttataccgaagaaaatggcagcgtgctgcaggtcgggagaaatatcacccgaatcaagctgctggttaggaaattccttcagacgcaagatgatagaccctttttcctgtatgtagccttccacgacccacatcggtgcggccattctcagcctcaatacggcactttctgtgaaaagttcggaaatggtgagtcaggaatggggcgcatccctgactggacaccgcaggcttatgaccccttggacgtgttggtgccatatttcgtgcccaacacacccgccgcacgggcagacttggctgcacagtatactacagtgggccggatggaccagggcgtgggactagtgctgcaggaacttagggacgcaggcgtactgaatgatactctagtgatttttacctctgacaacggcattccttttccttcgggacggacaaacctctattggcccggaaccgccgagccactcctggtaagctcccccgaacaccctaagaggtggggccaggtcagcgaggcctatgtgagcctgctagacctgacacctaccatacttgactggttctccatcccttacccctcttacgctattttcggatcaaagacaatccacctcactggtcgcagtcttcttcccgcgctggaggccgaacctctgtgggccactgtgttcggaagccagagtcatcacgaggtgacgatgagctaccccatgcgcagtgtgcagcataggcactttcgtctagtccataatctgaattttaagatgccctttccaatagaccaggacttctatgtgtcacctactttccaggatctcctcaatagaacgacagcagggcagccaaccgggtggtataaagacttgcgccattactactacagagcgcggtgggaactgtacgacagaagtcgagacccccatgagactcagaacctcgccacggatcctcgattcgcacagctgcttgaaatgctacgcgaccaactggcgaaatggcagtgggaaactcatgacccttgggtgtgtgccccagatggcgtgctcgaggaaaagctgtccccacaatgtcagcccctgcataacgagtta

SEQ ID NO: 250694 - DNA, 1506 bp, Artificial Sequence
  Description of Artificial Sequence: Synthetic coding sequence
atgtcgtgtccggtaccggcgtgttgtgcgttattactagttctaggtctatgtcgagcgcgtccgcgtaatgcgctattattattagcggatgatggtggttttgaatcgggtgcgtataataattcggcgatagcgacgccgcatttagatgcgctagcgcgacgttcgctattatttcgtaatgcgtttacgtcggtatcgtcgtgttcgccgtcgcgagcgtcgctactaacgggtttaccgcaacatcaaaatggtatgtatggtttacatcaagatgttcatcattttaattcgtttgataaagttcgatcgttaccgctattactatcgcaagcgggtgttcgtacgggtataataggtaaaaaacatgtaggtccggaaacggtatatccgtttgattttgcgtatacggaagaaaatggttcggttctacaagtaggtcgaaatataacgcgaataaaattactagttcgtaaatttttacaaacgcaagatgatcgaccgttttttttatatgtagcgtttcatgatccgcatcgatgtggtcattcgcaaccgcaatatggtacgttttgtgaaaaatttggtaatggtgaatcgggtatgggtcgaataccggattggacgccgcaagcgtatgatccgttagatgttctagttccgtattttgtaccgaatacgccggcggcgcgtgcggatttagcggcgcaatatacgacggttggtcgtatggatcaaggtgtaggtctagttctacaagaactacgagatgcgggtgtactaaatgatacgctagtaatatttacgtcggataatggtataccgtttccgtcgggtcgtacgaatttatattggccgggtacggcggaaccgttactagtatcgtcgccggaacatccgaaacgttggggtcaagtttcggaagcgtatgtatcgctactagatctaacgccgacgatactagattggttttcgataccgtatccgtcgtatgcgatatttggttcgaaaacgatacatttaacgggtcgttcgttactaccggcgctagaagcggaaccgttatgggcgacggtatttggttcgcaatcgcatcatgaagtaacgatgtcgtatccgatgcgatcggtacaacatcgtcattttcgtctagtacataatttaaattttaaaatgccgtttccgatagatcaagatttttatgtttcgccgacgtttcaagatttactaaatcgtacgacggcgggtcaaccgacgggttggtataaagatttacgtcattattattatcgtgcgcgatgggaactatatgatcgatcgcgtgatccgcatgaaacgcaaaatttagcgacggatccgcgttttgcgcaactactagaaatgctacgtgatcaactagcgaaatggcaatgggaaacgcatgatccgtgggtttgtgcgccggatggtgtactagaagaaaaattatcgccgcaatgtcaaccgttacataatgaacta

SEQ ID NO: 250695 - DNA, 1506 bp, Artificial Sequence
  Description of Artificial Sequence: Synthetic coding sequence
atgtcatgcccggtgccagcttgctgcgcattgttgctcgtgttgggactttgccgggccaggcctcgcaacgccctccttcttttggccgacgacggtggtttcgagagcggagcgtacaacaacagcgccatcgcaaccccacatttggacgcgctggctcgccgttccctgctgttccgcaatgctttcacttcagtctcatcttgttcaccgtcgcgggcatcactcctcaccggcctcccacagcatcagaacggcatgtacggtttgcatcaggatgtccatcatttcaactctttcgataaggtgcgctcgctgccacttctgctcagccaggctggcgtcagaactggcatcatcggcaagaaacacgtgggaccagagactgtctaccctttcgatttcgcctatactgaagagaatggatccgtgttgcaggtgggcagaaacatcacccggattaaacttctggtcagaaagttcctccaaacgcaagacgacagaccgttcttcttgtacgtggcgtttcacgatccgcaccggtgtgggcactcccagccacagtacggcactttttgcgaaaagttcggcaatggagagtctggaatgggaaggattcctgactggaccccacaggcatacgatccactggatgtgctggtgccatacttcgttccaaacactccggccgctcgggccgaccttgcggcgcagtacactaccgtgggccgcatggatcaaggggtgggactggtgttgcaagagctgagagacgccggtgtactgaatgacacgcttgtcatcttcacttcggataacggaatcccgttcccctccggccggaccaatctgtactggccaggaaccgcggaaccgctccttgtgagctccccggaacaccccaagaggtggggacaggtttcggaggcttatgtgagcctgctggatcttactccgactattctcgactggttttcgatcccgtacccgtcctacgcgattttcgggtcaaaaactattcacttgaccgggcgctccctcctgccggccttggaagccgaacctctgtgggcaacggtgttcggatcgcaaagccatcatgaagtcacgatgtcctaccccatgcgcagcgtgcagcacagacacttccgcctggtgcacaatctgaacttcaagatgccgtttccgattgaccaagatttctatgtgtcgccaacttttcaggacctgctgaaccgcactactgcaggacagcccacgggatggtacaaggacttgcgccactactactacagggcccggtgggaactgtacgaccgctccagggatccgcatgaaactcagaatctggccacggacccgcggtttgcacagcttctggagatgcttcgggaccaactggccaaatggcaatgggagactcacgacccctgggtctgcgcgccggacggtgtgctggaagaaaagctgagcccccagtgccagcctctccacaatgagttg

SEQ ID NO: 250696 - DNA, 1506 bp, Artificial Sequence
  Description of Artificial Sequence: Synthetic coding sequence
atgtcttgtccagtccccgcctgttgtgccctgctattagtgctgggattatgtcgcgccagaccccgaaatgctctactgctcttggctgatgatggaggcttcgagtcaggagcgtacaataactccgctatcgccactccacacctggacgcacttgctaggagatccctcctctttcgcaacgcattcacgtcggtgagttcatgtagcccctctcgcgccagtttgctcacagggctgccccagcatcagaatggaatgtacggactgcatcaggatgttcatcactttaattctttcgacaaggtgcgttccctgccacttctactttcccaggctggggtgaggacgggcatcattggtaaaaagcacgtgggccctgaaactgtgtatccgttcgatttcgcatacaccgaggagaatggttcagtgttgcaagtgggtcgaaatattaccagaattaagttgctagtacgcaaattcttgcagacacaggatgatcgccccttttttctatatgtcgcctttcacgatccacatagatgcggacacagccagccacagtacggcacgttttgtgagaaattcggcaacggcgaatcgggtatggggcgcatccctgattggaccccccaagcatacgaccccctggacgtactggttccctacttcgtccctaatactcctgcagccagagcggatctagctgctcaatacactacggttggaaggatggatcagggggtaggcctggtgctccaggagctgcgcgatgccggcgttctcaatgacacgctggtgattttcacttccgacaatggaatcccttttccttcaggccgcacgaatctgtactggcctggcacagcagagccactgttggtgtcttcccctgaacacccaaagaggtggggacaggtgagcgaggcttatgtctcattgctggacctgactcctactatacttgactggttctccatcccctacccaagttacgcgatattcggctccaaaactattcacctgacgggccgcagcctgctgcccgcactcgaggcagaacccctgtgggccacggtgtttggctcccaatcccaccatgaggttaccatgtcttaccccatgcgctcggtgcagcacagacattttcggctggtgcataatcttaacttcaagatgcctttccccatcgaccaagacttctatgtgtcccctacgttccaggacctgctcaatcgcacaactgcggggcagcccaccgggtggtataaagatctcagacactactactatagagctaggtgggaactttacgacagaagcagagacccccacgaaacgcagaatctcgccacagatcctagatttgcgcagctcctcgagatgctgcgggatcaattggccaagtggcagtgggagacgcacgatccttgggtctgcgccccggacggggtgctggaggaaaaactttctcctcagtgtcagcctctgcataatgaactg

SEQ ID NO: 250697 - DNA, 1506 bp, Artificial Sequence
  Description of Artificial Sequence: Synthetic coding sequence
atgtcctgccctgtgccagcttgttgcgctctgctgctcgttcttggactctgcagggctcgcccaagaaacgccctcctccttctggctgatgacggaggcttcgaatccggagcatataataattccgccatcgctacaccgcaccttgacgcgctggctcgcagaagtctcctctttcggaatgcgtttacttctgtatcttcttgtagccccagcagggcctcactcctgacaggactgcctcaacaccagaatggcatgtacgggctgcatcaggacgtgcaccacttcaactcgttcgataaagtcagaagtttgcctctcctacttagccaggctggagttaggactggcattatcggcaaaaaacatgttggaccagaaacggtctatccatttgatttcgcttacaccgaagagaacgggtccgttcttcaggtgggtcgcaacattaccaggatcaagctgttagtccgtaaatttcttcaaacgcaagacgataggccattctttttgtacgtagcttttcacgatccgcaccgctgtgggcacagtcaaccacaatacggtactttttgtgaaaagtttggaaatggtgaatctgggatgggcagaatcccagactggaccccccaagcatacgaccccttagacgttctggtcccctactttgttcctaatactccagccgctcgcgctgacctagccgctcaatataccaccgttggacggatggaccaaggggttggcttggtattgcaggaactgagagatgccggcgtacttaacgatactctggtcatcttcacctctgacaatggcatccctttccctagtggaaggacgaatctctattggcctggcaccgctgagccacttctggtgtcttctcctgagcaccccaagcggtggggacaagtgtcagaggcttacgtcagcctcttggatcttaccccaactatcctggactggttcagcattccatacccaagttacgctatcttcggttctaagacaatccatctgaccggcaggagcttgcttcccgctctcgaggcagaacctctatgggcaacagtgtttgggagccaatctcatcacgaagtgactatgagctacccaatgaggagtgtccagcacagacattttcgccttgtccacaacctaaacttcaagatgccatttcccattgaccaagacttctatgtgagccccacgtttcaggatctgctgaacagaactactgccggtcaacctaccgggtggtacaaagaccttcgccattactattaccgagctagatgggagctgtatgaccgaagcagggacccacacgagacacagaacctggcgaccgatcccagattcgctcagcttctcgaaatgcttagagatcagctggcaaaatggcagtgggagacacatgatccttgggtctgtgcccctgacggcgtgcttgaggaaaagctctcaccccaatgccagccacttcacaatgaactg

SEQ ID NO: 250698 - DNA, 1506 bp, Artificial Sequence
  Description of Artificial Sequence: Synthetic coding sequence
atgagctgcccggtcccagcgtgctgcgcgctcctgctggtgctcggactttgtcgggccagaccaaggaacgccctcttgctgctcgcagacgacggcggattcgaatcgggtgcttacaacaactcggccatcgccacgccgcacctggacgcccttgcgagacggtcactgctctttagaaacgcgttcactagcgtgtcctcgtgttcgcctagccgcgcttcgctgctgaccggactgccgcagcatcagaacggcatgtacgggctgcaccaggacgtgcaccatttcaactcctttgacaaggtgcgctcgctcccgctgctgctcagccaagcaggagtgcggactggaattatcggaaaaaagcacgtgggccctgagacggtgtaccctttcgacttcgcgtacaccgaagagaatgggagcgtgctccaggtgggtcggaacatcacccgcatcaagttgctcgtgcgcaagttcctccaaactcaggatgatcggccgttcttcctgtacgtcgcgttccacgacccgcatcgctgcggccactcacaaccacagtacggaactttttgcgaaaagtttggtaacggcgagagcggcatgggacgcatcccggattggaccccccaggcctacgatccccttgatgtactggtgccctacttcgtccctaacaccccagccgctcgggctgacctggccgcgcaatacaccactgtgggccgcatggatcaaggggtgggactcgtcctgcaagagctcagggacgccggtgtgttgaacgacactctggtcatctttaccagcgataacggaattccctttccttcgggtcgcacgaatctgtattggcccggaactgccgagcctctgctggtgtcaagccccgaacacccgaagaggtggggtcaggtatcagaggcttatgtttcactgctcgatctgacccctactatcttggactggttcagcatcccatacccgagctacgcgatcttcggttcaaagaccatccacctcaccggaagatcccttctgcctgcgttggaagccgaacccctctgggcaactgtctttggatcccaaagccatcacgaagtcaccatgtcatatccgatgcgatcggtgcaacacagacacttccgcctcgtgcataacctcaatttcaagatgccgttcccaatcgatcaggacttttacgtctcgccgaccttccaggatcttctgaacaggaccaccgcaggacagccgacggggtggtacaaggacttgcggcattactactacagagcccgctgggagctctacgatcgctcccgcgacccgcatgagactcaaaatctcgctaccgacccacggttcgcccagctcctggagatgctccgcgatcagctggcgaagtggcaatgggaaacccacgacccgtgggtgtgtgccccagacggcgtcctcgaggaaaagctgtcgccgcaatgtcaaccactgcataacgaactg

SEQ ID NO: 250699 - DNA, 1506 bp, Artificial Sequence
  Description of Artificial Sequence: Synthetic coding sequence
atgagctgcccagtccccgcatgctgtgcccttcttctggttctcggattgtgccgtgcccgacctcgcaacgcattactactcctcgctgatgatggggggtttgaatcgggagcctataacaactccgctattgccaccccgcacctggatgcccttgcccggcgtagcctactgttccgcaacgcctttacatcagtgtcatcctgtagtccgagccgcgcctctcttcttaccggtctcccgcagcatcagaatggaatgtatggtctccatcaggacgtccatcacttcaattcatttgacaaagtgagatctctcccactactgttgtctcaagccggggtgagaacgggtatcatcggcaaaaaacacgttggaccggaaacggtttatccattcgattttgcttatacggaggaaaacggatctgttttgcaagtaggaaggaacatcacgcgcatcaaattattagtccgaaaatttcttcaaacacaggatgaccggcctttttttctgtatgtcgcgttccatgacccccaccgttgtggtcattcacaaccgcaatacggaacgttctgcgagaaattcgggaacggtgaaagcggtatggggcggattccggactggaccccccaagcatatgatccactcgatgttcttgtcccgtatttcgttccgaacacaccagcggcacgcgccgacttagccgcacagtacacgacagtgggtagaatggatcaaggagtcggactggtgctgcaggaacttagagatgctggagttcttaatgataccctggtcatctttacatccgataatggaattccgttcccttcaggacgcacgaatctttattggccgggaacagcagaaccccttctggtctcaagcccggaacacccgaaacgatggggacaggtatctgaagcctacgtatctctccttgacttgacaccgacaatcttagactggttctctattccatacccgtcgtatgcgatttttgggtctaagacaattcatctgacaggacggtcccttttgcccgcactcgaggcagagcctttgtgggcgacagttttcgggtcgcagtcacaccatgaggtaacaatgtcttacccgatgcggtcagtacaacatcgtcatttccgtttggtgcacaatttaaattttaaaatgcctttcccaattgaccaagatttttacgtttcgcctacgttccaagaccttctgaatagaacaacggcaggccagcctacagggtggtacaaggatctgaggcattattattatcgagctcggtgggaattgtatgatcgttctcgcgatcctcatgagacacagaatttggctactgacccgcgatttgctcagcttctggaaatgttacgcgaccagcttgctaagtggcaatgggaaacacacgatccttgggtgtgtgccccggatggtgtattagaagaaaaattatctccgcagtgtcagccgctgcataacgaactt

SEQ ID NO: 250700 - DNA, 1506 bp, Artificial Sequence
  Description of Artificial Sequence: Synthetic coding sequence
atgtcatgcccggtccctgcctgctgcgcgctgcttttggttttgggactgtgcagagcccgcccgagaaatgctctgctcctgctcgctgacgacggaggatttgaaagcggcgcttacaataattctgcaattgctacgcctcacctggatgcactcgcaagaagaagcctgttgtttaggaacgcttttactagtgtgtcctcctgctcaccttctagagcctctttgttgacaggtctgccccagcaccaaaatggcatgtatggactccaccaggatgtccaccactttaactcctttgacaaggtcaggtcacttccgctgctgttgtctcaggctggagtgaggactggtatcattggcaagaaacacgttggtccagagactgtctatcccttcgattttgcttatactgaggaaaacggtagtgttttgcaggtgggcaggaacattactcgcatcaagctgctggtacgcaagtttctgcaaacccaagacgaccgcccattcttcctgtacgtagcattccacgacccacataggtgtggccactctcaacctcaatacggtaccttctgtgagaagttcggcaatggtgagtcaggtatgggacgcatacccgactggactccccaggcttacgatcccctggatgtgcttgtaccttatttcgtgccaaacacacccgctgcaagggctgacctggccgctcagtacactactgtcggcaggatggatcaaggcgtcggacttgtgctccaagaattgcgcgacgcaggtgttttgaatgacacacttgttatctttaccagtgacaacggtatccccttcccaagcggtagaacaaatctctactggccaggtacggctgagcctctgctggtctctagccccgaacaccctaaaagatggggacaggtatctgaggcgtatgtctccctgctcgatctgacacccacaatcttggactggttttcaattccctacccgtcctacgctatatttggctccaagaccattcacctgacgggtaggagtctccttcccgccctcgaagccgagccactctgggccaccgtcttcggctcccagtcccatcatgaggtcacaatgtcttatcctatgcgctctgtgcagcacaggcattttcgcctggtccacaacctcaatttcaagatgccgttccccatagaccaagacttctacgtatctccaaccttccaggacctgctgaatagaacaaccgccggtcaacccacaggctggtacaaggatttgcgccattattactaccgcgctcgctgggagctttacgataggagccgcgacccccacgaaacccagaacctggctaccgatccccgcttcgcccagctgctggagatgcttcgcgatcaacttgcgaagtggcaatgggaaacacacgacccttgggtatgcgcaccggatggagtgctggaggagaaactctcaccacagtgtcaaccacttcacaacgagttg

SEQ ID NO: 250701 - DNA, 1506 bp, Artificial Sequence
  Description of Artificial Sequence: Synthetic coding sequence
atgtcatgtcccgtgccagcgtgctgcgccctgctgctggtgcttggattgtgcagagctcgcccgcggaatgccctgttgctgctggccgatgacggaggattcgaatcgggcgcctacaacaattccgcgatcgcgacccctcacctcgatgctctggcacgccggagcttgctcttcaggaacgcatttacctcagtgtcaagttgcagccctagcagagcctccctgctcaccggactcccacagcatcaaaacggcatgtacggacttcaccaagacgtgcaccatttcaactcgtttgacaaggtgcgctccctcccgctgcttctgagccaggccggagtgcgaactggcatcatcggcaagaagcacgtcggaccggaaactgtgtaccccttcgatttcgcatacactgaagaaaacggttcagtgctgcaagtcggacgtaacatcacgcgtatcaaacttctcgttcgcaagttcctgcagactcaggacgatcgacctttcttcctgtacgtggccttccacgacccgcacaggtgcgggcatagtcaaccgcagtacggaaccttctgtgaaaagttcggaaacggggaatcgggaatgggtagaatcccggattggacgcctcaggcttacgacccactggatgtgcttgttccatactttgtcccaaatactccagcggcgagagcagatcttgctgcccagtacaccaccgtggggagaatggaccagggtgtgggcctcgtccttcaagaactgagggacgctggcgtcttgaatgataccttggtgatcttcactagcgacaacgggattcccttccccagcggaagaactaatctgtactggccgggaactgcagaaccgctcctcgttagcagcccagagcacccgaaacggtggggtcaggtgtccgaggcttatgtatccctcctcgatttgacccccaccatcctggactggttttccatcccgtacccatcttacgccattttcggttccaagactatccatttgaccggacggtcactgctcccggccctcgaagcggagcccctgtgggctaccgtgttcggaagtcagtcccaccacgaggtgaccatgtcatatcctatgagatctgtgcagcatcgacattttagactggtccacaacctgaactttaagatgccgttcccaattgatcaggacttttacgtgtcacctaccttccaggaccttttgaacagaactactgccggccagccgacgggttggtacaaagacctccgccactactactaccgcgctcgctgggagctgtacgacaggtcccgcgatcctcatgagacgcagaatctggccaccgacccacgcttcgcccaactccttgagatgctgcgggaccaacttgcgaaatggcagtgggagactcatgacccctgggtgtgcgcaccggacggcgtcctcgaagaaaagctgagcccacaatgccaaccgctccacaacgagctg

SEQ ID NO: 250702 - DNA, 1506 bp, Artificial Sequence
  Description of Artificial Sequence: Synthetic coding sequence
atgtcgtgcccggtgccagcatgctgtgcgcttctgctcgtgctgggactctgccgggcccgcccgcgaaatgcactgctgctgctcgctgacgatggggggtttgaatccggggcatacaacaacagcgccatcgctactccgcatttggacgccctcgcgcggagaagcctcctctttagaaacgcgttcacctcagtctccagctgttcgccgagcagggcgtctctgctgactggactgccgcagcaccagaatggaatgtacggtctgcaccaggacgtgcaccacttcaattcgtttgacaaggttcggtcgctgccgctccttctctcacaagcgggtgttcgcactggaattatcggtaagaagcacgtgggacctgaaactgtgtaccctttcgacttcgcttacactgaggaaaatggatccgtgctgcaggtgggtcgcaatatcacccggatcaaacttctcgtgagaaagttcctgcagacgcaagacgataggccgttctttctgtacgtggccttccacgacccgcatcgctgcggtcattcccagccccagtacggaaccttctgcgaaaagttcggaaacggcgaatcaggcatgggtcggatccctgattggactcctcaagcatacgatcccctggacgtgctggtgccttacttcgtccctaatactccggccgcacgcgcggatcttgcagcacagtacactactgtcgggcgcatggatcagggcgtgggcttggtcctccaagagctgcgagatgccggcgttcttaacgacactctggtgatcttcacctcagacaacggaatcccgttcccttccggaagaacgaacctttactggccgggcaccgccgaacctctgctcgtgagctcccctgagcaccctaaacggtggggacaagttagtgaagcgtacgtctcgctgctcgacctgacgcctaccattctggactggttctccattccctacccgtcttacgcaatcttcggctcaaagactatccatctgactggccgcagccttctccctgctctggaggcagaacctctgtgggccaccgtgtttggcagccagtcccatcacgaagtgaccatgtcgtacccaatgaggtccgtgcagcaccgccatttccggctggtgcataacttgaactttaagatgcctttcccaatcgatcaagacttctacgtgagcccgactttccaagatctgctgaaccggactactgccggccagccgactgggtggtacaaagacctgagacattactactacagggcacggtgggaactctacgatagatcccgcgatccgcacgaaacgcagaacttggcgaccgatccgagattcgcgcagctgctcgagatgctccgcgaccaactcgctaagtggcagtgggaaacccatgatccgtgggtgtgcgcgcctgacggagtgctcgaggaaaagttgtccccgcaatgccagccactccataacgagctg

SEQ ID NO: 250703 - DNA, 1506 bp, Artificial Sequence
  Description of Artificial Sequence: Synthetic coding sequence
atgtcgtgccccgtgccagcgtgctgcgcactgcttctggtactgggcctttgtcgagcacgaccccggaacgccctgctgctgctggctgatgacgggggctttgaaagcggcgcttataacaattccgccatagccaccccccatctggacgcactggctcgcagatcacttcttttcagaaacgcatttacatccgtttcgagctgttcgccatcaagggcctcacttttaaccggtttgccccaacatcaaaacggaatgtacggcctgcatcaagacgtgcaccacttcaactctttcgataaggtgaggagcctgccgctgctcctgtcccaagcgggtgttaggacaggcattatcggaaagaagcacgtaggccctgaaacagtttatccatttgacttcgcctacaccgaagagaacggatctgtactccaggtgggtcgcaacatcacccgtataaaattactcgtgcggaagttcctccaaacccaggacgaccggccgttttttctgtacgtggcatttcatgatccacatcgctgcggccatagccagccacagtatggcacgttttgtgagaagttcggtaacggggagagcggcatgggccgcatccccgattggacacctcaggcgtacgatccgctagatgtcttagttccatacttcgtgcccaacacgcccgccgctagagccgacctcgctgctcagtatacaaccgtggggcggatggaccagggtgttggcctggtgctccaagaactcagggacgcaggcgtgctgaatgatacacttgtgattttcaccagtgacaacggcattccttttccatccggcagaaccaacctgtactggcctggcacagctgagccactgctcgtgtctagcccagagcaccctaagcgttggggtcaggtcagcgaagcttatgtgagcctgctggatctgacccctactatcctagattggttctccatcccataccctagctatgcaatcttcggatcaaagactatccatctcacaggaaggagcctgcttcccgctctcgaagccgaaccactgtgggccaccgtattcgggagccagagtcaccacgaagtgactatgtcataccccatgaggtccgtgcaacacagacatttccgtttggttcacaaccttaactttaagatgcccttcccaatcgatcaggacttttacgtgtctcctacatttcaggatctcctgaacagaacaactgcaggacagccaaccggatggtacaaggatcttcgccactactactaccgggctagatgggagctgtatgatcgtagccgagatccacatgaaacccagaaccttgcgaccgatcctaggtttgctcagctcctggagatgctcagagaccaactggccaaatggcaatgggagacccacgatccatgggtctgtgcaccggatggggtgttggaagagaagttgagtccacaatgtcaacctctgcacaacgagctg

SEQ ID NO: 250704 - DNA, 1506 bp, Artificial Sequence
  Description of Artificial Sequence: Synthetic coding sequence
atgtcttgccccgtacccgcatgctgcgcactgctgttggtgctcggattatgtcgggccaggccaaggaatgcccttttactactggccgatgacggagggtttgaaagtggggcgtataataactcagccatagccacgccacatttggatgctttggccagacggtctctcctgttcaggaatgcttttacatctgtaagttcatgctctccttctagggctagtcttttgacagggttacctcaacatcagaacggaatgtatgggctgcatcaggacgtacaccacttcaattcatttgataaagttcgctccctacctctgctgctgagtcaggccggggtgcggacagggataatagggaaaaaacacgtcggacctgaaacagtatatccttttgattttgcctatacagaggaaaacggatctgtgctccaggtgggacgcaatataacaagaatcaaactgctggtcaggaaattcttacagacacaggatgatcggcctttctttctttatgtcgctttccatgatccacatagatgtgggcactcacagccccagtatgggacattctgtgaaaaatttgggaatggggaatccggaatggggcgaattccagattggactccacaggcctatgatcctcttgatgttctggttccttatttcgtgcctaacacacccgcagcacgagccgatttggcagcccagtatactactgtggggagaatggatcagggagtagggttagtgcttcaggagctcagagacgctggagtgctcaacgatactctcgtaatctttacatccgataacgggattcccttccccagtggacggacaaatctgtactggcctgggacagctgaacctttgttagtgtctagtcctgagcaccctaaaaggtgggggcaggtttcagaggcctatgtttccctcctagatctgactcctacaatcctagattggttttctataccctacccctcatatgctattttcggatctaaaacaatacacttaacaggacggagtctattacccgcactggaagctgaaccactgtgggctacagtcttcgggtcacagtcccaccacgaagtgacaatgtcctatcccatgagaagtgtacagcaccgccatttcagactagtgcacaatcttaattttaaaatgccattcccaatcgatcaggatttctatgtgtctcccacattccaggatctgctgaatagaacaactgccggacagcccacagggtggtacaaagatctccgccactattattatcgtgcccgctgggaactctacgatcgctctagagatcctcatgaaacacagaacttagctactgatcccagattcgctcagttacttgaaatgctccgggaccagctcgcgaagtggcagtgggaaactcatgatccctgggtctgtgcaccagatggggtattagaagaaaaattgtcacctcagtgtcagccccttcataatgaactg

SEQ ID NO: 250705 - DNA, 1506 bp, Artificial Sequence
  Description of Artificial Sequence: Synthetic coding sequence
atgtcatgcccggtcccagcatgctgtgcgctgctcttggtgctgggattgtgcagagcccgcccgcggaacgctctgctgttgctggcggacgacggaggattcgaaagcggcgcgtacaacaactcggccatcgctactcctcatctcgacgcactggcccgtagatccctgctgttccgcaatgccttcacttcggtgtcctcctgctcgccgtcccgggcgtcgttgctgaccgggctgccgcagcatcagaatggcatgtacgggttgcaccaggacgtccatcactttaactcgtttgataaggtcagatcactcccgctcctgctgtcccaggcaggtgtgaggaccggcatcattggaaagaaacacgtgggaccggaaaccgtctacccgttcgacttcgcctacacggaagagaacggatcggtgctccaagtgggcaggaacatcaccagaattaagttgctcgtccgcaagtttctgcaaactcaagacgacagacctttcttcctgtacgtggcgttccacgatccccaccggtgtgggcattcccagccgcagtacggaactttctgcgagaaatttggaaacggggaatcgggcatgggcagaatcccggactggaccccccaagcctacgacccgctcgatgtgctcgtgccgtacttcgtgccgaatactcccgcggcacgcgcggacctggccgcccagtacactaccgtgggtagaatggaccagggtgtgggactggttctgcaggaactgcgcgacgccggtgtactgaacgataccctggtcatattcacgtccgacaacggcatcccgttcccttccggacgcaccaacctgtactggccaggaaccgccgaaccactcctggtgtcatcaccggaacatccaaagcgctgggggcaggtgtcagaggcgtacgtgtcactgctggacctcactccgaccatccttgattggtttagcattccatacccgagctacgccattttcggatcaaaaactatccaccttaccggtcgttcactcctcccggcgctcgaggcggagccactgtgggccaccgtgttcgggagccagtcccaccacgaggtcacgatgtcgtacccgatgcggtcagtgcagcatcgccactttagactcgtgcataacctgaacttcaagatgccgttcccgattgatcaagacttctatgtgtcaccgaccttccaggacctgctgaaccgcaccaccgcgggacagccgactggatggtataaagacctgcgccattactactacagagcccggtgggaactttacgatcggtcgcgggacccacatgagactcagaatcttgctaccgatccccgcttcgcccagctcctggagatgcttagggaccagcttgcaaagtggcagtgggaaacgcacgatccatgggtgtgtgccccggacggcgtcctggaagagaagttgtccccgcagtgccagcccctgcacaatgaactg

SEQ ID NO: 250706 - DNA, 1506 bp, Artificial Sequence
  Description of Artificial Sequence: Synthetic coding sequence
atgtcatgcccagtgcctgcatgctgcgcacttctgctggtgcttggcctctgtagggcacgtccgagaaatgcattgctcctgctggctgacgacggcggctttgaatcgggcgcgtacaacaatagcgcaattgccactccccaccttgatgcgctggctcgccgatcactgctttttcgcaacgcgttcacctccgtgagctcatgttcaccttcacgagcatcccttcttactggactccctcagcatcagaacggaatgtatggcctccatcaggatgtccaccacttcaattccttcgataaggtgcggagcctccctcttctgctgtcgcaagccggcgtccgaactgggataattgggaagaagcatgtgggacccgagactgtctacccatttgattttgcatacaccgaggagaacggcagcgtcctgcaggtgggtaggaatatcacccgtattaagctcctggtccggaagtttctgcagacccaggatgaccgccccttttttctttacgtggcttttcatgaccctcaccgctgtggccattcccagccacagtacggaaccttttgtgaaaagttcggtaacggcgagtccgggatgggtagaattcctgattggaccccacaagcgtacgatcctcttgatgtgcttgtgccttacttcgtgcctaacaccccagcagcacgggccgatctggcagcacaatacactactgtggggcgaatggatcaaggtgtgggcctggtgctgcaggagttgcgggatgccggagtgctgaatgacactcttgtcatattcacgtcggataacgggatcccatttccaagcggcagaactaacctttactggcccggaactgcagaacccctgcttgtgtcaagccctgaacatcctaagcggtggggccaggtgtcggaggcatacgtctccctcctggacctcacccccactatcttggattggttctcgattccatacccctcgtacgctattttcggtagcaaaactatccatcttactggaaggtccctgctcccggcactggaggcagagcccctttgggcgactgtgttcggatcgcagagtcatcacgaagtgacgatgtcgtaccctatgcgttccgtccaacacagacactttaggctggtccacaatcttaactttaagatgcctttcccaattgatcaggatttctacgtttccccaacgttccaagatctccttaataggactaccgcaggacaacctacgggttggtacaaagatcttcggcattactactacagggcaaggtgggagctgtatgatagatcgcgagatcctcatgaaacccagaaccttgcaaccgacccacgttttgcgcaacttctcgagatgcttagagatcaactcgcgaaatggcagtgggaaacccacgacccctgggtgtgtgctccggatggagtccttgaggaaaagctgagtccacagtgtcagcctctgcataatgaactt

SEQ ID NO: 250707 - DNA, 1506 bp, Artificial Sequence
  Description of Artificial Sequence: Synthetic coding sequence
atgtcgtgtcccgtgccagcttgttgtgccctgcttctggtactcggactgtgccgggctcggccacggaatgctctgctgcttctggcagacgacgggggtttcgaaagcggggcttacaataacagtgcgatagctactccccatctggacgctctggcccgtcggtctctgttgtttagaaatgcgttcacatcggtatcatcatgttcacctagcagggcatccctcttaacgggactcccacaacatcagaacggcatgtacggactgcaccaggatgtgcaccactttaattcgttcgacaaggtccgctccctgccccttctactgagtcaggctggtgtgagaaccggaatcattgggaagaagcatgttggcccagagaccgtctacccattcgacttcgcctacaccgaggaaaatggatctgttctacaggtcggccggaacattacccgaattaagcttcttgtcaggaaattcctccaaacgcaggacgatcgcccattttttctatacgtcgcttttcacgatcctcataggtgtggccacagccaacctcaatacgggacgttttgtgagaagtttgggaacggggaaagcggcatggggcggataccagattggacaccacaagcgtacgatccactcgacgttctggtgccctatttcgtgccaaacaccccagctgctcgcgccgacctggctgcccagtataccacagttggtcggatggatcagggtgtcggactcgtattgcaagagctcagagacgcaggagttttgaacgacactctggtgatatttactagcgacaatggaattccattcccaagcggccggacgaacctttactggccaggcaccgcagagccacttttagtgagttcccctgagcacccaaagaggtgggggcaagtgagcgaagcttacgtgagtctgttggacctgacaccgactattttggattggttcagtattccatacccatcctacgccatttttggatccaagacaatccatcttaccggccggtcacttctgccagccctagaagccgagccactgtgggcaaccgtttttggatcgcagagtcaccatgaggtcactatgtcatatcctatgcgcagcgttcagcaccgccacttccggctggtgcacaacctgaactttaagatgcctttccctatcgatcaggacttttatgtgagccctacctttcaagatctgctaaaccgtacaactgcgggtcagccaactggctggtataaagatctacgacactactattacagggctcggtgggaactttatgaccgctcgagggaccctcatgagacccaaaacttggctaccgacccacgatttgcacagcttttggagatgctgagagatcagcttgccaagtggcagtgggaaacacatgacccatgggtttgcgccccagatggggtacttgaggaaaaactgtctccccagtgccagccactccataatgagctg

SEQ ID NO: 250708 - DNA, 1506 bp, Artificial Sequence
  Description of Artificial Sequence: Synthetic coding sequence
atgagctgcccagtccccgcgtgttgtgccctcctcctcgtgttggggctgtgccgcgcccggcctcgcaatgcactcttgctcttggcggacgacggcggattcgaatcaggcgcatacaacaactccgcgatcgcaaccccgcacttggacgctctcgcccgtcggtcgctgttgttccggaacgcttttacctccgtgtcatcgtgctccccgagcagggcctccctgctgactggattgcctcaacatcagaatggaatgtacgggctgcaccaggacgtgcaccacttcaattcattcgacaaggtgagatccctgccgctgctgctgtcccaggcgggagtgagaaccggaatcatcggcaaaaaacacgtgggtccggaaaccgtgtatccgttcgacttcgcatacacggaggaaaacgggtcggtcctgcaggtgggtcgaaatatcacccgaatcaaactgctggtgcgaaagttcctccagacccaggacgatcggccgttcttcctgtacgtcgcatttcacgacccgcaccgctgcggacattcccagccccaatacggaactttttgtgagaagtttggcaacggcgagtcgggcatgggaaggatcccggattggaccccgcaagcgtacgatccgctcgacgtgttggtgccttacttcgtgccgaacacccccgcagccagagcagacctcgccgcccagtacactaccgtgggtcgcatggaccagggggtgggacttgtcctgcaggaacttcgggacgctggggtcctcaacgataccttggtgatcttcacctcggataacggaatccccttcccatcgggtaggactaacctgtactggccaggtaccgcggagccgttgttggtgtcctcacctgaacatcctaaacgctgggggcaagtctcagaagcatatgtgtccctgctcgacctgaccccgactatcctcgattggttcagcatcccatatccatcatacgccatattcggaagcaagacgatccacctcactggtagatctctgctgccggccctggaagcagagcccctctgggcaaccgtgttcggatcacaaagccatcacgaggtcaccatgtcatacccaatgcgctcggtccagcataggcatttccggttggttcacaatctcaactttaagatgccgtttccgatcgaccaggatttctatgtcagcccgaccttccaggacctgctcaaccggaccaccgccggacaaccgactggatggtacaaggatctgcggcattactactaccgcgcccgctgggaactgtacgaccgaagtcgggatcctcacgaaactcaaaacctcgctaccgatcctcgctttgcccagctcctggagatgctccgagatcaactggccaagtggcagtgggaaacccacgatccatgggtttgtgccccagatggagtgctggaagagaagctctcacctcaatgccagccactgcacaacgaactt

SEQ ID NO: 250709 - DNA, 1506 bp, Artificial Sequence
  Description of Artificial Sequence: Synthetic coding sequence
atgtcgtgccccgtgcctgcttgttgtgcactactgctagtcctgggcctgtgtcgggcccggcctcggaatgctctgctgctgctcgcagatgacggtggcttcgaatccggcgcctacaataacagtgccattgcgaccccccatctggatgctctggcaaggagaagcttgttgtttagaaacgcattcacctccgtttcctcatgctctccctcaagggcttccctcctgaccggccttccccagcaccagaatggcatgtatggactgcatcaggacgtgcaccatttcaactctttcgataaagttcgatctcttcccttgttactgtctcaagccggggttagaactggtatcattggtaagaagcacgtaggcccggagaccgtgtatcctttcgattttgcctatacagaagagaacgggtctgtgttacaggtgggacgcaatattacgcgtatcaagctgcttgtgagaaagtttctgcagactcaggacgaccggcctttttttctatacgttgcttttcacgatccgcacagatgcggtcactcacagcctcagtatggaactttctgtgagaaattcgggaatggagagtcaggtatgggaaggatacctgattggacacctcaagcatacgatcccctggatgtgctagtgccatacttcgttccgaacacacctgccgctagagcggatctggcggcacagtacactacggtgggccgcatggaccaaggagtcggattggtgctgcaggagcttagagatgcgggcgttttaaatgatactctggtgatatttactagcgataatggtataccattcccttctggtcgcactaatctgtactggcctgggactgctgaacctcttttagtaagcagcccagagcatcctaaaagatgggggcaggtgtctgaggcatacgtgagtctattagacctcacacccaccattcttgattggttctcaattccatatcctagttatgccatcttcggaagcaagacaattcatttgaccgggaggtcactgcttcccgcgctagaggccgagccactttgggcgacagtgttcggatctcagtcacatcacgaagtcaccatgtcctaccctatgagaagtgtgcagcaccgccatttcaggttagtgcacaacctgaactttaagatgcctttccctatagaccaggatttttacgtgtcaccaacctttcaggatctcttgaaccggacaacagctggtcagcccacaggttggtataaggaccttcgccactactattaccgtgcaaggtgggaactctacgaccgctctagggacccacacgagactcagaatctggccaccgacccacgcttcgctcagctgctggagatgctgcgggaccagcttgctaaatggcaatgggaaactcacgacccatgggtgtgtgcccccgacggtgtgctcgaagaaaaattaagccctcagtgccagccgctccacaatgagctt

SEQ ID NO: 250710 - DNA, 1506 bp, Artificial Sequence
  Description of Artificial Sequence: Synthetic coding sequence
atgagctgcccagtcccagcctgttgtgccctgctgctcgtcctgggcctttgtagggctagaccccgcaacgcactccttcttcttgcggatgacggaggatttgaatcgggtgcatacaacaactcagcaattgctactccacatctggatgcattggcacgccgctccctgttgttcagaaatgcgtttacctcggtgtcctcgtgctctccttctcgggcctcgctgcttaccggactccctcaacatcagaatggcatgtacgggctccaccaggatgtgcatcactttaactcatttgacaaggtccggtcgctgcctctgctgctgagccaggccggagtgcgaaccggaatcattggtaagaagcatgttgggccagaaactgtgtacccctttgattttgcatataccgaagaaaatggatccgtccttcaagtgggtcgcaatatcactcgcattaagttgctggtccggaaatttctccagactcaggatgatcgacccttcttcttgtacgtggcattccacgatccacacaggtgtggccactcgcaacctcaatacgggaccttttgtgaaaagtttggaaacggcgaaagcggtatggggcgtattccagattggaccccgcaagcatacgacccgctggatgtgctggtgccgtacttcgtccctaacacgcccgctgcacgagccgacctcgccgcccagtataccactgtgggtagaatggatcagggagtgggactcgttctgcaagaactccgtgatgcgggcgtccttaacgataccctggtgatattcacctcagataacggcatcccatttccatcagggagaactaatctttactggcccgggactgcggagcctctccttgtgtcgagccctgagcatccgaaacgatggggtcaggtgtcagaagcgtatgtttccctgctcgacctgactcctaccattcttgattggttttccattccatacccttcatacgcaatcttcggatccaaaactatacatcttaccgggagatctcttctgcccgctctggaagcagagccattgtgggcaactgtgttcggatctcaatcgcatcacgaagtgactatgtcctacccaatgagatcggtgcagcacagacattttagactcgtgcataaccttaacttcaaaatgccatttcctatcgatcaggacttttacgtctcacctaccttccaagacttgcttaaccgtaccaccgcaggccagcctactggttggtacaaggatctccggcattactactaccgggcacggtgggagctgtacgaccgctcgagggacccccacgagactcaaaatcttgcaaccgatccaagatttgcacaactcctcgagatgctgcgggaccaattggccaagtggcagtgggaaacccatgatccgtgggtgtgcgcgccggacggcgtgttggaagaaaagttgtcgcctcagtgtcaaccgttgcacaatgagctt

SEQ ID NO: 250711 - DNA, 1506 bp, Artificial Sequence
  Description of Artificial Sequence: Synthetic coding sequence
atgtcgtgccccgtccccgcgtgctgtgctctgttactcgttctgggtctttgccgcgcacgccctcgtaatgcgctcctgttgctggctgacgatggaggcttcgaatctggtgcctataataactccgcgattgcgacgccccatcttgatgcactcgcccgccgctcgcttttattccgaaacgctttcacctccgtctcgtcttgttcaccgtcccgcgcctcgctccttacaggtttaccacaacatcaaaacggcatgtacgggctccaccaggatgtgcatcattttaacagttttgataaagtcaggtctcttcctctcctgctatcacaggcgggtgtccggacgggcatcatcggcaaaaagcacgtgggccctgagacagtctatccgtttgatttcgcatacaccgaagagaacggcagtgtcctacaggttggtcgaaacatcacacgtattaagttgttggtacgcaaatttttgcagacccaggacgaccgaccgttcttcctgtacgtcgcgtttcacgatccgcatcgatgtggtcacagtcagcctcagtatggaactttctgtgaaaagttcggaaacggagaaagcggcatggggaggataccagactggactcctcaagcctacgacccgcttgatgttcttgtgccctacttcgtccccaatactcctgcagcacgggcagatctggccgcccagtataccactgtcggccgaatggatcagggtgttggactggtgctccaagagctccgagacgcaggagttcttaacgacacacttgttatctttactagtgacaacggaattccgtttccttcaggacgtacaaatctttattggcctgggacagcggaacccttgttggtgagcagcccagaacatcccaagagatggggacaggttagcgaggcgtatgtgagcctccttgaccttacaccgaccatcctcgactggttctccatcccgtatccctcgtatgccatcttcggttcaaagaccatccatcttacagggcgtagtctgttaccggccctcgaggcggaacctttgtgggcaacagtttttggcagccagtcacatcacgaggtcacaatgagttatcctatgcggtccgtgcaacaccgtcatttcagacttgtccataaccttaactttaaaatgcccttccctatcgatcaggacttttacgtttcgcctactttccaggacttgttgaaccgtacaacagcgggccagccaaccggatggtacaaggatctacgacattattattatcgagcacgctgggaattgtacgatcgttcccgggatccgcatgagacacaaaacctcgcgaccgaccctcgctttgctcagttgctggagatgctgcgagaccaactggctaaatggcaatgggagactcatgatccctgggtgtgtgcccctgatggcgtgctagaagagaagctgagtcctcaatgtcaacctttacataatgagttg

SEQ ID NO: 250712 - DNA, 1506 bp, Artificial Sequence
  Description of Artificial Sequence: Synthetic coding sequence
atgtcttgccccgtaccagcttgttgcgcactgctgctggtgctggggctttgtagggcacgaccacgaaatgcgttgctgctgcttgctgacgatggagggttcgaatctggcgcttacaacaatagtgcaatcgccacaccacatctcgatgctctcgctagaaggtccctgcttttccgtaacgcctttacctccgtatcctcatgtagcccatccagggcttccctcctcaccgggttaccacagcatcagaatgggatgtacggcctgcaccaggatgtacaccatttcaactcctttgataaggtgaggagtttgccactactgctctcacaggcgggtgtgaggactggcattattggaaaaaagcatgtgggcccagagacagtgtacccattcgactttgcctatacagaggagaatggctctgtgctgcaggtcggccgaaatataacacgcatcaagcttcttgtcaggaagttcctgcagactcaggatgatcgaccttttttcttgtacgtggcctttcacgacccgcaccggtgtggacattcacaaccgcagtatggcactttttgtgagaaatttgggaacggcgaaagcggcatgggcagaatacctgattggacgccccaggcatacgaccccctggatgtcctcgtgccgtactttgtgcctaatacaccagccgcccgggccgacctggctgcccagtacaccaccgtgggcagaatggaccagggcgttggcctagtcctgcaggagctccgggatgcgggggttttgaatgatacacttgttatcttcacctcagataacggaataccgttcccttccggcagaacgaatctctattggccgggtaccgcagaaccgctgctcgtgtcctcacctgaacaccctaaaaggtggggccaagtgagcgaagcttacgtgtcgctccttgacttgacccctacaatcctggactggttttcaatcccatacccctcgtatgctatctttggctccaagactattcatcttaccggaaggagcctgctaccagcacttgaagctgaacccctgtgggccacagtatttggatctcagagccaccacgaggttacaatgagctacccaatgaggtctgtgcagcaccgacacttcaggttagtccacaacctgaattttaaaatgccattcccaatagaccaggatttttacgtgagccctacatttcaggacttgctgaaccggaccacagcaggccagccaaccggctggtacaaagaccttcgtcattactattaccgggccaggtgggaactgtatgatcggagtcgggacccacacgagacacagaacctcgcaaccgatcctcggtttgctcagcttctggaaatgcttagggaccagcttgccaaatggcagtgggagacacacgacccttgggtgtgtgctccagatggagtgttggaggaaaagctgtctcctcagtgccagccacttcacaacgagctg

SEQ ID NO: 250713 - DNA, 1506 bp, Artificial Sequence
  Description of Artificial Sequence: Synthetic coding sequence
atgtcttgccccgttccagcatgctgcgctctgctcctggtcctgggcctgtgtcgcgcacgcccaagaaacgctttgcttttgctagctgacgacggcgggttcgagagcggagcatacaataactccgcaatcgccacaccccacctcgacgccctggctcgcagatcactcttatttaggaatgcttttacgtccgtatcctcatgctcccctagccgcgcatccttattgactggcctgccgcagcaccagaacggcatgtacggtctccatcaagacgtccaccactttaatagttttgataaggtgcggtccttgcccttactgctctcccaggctggtgtcaggacaggcatcattgggaagaaacacgttggccctgaaactgtctaccccttcgatttcgcctacactgaagagaacggcagtgtgttgcaggtgggaagaaacatcaccaggattaagctactggttaggaaattcttgcagacccaggatgatcgtccattctttctgtatgtggcgttccacgatcctcatcggtgcggccattctcagccgcagtatggtaccttctgcgagaaattcggtaatggggaatcaggtatgggccgaatccctgattggactccccaggcttacgatcccctggacgtgttagtcccctactttgtacccaatactcctgcagctagagcagacctggccgcgcagtataccacagtcggcaggatggaccagggcgttgggttggtgctgcaggagctgcgagatgctggcgtgttgaacgacactctcgtcatctttactagcgacaacggcatccctttcccctctggccgaaccaacctgtactggccagggaccgcggagcccttactggtgagctcccctgaacaccctaagcgctggggtcaggtttccgaagcctatgtgagcctgctggacctgactccgactattctggattggtttagcataccttatccttcatacgctatctttgggtctaaaacaatacatttgacgggcagatccctgttgccagcattggaggctgagccactgtgggctaccgtgttcggttcgcagagccaccatgaagtgaccatgagctaccccatgaggtctgtccaacaccgacatttccgtttggtgcataacctgaacttcaaaatgcccttccctatcgatcaggatttctatgttagccccacattccaggacctgttgaatcggaccacagctggtcagccgacgggttggtacaaggaccttaggcactactactatagggcccggtgggagctgtatgaccgctctcgggatccacatgaaacgcaaaacctcgcgactgatccccgctttgcccagctcctggaaatgttaagggatcagctggccaagtggcagtgggagacgcacgatccatgggtctgtgcaccggatggcgtgcttgaggagaaattgtcccctcagtgccaaccgcttcataatgagctg

SEQ ID NO: 250714 - DNA, 1506 bp, Artificial Sequence
  Description of Artificial Sequence: Synthetic coding sequence
atgtcctgtccggtgcccgcctgctgcgcacttctgctggtgctggggctctgtcgcgcacggccacgcaacgctcttctgttactcgcagatgacgggggtttcgagtctggggcttacaataattccgctattgcgacgccccatctggatgctctggccagacgaagcttattgttcagaaatgccttcacttcggtgtcaagctgctccccttctcgggcttctctcctgacgggattgcctcagcatcagaatggcatgtacggactacatcaggacgttcaccactttaattcttttgacaaagtgcgcagtctccccttgttactctcacaggcgggtgtccgtacaggcatcattggaaagaagcatgtgggccccgaaacagtgtacccctttgatttcgcgtacacggaggagaatggatcggtgttgcaggtcgggcgcaatattactagaattaagctgctggtgcggaagttcctccagacccaggacgaccgcccgtttttcctgtatgtggcctttcacgacccccaccgttgtgggcactcccagccacagtacggaacattttgcgagaagtttgggaacggagagtctgggatggggaggattccagattggactccgcaggcatatgaccccttagatgtgctggtgccctacttcgtgccgaataccccagcagccagggccgacctggccgcccagtatactaccgtgggcaggatggatcagggcgtgggcttggtgcttcaggaactgcgggacgcaggcgtgctgaacgacacattggtcatattcactagcgacaacggaataccttttcccagcggccgcaccaacctatattggccagggaccgccgaaccactactggtgagcagccctgaacaccccaaaaggtggggccaggtcagcgaagcctatgtgtccctgctcgatcttacgccaactatactagattggttctctatcccatatccaagctatgctatcttcggctccaagaccatacacctgactggcagatcactcctgcccgccttggaggccgaacccctctgggcaaccgtatttggctcccagagccaccatgaagtgaccatgtcatatccgatgcggtcagtgcaacacaggcattttcgccttgtccataacttaaacttcaaaatgccgtttcccatagatcaggacttctacgttagcccaacatttcaagatctcctgaacagaacgacagcaggccagcccaccggctggtacaaagatctccgtcactactattaccgagcgcgctgggaattgtacgataggtcaagagatccccacgagacgcaaaacctagctactgacccacggtttgcccaactgctggagatgcttagagatcaactggcgaagtggcagtgggaaactcatgacccctgggtgtgcgcccccgatggagttctggaggaaaaattatccccccaatgtcagcctctacataatgagctg

SEQ ID NO: 250715 - DNA, 1506 bp, Artificial Sequence
  Description of Artificial Sequence: Synthetic coding sequence
atgagttgccctgttcctgcgtgttgtgccctcctgcttgtgttgggcctctgcagggctcggcctaggaacgctttgctccttctcgccgacgatggggggtttgaatctggtgcctacaacaactctgctatcgcgaccccccacctagacgccctggcccgccgcagcttgctgtttagaaacgcattcaccagcgtatcctcttgcagtccttcaagggcatcacttcttacaggactcccccagcatcagaacggtatgtacgggctgcatcaggacgtccaccacttcaactcttttgataaggtccggtccctccctctgttgctgtctcaagcaggagtcaggactggcattatcggcaaaaaacacgtcgggcctgaaacggtatacccctttgacttcgcttacactgaggagaatggttcagtgctacaagtgggtcggaatatcacaagaataaagctgttagtgcggaaatttcttcaaacgcaggatgatcgtccattctttctctacgtggcgttccacgacccacacaggtgcggccacagtcaacctcaatatgggaccttctgcgagaaatttggcaacggagagtctgggatgggcaggattccggattggaccccccaggcgtacgatccgctcgatgtcctggtcccttactttgttcccaacactcccgccgcaagggccgatcttgctgcacagtacacaaccgtgggccggatggatcagggcgtggggctcgtccttcaggaacttcgcgacgccggagtgctgaacgacaccctggtgatttttacatctgataacggaataccgttccccagtggccgaacaaatctgtactggcccgggacggctgagcctctcctggttagcagcccggagcatcccaaacgatggggacaggtgagtgaagcctatgtgtcattgctggacctaactccaacaatcctggactggttcagtataccctatccctcctatgccattttcggaagcaaaactatccatttgacaggtagaagtctgctgcccgccctcgaggccgaacctctgtgggcgaccgtgtttggcagccagagccaccacgaagtaactatgtcctaccctatgcggtcggtgcaacatagacactttcggcttgtgcacaatctaaacttcaaaatgcctttcccaattgaccaggatttttatgttagcccgacctttcaagatctccttaaccgtacaaccgcaggtcaacccaccggttggtacaaggatcttcgccattattattatagagcacgctgggagttgtatgataggtccagggatccccacgagactcaaaacctggctactgaccctagattcgcccagctcctggagatgctgcgggatcagctcgcgaagtggcagtgggagactcacgatccctgggtctgcgcacctgatggtgtgctcgaagagaaattgtcaccgcagtgtcagcctcttcacaacgagctg

SEQ ID NO: 250716 - DNA, 1506 bp, Artificial Sequence
  Description of Artificial Sequence: Synthetic coding sequence
atgtcatgccctgtgcctgcttgttgcgcactgctgctggtgctcggactgtgtagagcaagacctcgtaatgccctgctcttgctggcagatgatggcgggttcgagagtggggcatacaataactctgcaattgcaacccctcatctggacgcccttgctaggaggtcacttctgttccggaatgcatttacctccgtgtcatcgtgctccccatcccgtgcctcgctgcttacgggactgccgcaacaccaaaacggaatgtacgggcttcatcaggacgtccatcactttaactcttttgacaaggtcagatctctgccccttcttctttcccaggcgggtgtccggaccggaataatcggtaaaaagcatgtcggtccggaaactgtgtacccattcgatttcgcatacaccgaagaaaacggatccgtccttcaggtgggacgcaacattactcgcataaagctgctggtgagaaagtttctgcagacccaagatgatagaccttttttcctttacgtcgccttccacgatccccatagatgtggtcacagccaaccacaatacggtaccttttgtgagaaattcggaaatggcgaatcgggtatgggccgaatccccgactggactcctcaggcctacgatccacttgatgtcttggttccttatttcgtgccaaataccccggcagctcgtgctgatcttgccgcacaatacactactgtcggacggatggaccaaggagtggggctggttttgcaggaactgagagatgcaggggtcctcaacgatacgctggtcatattcacgtcggataacggaatcccgttcccatcgggtaggacgaatctgtactggcccggcaccgccgaacctctccttgtgtcgagcccggaacatcctaagcgatggggtcaagtgtcagaagcatacgtgtcgctgctcgatctcactcctactattcttgattggttttccattccttatccctcttacgcaattttcggatcgaaaaccattcatcttaccggtcgcagtttgcttccagccctggaagccgaacctctgtgggccacggtgtttggatcacaatcacatcacgaggtcaccatgtcgtaccccatgcggtccgtccaacatagacatttcagacttgtccataatctcaatttcaagatgccatttcccattgatcaggacttttacgtgtcccctacttttcaggacctgctgaacaggaccaccgcaggccagccaactggttggtataaggatcttaggcactactactacagagcgcgctgggagctgtacgataggtcaagagatccacacgagacgcagaacctggcaaccgatccccgcttcgcgcaactgcttgaaatgcttcgagatcaactcgcaaaatggcaatgggagactcatgatccatgggtctgtgcacctgacggcgtgctggaagagaagctctcgcctcaatgtcagcctctccataatgagctg

SEQ ID NO: 250717 - DNA, 1506 bp, Artificial Sequence
  Description of Artificial Sequence: Synthetic coding sequence
atgtcgtgccccgttcctgcatgttgcgcgttgctgctggtgctgggactctgcagagcccgccccagaaacgctctgttgcttttggcggacgatggaggcttcgagtcaggggcctacaacaactcggcaattgcgacgccacatctcgacgccctcgcgcgacgctctttgctcttccgaaacgcctttacctcggtgtcgtcctgttccccttcccgcgccagcctcctgaccggcctgccccagcatcaaaatggaatgtatggactgcatcaggacgtgcaccacttcaacagcttcgataaggtgagatcgctcccactgctgctgtcgcaggctggagtccgcaccggaatcatcggcaagaaacacgttggtccagaaactgtctaccccttcgatttcgcgtacacggaggaaaacggatcagtgctgcaggtgggtcggaatatcaccagaatcaaactgctggtccggaaatttctgcaaacccaggacgaccgtccgttcttcctgtacgtggctttccatgatccgcatcggtgcggccattcgcagccacaatacggtactttctgtgaaaagttcgggaacggagagtcagggatgggacgcattcccgactggacccctcaagcctacgatcccttggatgtcctggtcccgtacttcgtgcccaacactcctgcggcgagagccgatctcgcggcacagtacactaccgttggccgcatggaccagggcgtgggtttggtccttcaagaactgcgggacgctggagtgctcaacgatacgctcgtgatctttacctcagataatggaatcccgttcccgagcggccggactaatctgtactggcccgggactgccgagcctttgttggttagctcgccggagcatccaaagagatggggacaggtgtcagaagcatatgtgagcttgctcgacctgacccctactatcctggattggttttcaattccatacccaagctacgccatcttcgggtccaagaccatccatctcactggacgtagcctgctgcctgcgctcgaggccgaaccgctctgggcgaccgtgttcggatcgcagtcccaccacgaagtgaccatgtcatacccgatgaggagcgtgcagcaccgccacttccggttggtgcacaatctgaactttaagatgccgtttccgatcgatcaagacttttacgtctcaccgacgtttcaggatctgctcaaccgcaccactgcggggcagccgactggatggtacaaagacctgagacactactactaccgcgcccggtgggagctgtacgaccgctcccgggacccgcacgaaacccaaaacctcgctaccgaccctcggttcgcgcaactgctggaaatgttgcgcgatcaactcgcaaagtggcagtgggaaactcatgacccgtgggtgtgcgcgccagacggagtgctggaggaaaagctgtcgccacagtgtcagccgctgcataatgagctg

SEQ ID NO: 250718 - DNA, 1506 bp, Artificial Sequence
  Description of Artificial Sequence: Synthetic coding sequence
atgagctgcccggtcccggcttgctgcgctctcttgctggtcctggggctgtgtagggcacggccccgcaacgcgctcttgctgctcgccgacgatggaggtttcgagagcggcgcctataacaattctgctatagcgactccgcatctcgacgccctcgcgcggcgcagtctgctgttccgcaatgctttcacttccgtatcgagctgttccccatctcgagccagcctcctgaccggactgccccagcatcagaacggcatgtatggactgcaccaggacgtgcatcatttcaacagctttgacaaggtgcgctcactgccgttgctcctctcacaagccggagtgcgcactggcattattgggaagaaacacgtcggcccggagactgtctacccgtttgacttcgcctacactgaagaaaatgggtccgttcttcaggtgggacgtaatatcacccggatcaagctgctggtgaggaaatttctgcaaactcaggatgatcgcccattcttcctgtacgtggcattccacgacccgcatagatgtggacattcccagcctcaatacggtaccttctgcgaaaagttcggaaacggagaaagcggcatgggcaggatcccggattggaccccgcaggcgtacgacccactggacgtgctggtgccttacttcgtgcctaacacccccgcagccagagccgaccttgccgcgcagtacaccaccgttggacgcatggaccagggggtcggacttgtactccaagaactccgggatgctggcgtcctcaacgacacccttgtgatcttcacgtctgataacggcatcccgtttccttcaggacggacgaacctctactggccagggaccgcggaaccgctgctggtatcgtcaccggagcacccgaagcgttggggacaagtctccgaagcctatgtttcgctgctcgacctcaccccaaccatcctggactggttctccatcccatacccatcgtacgcgatcttcggctccaagactatccatctcaccggacgatcgctgctcccagcactggaggcagagccgctgtgggctacggtgttcgggagccaatcacaccacgaggtgacgatgtcgtacccgatgcggtcggtgcagcatagacacttccggctggtgcacaatctgaatttcaaaatgccgtttccaatcgatcaggatttctacgtctcacctacttttcaggatctgctgaacagaactactgcgggtcagcctaccgggtggtacaaggacctcagacactactactacagagctaggtgggaattgtacgaccgcagccgcgacccgcacgaaacccaaaatcttgcgactgacccgcgctttgcccaactgctggaaatgcttcgggatcaactggccaagtggcaatgggaaactcacgatccttgggtgtgcgcaccagatggtgtgctcgaggagaaactttcccctcagtgccagccccttcacaacgagctc

SEQ ID NO: 250719 - DNA, 1506 bp, Artificial Sequence
  Description of Artificial Sequence: Synthetic coding sequence
atgagctgtccagtgcccgcgtgttgtgccctcctccttgttctcgggctgtgccgcgcccgtcctaggaatgcccttcttttgcttgcggatgatggtggatttgagtcgggagcctacaacaattccgcgattgcaacccctcacctggacgcacttgcaagaaggagccttctgttcagaaacgcttttacttctgtctcgtcatgctcgccttcgcgcgcatcactcctcactggcttgccacagcatcaaaacggaatgtacggtctgcaccaagatgtgcaccactttaactcctttgacaaggtccggtccctgcccctgcttctcagccaggctggtgtgagaaccggtatcattggaaagaagcatgtgggacccgagacggtgtacccatttgacttcgcatacactgaggaaaacgggagcgttctccaggtgggaaggaacatcacccgcataaagctcctggttagaaagtttctgcagactcaggacgacaggccgttttttctctacgtggcatttcatgacccacatcgctgtggacattcacaaccacagtacggtactttttgtgagaaattcggaaatggagaatcggggatgggtcggattcccgactggaccccacaagcatacgatccgctcgatgtcctggtgccttacttcgtgcctaataccccagcggcacgagcagatctggcggcacaatacaccaccgtcggaaggatggaccagggagtcggacttgtcctgcaggagctgcgtgatgcaggtgtgttgaacgacacgcttgtgatctttaccagcgacaacgggatcccttttccttccggacgcaccaacctgtactggcctggaactgccgaaccattgttggtatcatccccagaacaccctaagaggtggggccaggtgtcggaagcgtacgtgtcccttcttgatctgactcctactattctcgattggttctccattccttacccatcctatgcaatctttggatcgaaaaccatccatctgacggggaggtcactgcttcctgccctcgaagcagagcctctgtgggcaactgtctttggttcccagtcgcaccacgaagtcactatgtcctaccctatgcgttcagtgcagcacagacactttcgtcttgtccataaccttaactttaagatgccctttccaatcgatcaggacttttatgtcagcccaactttccaagacctgctgaaccggacgactgccggacagccgaccggttggtacaaagacctcaggcactactactacagagcccgttgggagctttatgatcgctcacgtgacccccatgaaacccaaaacctcgcaaccgacccacgctttgcacaattgttggaaatgctgagagatcaactggcaaagtggcaatgggagactcatgatccctgggtgtgtgcacctgatggagtgctggaggaaaaactgtcacctcaatgtcagcctcttcataacgaattg

SEQ ID NO: 250720 - DNA, 1506 bp, Artificial Sequence
  Description of Artificial Sequence: Synthetic coding sequence
atgtcttgccctgtgcctgcgtgctgtgcgctcttgttggtcttgggtttgtgtcgggcgcgtccgcggaatgcacttcttcttcttgctgatgacggaggctttgaatcgggtgcatacaataactccgcaatagccactccacaccttgatgcacttgcaagacggagcttgctgttccgcaacgcgtttacctccgtctcgtcgtgttctccatcgagggctagccttcttactggacttcctcaacaccaaaacggaatgtacggacttcatcaagacgtgcaccactttaacagcttcgacaaggtgcgttcactccccctcttgctgtcacaggcgggagtgcggaccggaatcatcggaaagaaacatgtcgggccagaaactgtctacccttttgatttcgcctatacggaggaaaacggatccgtgttgcaagtgggacggaacataactagaatcaagctgcttgtgagaaaattccttcagacccaagacgaccgaccatttttcctgtacgtcgctttccatgacccacatcgctgcggccatagccaacctcaatacggcacgttttgtgagaagtttggaaatggcgagtcagggatggggagaatacccgactggaccccgcaggcatacgaccctcttgacgtgctggtcccctatttcgtccccaacactccggcagcacgagcagatcttgcagcccaatatacgaccgtgggaaggatggatcaaggggtgggactggttctgcaagaacttagggacgcaggggtcctgaatgataccctggtcatctttacctctgacaacggtattccctttccttcaggccgtactaatctctactggccaggtaccgctgagcctctgctggtcagctcaccggagcatccgaagcgctgggggcaagtttcggaggcatacgtgtcgctgctggatcttactccgaccatcctggattggttcagtattccatatccgtcgtacgcaattttcggctcaaagaccattcatctcactggtcgctcactcctccctgcattggaagcagagcctctgtgggctactgtgtttggttcccagtcacaccatgaagtgacgatgagctaccctatgcggtccgtccagcatagacacttccggttggtgcataaccttaactttaagatgccctttcctattgatcaagacttttacgtcagtccaacgtttcaggatctcctgaacagaaccaccgcaggccagcccactggatggtacaaagatcttagacattactactaccgtgcaaggtgggagctgtacgatcgctcccgcgatccccacgaaactcaaaatctcgccaccgatcctcgtttcgctcaactgctggaaatgttgagagatcaactggcaaaatggcagtgggaaactcatgatccatgggtgtgcgcccccgatggagtgcttgaagaaaagttgagccctcagtgtcagccacttcacaacgaactc

SEQ ID NO: 250721 - DNA, 1506 bp, Artificial Sequence; identical to SEQ ID NO: 250693
  Description of Artificial Sequence: Synthetic coding sequence

SEQ ID NO: 250722 - DNA, 1506 bp, Artificial Sequence
  Description of Artificial Sequence: Synthetic coding sequence
atgtcctgccccgttcctgcatgctgtgcactcctcctggttctcggcctgtgtagagcgcgacctcgtaacgcactccttctgcttgcagacgatggaggctttgaatctggagcatacaacaacagcgctatcgcaaccccccatctggatgccctggcaaggcgttcgctgctgttccgcaacgcatttacttccgtctcttcatgttcaccttcgcgcgcaagcctccttactggcctccctcagcaccaaaacggtatgtacggactgcaccaagatgtgcaccatttcaattcgtttgacaaggtgagatcccttcccctcttgctcagccaagcaggcgtgagaactggcatcatcggtaaaaagcatgtgggtcctgaaaccgtctacccgtttgattttgcatatactgaggaaaatggaagcgtcctgcaagtgggaagaaacatcacccgcattaaactcctggtcagaaagttcctgcagacccaagacgaccgacctttcttcctctacgtggcttttcatgatccacacagatgtggtcattcgcaaccacaatacggtacgttctgtgagaaattcggcaacggtgaatcaggtatgggaagaataccagattggactccccaagcatacgacccgcttgatgtgcttgtcccttacttcgtgccaaataccccagcagcacgtgccgatcttgccgcacaatacaccaccgtgggtcgaatggatcaaggcgtcggattggtgttgcaagaactccgcgacgctggagtccttaatgacactctggtcattttcacctcggacaacggtattccatttccatcggggcggaccaatctctactggccaggtactgcagaacctctcctcgtctcctcaccagagcatcccaagagatggggtcaggtgtccgaggcatacgtgagccttcttgatctcaccccaaccatccttgactggttctcgatcccatacccgtcgtacgccatttttggatccaagacgattcacctcactggccgatcacttcttcctgcgctggaagccgagccactgtgggcaactgtgtttggatctcagtcacatcatgaagtgacgatgtcctacccaatgagatcagttcaacatagacactttcgtctcgtccataacctgaactttaagatgccgtttccaatcgatcaggatttctacgtctcgcccacctttcaagatctgcttaatagaaccactgcaggccagccaaccggctggtacaaggacctgagacattactactaccgggcgcggtgggagctttacgacagatcgagagatcctcatgaaacccaaaatctggctactgatccgcgcttcgcacaactcctggaaatgcttagggaccagctggcaaaatggcagtgggaaacgcacgacccctgggtgtgcgcacccgatggagtcctggaagaaaaactgtcgccacagtgtcaacccctgcacaacgagctg

SEQ ID NO: 250723 - DNA, 1452 bp, Artificial Sequence
  Description of Artificial Sequence: Synthetic coding sequence
atggcatgtagagggggggcagggaatggacaccgggcctctgcgacactgtcccgtgtaagcccaggttctctgtatacctgccgcaccagaacgcataatatttgcatggtatccgacttcttctatcccaatatgggaggcgtggaatcccatatctaccagttatcccagtgccttatagaaagaggtcacaaggttatcatagtgacacacgcgtacgggaatcgtaaagggatccgctatcttacttccggactgaaggtgtactatctgccacttaaggtcatgtataatcagtcgaccgctactacgctttttcacagcctgcctctgctccggtatattttcgtccgggagcgggtgacgatcatccacagccatagcagtttctctgccatggcacacgatgccctgtttcatgctaagacaatgggactacagacagtgtttacagaccactctctgtttggttttgccgatgtcagttctgtactgacaaacaagttgctcacggtctccctgtgcgacacgaatcatattatttgtgttagctatactagcaaagaaaatacagttcttcgcgccgctctgaacccagaaattgtaagcgtgattcccaacgctgttgatcccacagacttcacccccgatccttttcggaggcacgactccattactatcgtagtggtgagccggttggtgtaccggaaagggattgacctcctgtcaggaattatccccgagctgtgccagaagtaccccgacttgaattttattattggtggggaggggcctaaaagaattatcctcgaggaagtgagagaaaggtaccagctccacgaccgggtgcgccttctgggcgctctggagcataaagacgtccgtaacgtgctggtgcaaggccacatattcctcaacacgagtctgacagaagcattttgcatggccattgttgaagcagcttcatgtggtttacaggtggtatcaactagggtgggggggataccggaggtgcttccagagaacctgattattctctgcgagccctcagtgaagtctctgtgcgaggggctggagaaggcaatcttccagttgaaatccggtacgttgcccgcccctgagaacatccacaacatcgttaaaaccttctacacgtggagaaatgtggccgagcggactgagaaagtgtatgaccgcgtgagtgtggaggctgtgctgccaatggacaagaggctggacaggctaatcagtcattgcggaccggttaccggctatatcttcgcactgctggccgtgttcaatttcctattcttgatatttctgagatggatgacacctgacagcattattgacgtggctattgatgctacggggcccaggggcgcctggacaaacaattactcccacagcaaacggggcggggagaataatgaaatcagtgaaacacgg

SEQ ID NO: 250724 - DNA, 1452 bp, Artificial Sequence
  Description of Artificial Sequence: Synthetic coding sequence
atggcctgccgtggcggcgctggcaacgggcaccgcgcatccgccaccctgtctcgcgtctcgccgggcagtttgtacacttgcagaacacgtacccacaacatctgtatggtcagtgacttcttttacccgaacatgggtggtgtggagtcccacatctaccagctaagccagtgcctgattgagcgcggccataaggttatcattgtaactcacgcttatggaaaccggaagggcatccgctacctgacgtctggtcttaaggtctactacctgcccctgaaggtcatgtacaaccagtcgacagccaccaccctcttccattcattgcccttgcttcgttacatattcgtccgcgagcgcgtcaccatcattcattctcactccagcttctctgccatggcccacgatgctctttttcatgccaagactatgggcctccagaccgttttcactgaccactcgctgttcggcttcgccgacgtgagttccgtcctgacaaataagctgcttaccgtcagcctctgcgataccaatcacatcatctgcgtctcgtacacgtccaaggagaacactgttctccgcgctgccttgaaccccgagatcgtttcggttatcccaaacgctgttgatccaaccgacttcactcccgatccctttcgtcgccacgactccatcaccatcgtcgtcgtgagtagattggtgtaccgtaaaggtatagacctcctctcggggatcattcccgagctgtgtcaaaagtaccccgatttgaatttcatcatcggaggggagggccccaagcgaatcatcttggaggaggtgcgtgagcgttaccaactgcacgatcgggtcagactgcttggcgccctggagcacaaggatgtccgcaacgtcctcgttcagggtcacatcttcctgaacacgagtctgacagaggccttctgtatggccattgtggaagcggccagctgtggactccaagtcgtttctacgagagtcggtggtatccctgaggtcctacccgaaaatttgatcatcctctgtgagccttccgttaagtccctctgcgagggccttgagaaggccattttccaattgaagtctggcacattgcccgcacctgagaacattcacaacatcgtgaagactttttacacttggcgcaacgtcgccgagcgcaccgagaaagtctatgaccgcgtcagtgtcgaagccgtcctccctatggacaagagacttgatcggctgatttcccactgtggtcctgttactggatacatcttcgccctgctcgctgtcttcaacttcctcttcttgatattcctgcgttggatgacccccgattctatcatcgatgtcgccatcgatgccacaggcccccgtggcgcctggaccaacaactactcccactcaaagagaggtggcgagaacaacgagatctccgagactcgg

SEQ ID NO: 250725 - DNA, 1452 bp, Artificial Sequence
  Description of Artificial Sequence: Synthetic coding sequence
atggcttgtagagggggggccggcaacggacaccgcgcctctgccaccctgtcacgggtttctcctggtagtctgtatacctgcagaacaagaacccataatatatgcatggtgagcgatttcttttacccaaacatgggtggggtggagtcccatatttatcaactgtctcagtgcttgatcgagaggggtcacaaagtaataattgttacacatgcctacggcaaccgaaaggggatccggtacctgacatccggcttaaaagtctactatctgcccctgaaggtgatgtacaaccagtccacagccactacactgtttcactccctgccacttctccggtatatttttgtacgagagcgggtgaccataatccacagccacagttcattctctgcaatggcccacgacgcactgtttcatgctaagacaatgggtctgcagaccgtcttcaccgaccattcactattcgggttcgctgatgtcagcagcgtactgactaataaactcctcactgtaagtctgtgcgacaccaaccacatcatctgtgtaagttacacaagcaaagagaacacagttctgcgtgcagccctgaaccccgagattgtgtctgtaatcccaaatgctgtcgaccccactgattttaccccagatcctttccgaagacatgactccattaccatagtggtggtctctcggctggtgtatcgcaaaggaattgatttactgagtggcatcataccagaattgtgccagaagtaccccgatctgaattttataataggaggagagggccccaaaaggattatcttggaggaggttagagaaagatatcagctccatgacagagtacgtctgttgggagccctagaacataaggacgtgcgtaatgtccttgtccagggacacatctttttgaacacctccctgaccgaagcgttctgtatggcaatcgtggaggctgcatcttgtggtctacaggtggtctctactagggtgggaggaattcccgaggtgcttcccgagaacttaatcatcctatgcgagccgtccgtcaaatctctctgcgagggtctggagaaggccatcttccagctcaaatccggcaccctaccagcgccagagaatatccataatattgtgaagacgttttacacctggcggaacgtggcagagcgcactgagaaggtttatgaccgcgttagtgtcgaggccgtgctacctatggacaaacgcctggacagactgatcagtcactgtggacccgttacggggtatatcttcgccctgctggccgtgttcaattttcttttcctgatcttcctccgctggatgaccccggatagcataatcgacgtggccattgacgctactggcccgcgtggcgcctggactaacaattacagccactccaagcgcgggggggaaaataatgaaatatcggagacgagg

SEQ ID NO: 250726 - DNA, 1452 bp, Artificial Sequence
  Description of Artificial Sequence: Synthetic coding sequence
atggcatgcagggggggggcagggaacggacacagggctagtgcaacactgtcacgggtttcccccgggtctctttatacatgtaggacacgaactcacaacatctgcatggtctctgatttcttttatcccaatatgggaggggtggaatcccatatataccaactcagtcagtgtctaatagagcgaggacataaagtcataatcgtcacacacgcctatgggaacaggaaaggaattcggtatctgacttcagggctcaaagtgtattatctccctctgaaagtaatgtataaccagtcaacagccactacactcttccactccctccccctccttagatatatctttgtaagagagcgggtcacaattatccattcccattcttctttctctgcaatggcccatgacgcactctttcatgccaaaacaatgggactccagacagtctttacagatcactctttgttcggattcgccgatgtgtctagtgtcttgactaataagcttttaacagtgagtctctgcgatacaaaccatatcatatgtgtctcttatacttccaaagaaaacactgtcctccgggccgctctaaaccccgaaatcgtttccgttatacctaacgctgtcgatcccacagattttacacctgatccttttcggcgccatgattcaataactattgttgtcgtgagtcgcctggtttatagaaaggggatcgatctcttatctggaatcatcccagaactgtgccagaaatatcctgacctcaattttataataggaggagaaggacctaaaagaatcatcctggaggaagtccgagagagatatcagctgcacgatagggtacggctcctaggggctctagaacataaagacgtgcgtaatgtactggttcaggggcatatctttctcaatacatccctgacagaggccttctgcatggcaattgtcgaagcagccagttgcggactgcaggtggtctcgacaagggttggagggatccccgaagttttgcccgagaacctgataatcttgtgcgagccctctgtgaagtcactgtgcgagggactagagaaggcaatcttccagctaaaatccgggactcttcctgcccccgaaaatatacacaatatagtgaaaacattttatacttggcgcaatgttgccgaaaggacagagaaagtctatgatagagtctctgtggaagctgtccttcctatggacaagcggctggacaggctcatttcccactgtgggcctgtgacagggtatatcttcgctctgctggcagtattcaactttctatttctcatctttcttcgatggatgactccggactccataatagatgtagccatcgatgctacaggaccccgcggagcatggactaataactactcacattccaaacgcgggggagaaaacaatgaaattagtgagactcga

SEQ ID NO: 250727 - DNA, 1452 bp, Artificial Sequence
  Description of Artificial Sequence: Synthetic coding sequence
atggcctgccgcggaggtgctggaaatggtcatagagcctccgccacgctgagcagggtgtcaccaggcagcttgtacacttgtcgcactcgtacccataacatctgcatggtgtccgactttttctacccaaacatgggaggagtggagagccacatctaccaactgtcgcagtgcctgatcgaacgcgggcataaggtcatcatcgtgactcacgcctacggtaaccgcaagggaatccgctatctgaccagcggattgaaggtttactatctgccactgaaggttatgtacaaccagtcgaccgccaccacccttttccactccctgccgctcctgcggtacatcttcgtgcgggaaagagtgaccatcatccattcccactcgagcttctcggccatggctcatgacgcccttttccacgcgaaaaccatggggctgcagacggtattcactgatcactcgctgttcggcttcgccgatgtgagctccgtgttgactaacaagctgctcaccgtgtccctgtgtgacaccaaccacatcatttgcgtctcatacacttcgaaggagaacactgtgctgcgcgcggcgctgaatcctgagatcgtgtctgtgattcccaacgcggtggacccgaccgacttcaccccagatccgttcagacggcatgattccatcaccattgtcgtggtgagcaggctggtgtacaggaaggggatcgacctcctctctggcatcatcccggaattgtgtcaaaagtaccctgacctcaacttcatcattggcggcgagggaccgaaaagaatcatcttggaagaggtgcgcgagagataccagctgcacgaccgcgtgagactgctcggcgcgcttgagcacaaggatgtccgcaatgtgctggtccagggacacatctttctgaacacttccctgaccgaagccttttgcatggctatcgtggaagccgcgtcctgcggtctgcaagtggtgtccacgagggtgggcggcatcccggaagtcctgcctgaaaacctgatcatcctctgcgagccatcagtgaagtcgctgtgcgaaggactggaaaaggctatcttccaactcaagtcgggtacccttccggccccggagaatatccacaatattgtcaagactttttacacctggaggaatgtggccgagcggaccgaaaaggtgtacgatcgggtgagcgtggaggccgtgttgccgatggataagcgcctcgatagactgatctctcactgcggacctgtcaccggatacatcttcgcgctgctggccgtattcaattttctgttcctcattttcctccgctggatgactccggattcgatcattgacgtggcaattgacgccaccgggccgagaggggcgtggactaacaattactcgcattccaagcgcggaggcgagaacaacgagatctcagagacgagg

SEQ ID NO: 250728 - DNA, 1452 bp, Artificial Sequence
  Description of Artificial Sequence: Synthetic coding sequence
atggcatgtcgcggcggcgccggaaacggccatcgcgcctcggcaactctgtcccgagtgtcgccgggatcactctacacgtgtcggacccggactcacaacatctgcatggtttccgacttcttctacccgaacatggggggagtcgaaagccacatctatcagctgtcccagtgtcttatcgaacgcgggcataaagtgatcatcgtgactcatgcatacggtaatcgcaagggaatccgatacctgacctcgggcctgaaagtctactacctgccactgaaagtgatgtacaaccaatcgaccgccaccacgctgttccacagcctcccgctgctgcggtacatcttcgtgagggagcgggtgaccatcatccactcccattcgtcattcagcgccatggctcacgatgccctgtttcatgctaagaccatgggcctgcagactgtctttaccgaccactccctgttcgggtttgcggacgtttcctcagtcctgacgaacaagctcctcactgtgtccttgtgcgatactaatcatatcatctgtgtctcatacacctctaaggagaatactgtcctgagggcggcgcttaatccggaaatcgtctccgtaatcccaaacgcggtcgatccaactgattttactccagacccgtttcgcagacatgactcaatcacgatcgtggtggtgagcagacttgtgtatcggaaggggatcgatcttctcagcggcatcattccagagttgtgccagaaatacccggacctgaacttcatcatcggaggcgaggggccaaagcggatcatcctggaagaagtcagagaaagataccagttgcatgacagagtcagactgctgggagccctggaacacaaggacgtgagaaacgtgttggtgcaaggtcacatcttcctgaatacttcgcttaccgaggctttttgcatggcgatcgtggaagccgctagctgtggactccaagtcgtctctacgagggtaggtgggatcccggaggtcctcccagaaaacttgatcattctctgcgaacccagtgttaaatcactgtgcgagggactggagaaggctatcttccagctgaagagcggaaccctgcctgcgcctgaaaacatccacaatatcgtgaaaaccttctacacctggaggaatgtcgccgaaaggaccgagaaagtgtacgacagagtcagcgtggaggccgtgctgccgatggacaagcggctcgacagacttattagccactgcggcccggtcaccggatacatcttcgcactgttggccgtgttcaactttttgtttctgatattcctgagatggatgacccctgatagcatcatcgacgtcgctattgacgcgacgggaccgcggggagcctggaccaacaattactcacacagcaagcgtggcggagagaacaatgagatcagcgaaacccgc

SEQ ID NO: 250729 - DNA, 1452 bp, Artificial Sequence
  Description of Artificial Sequence: Synthetic coding sequence
atggcttgtcgaggaggagctggcaatgggcaccgcgcctccgccactctatcgcgagtaagtccggggtccttgtacacatgtcggacccgtacacacaatatttgtatggtttcggactttttctacccaaatatgggtggagtcgagtcccacatctatcagttgtctcaatgcttgatcgaacgtggtcataaggtcattatcgttactcacgcttatggaaatagaaagggaattcgctatttgacttctgggcttaaagtatattatttgccactcaaagttatgtataaccaatccaccgcaactaccttgttccatagtttaccactccttcgctatattttcgtcagggagcgggttacgataattcattcacactcttcgttctctgccatggctcacgatgcgttatttcatgcgaaaacgatgggattacagactgtttttacggaccactctttattcggatttgccgatgtcagtagtgttctgacgaacaaactgctcactgtttcactgtgtgatactaatcatattatttgcgtgtcatatacttctaaggaaaatactgtactccgtgccgctttaaatccggagatcgtatccgtcattccaaacgcagttgacccgactgactttactcctgatccattccgacgtcatgacagtattactattgtagttgtctcacgtctagtctacagaaaggggattgatctccttagcggaattattccggaactttgtcaaaaatatccggatttgaacttcatcataggaggagaaggaccaaagcgtattattctggaagaagttagagagcgttaccaacttcatgatagagttaggctgctcggagcattggagcataaggacgttcgtaatgttctggtgcaggggcatatctttttgaatacatctttgactgaagccttttgcatggcaattgtagaagcagcaagttgtggccttcaagtggtttctacacgagtgggaggaattccagaagtgctaccggagaatttaattattctttgcgaaccatccgttaaatcattgtgcgaaggacttgagaaggcaatattccaacttaaatcaggaacacttccggccccagaaaacattcataatattgttaagacattctacacatggaggaatgtagcagaacgcacggagaaagtatatgaccgggtttccgttgaagctgttttacctatggacaagcgtctggatcgtctcatctcccattgtggaccggtcacaggatatattttcgctttgctcgctgtatttaattttctattcttgatttttcttaggtggatgacccctgactcaataatcgatgtagccattgatgcaactggaccaaggggagcttggactaataattactctcactctaaacgagggggcgagaacaatgaaatttctgagactcga

SEQ ID NO: 250730 - DNA, 1452 bp, Artificial Sequence
  Description of Artificial Sequence: Synthetic coding sequence
atggcctgcaggggcggagcggggaatgggcaccgagcatcggcaaccctgtccagggtgagccccggctccctctacacatgcagaacccgcacccacaatatatgtatggtctctgacttcttttatcctaacatggggggagtggagtcccacatctatcagttgagccagtgcctaatcgagcgaggccacaaggtgataatagttacccacgcctatggtaatcggaagggaatacgttatctgacgagtgggttgaaggtgtactatcttcctctcaaagtgatgtacaaccaaagcactgctaccacactgttccatagtctccccctgctgagatacatattcgtcagggagcgggtgacaataatacactcccacagctctttctccgccatggcacacgacgcattgttccatgccaagaccatgggacttcagaccgtgtttacggaccattcgctgttcggtttcgctgacgtttctagtgtcctgactaataagctccttacggtcagcctgtgtgacaccaatcacataatttgtgtatcttacacaagcaaagagaacaccgtgcttcgagcagcgctgaaccctgaaatcgtgtcagtgattcccaacgctgtggatcccaccgattttacacctgacccttttcggcgtcacgatagtatcactatcgtcgtggtttcccgccttgtgtataggaaaggcattgacttgctatctggaatcatccctgaactgtgccaaaagtaccccgacctgaacttcattattggcggcgagggacccaaacgaattatccttgaggaagttcgcgagaggtatcagctccatgaccgggtgcggcttcttggagcccttgaacacaaggacgtacgaaacgtgctcgtgcagggacatatcttcttgaacacatccctgaccgaagctttttgtatggctattgtcgaagctgcaagctgcggcctccaggtggtttccactagagtgggcgggatcccagaggtcctgccggagaatcttataattctttgcgagccttcagtgaaatctttgtgcgaaggcctggagaaggcaattttccagttgaaatctggcaccctgccagctcccgaaaacattcataacatcgttaagaccttctatacttggcggaacgtggccgaaaggacagagaaagtgtacgatcgcgtttcagtcgaagccgtcctgccgatggataagagactcgaccggctgatctcacactgcgggccggtgacaggctacattttcgctctgttggcggtgttcaattttctcttcctaatcttcctacggtggatgactccagactccattattgatgtagctatagatgcaaccggacctcgtggtgcttggacaaacaactactcccacagcaagagaggcggtgagaataatgagattagtgagacaagg

SEQ ID NO: 250731 - DNA, 1452 bp, Artificial Sequence
  Description of Artificial Sequence: Synthetic coding sequence
atggcctgcagaggaggtgccggcaatggtcaccgcgcatcagcgaccctgtcccgggtatcgcctggatcgctgtacacttgccgcactcgcacccataacatctgcatggtcagcgacttcttctaccctaacatgggcggcgtggaaagccacatctaccagctgtcgcagtgcctgattgagaggggacacaaagtgatcattgtgacccacgcatacggaaacagaaaaggaattcgctacctcacctccggcctgaaagtgtattacctgcctcttaaagtcatgtacaaccagtctacggctaccaccctgtttcacagcctgccactgctgcgctacatcttcgtgcgggagcgagtcactattatccactcgcactcgtcgttctcggcgatggcacacgatgctctgttccacgcaaaaacgatggggctccaaactgtcttcactgatcacagcttgtttgggttcgccgacgtctcatcggtcctcacgaacaagctgctgaccgtctcgctgtgcgacaccaaccatatcatctgcgtctcgtataccagcaaggaaaataccgtgctccgcgctgccctgaatccagagatcgtgtcggtgatcccgaacgctgtggaccctactgacttcactccggacccgttcaggcggcacgactcaatcactatcgtcgtggtgtcccggcttgtttaccgcaaggggattgacttgctgtcgggcatcattccagaactttgccaaaagtacccggacctgaacttcatcatcggaggcgaagggccgaagagaattattctggaggaagtgcgcgaaagataccagcttcacgaccgagtgcgcttgcttggcgctctggagcataaggatgtccggaatgtgctggtgcaaggtcacatcttcctcaatacctccctgaccgaagcgttctgcatggcgatcgtggaggccgcctcatgtggattgcaggtcgtgagcactagagtcggagggattccggaggtgctgccggaaaatctgatcatcttgtgcgaaccgtcggttaagtccttgtgtgaaggcctggagaaagccatcttccaacttaagtccggcactctcccagctccggaaaatatccacaacatcgtgaagactttttacacctggagaaacgtcgccgaacggactgaaaaggtctacgatcgcgtctcggttgaagcggtcctgccgatggataagcgcctggatagactgatcagccactgcggaccggtcacgggttacatcttcgcactgctggccgtgtttaactttctcttcctcattttcttgaggtggatgactccagactcgatcatagacgtggcaattgatgcgaccggaccacggggagcctggaccaacaattactcacactccaaaaggggtggagaaaacaatgagatctccgaaactcgc

SEQ ID NO: 250732 - DNA, 1452 bp, Artificial Sequence
  Description of Artificial Sequence: Synthetic coding sequence
atggcatgtagaggaggtgccggaaatggtcatagggcatctgcgactctttcaagagtgtctcccggaagcctgtacacctgtcgtaccaggactcataacatttgtatggtgtcggacttcttttacccgaacatgggaggagtcgaatcccacatttatcagctttcacaatgtctcatagaaagaggtcacaaagtcataatagtgacccatgcatacggaaaccgaaaaggtattcgttatctgacttccgggctcaaggtgtactacctgccactgaaggtgatgtacaatcaatccaccgccaccaccctttttcactccctgcctcttctcaggtacatttttgtccgagaacgtgtgacgattatacattcgcatagctccttctcggcaatggcacatgacgcactctttcacgcaaagaccatgggactccaaaccgtgttcactgaccattccttgtttggcttcgcagatgtctcgtcagtgctgaccaataagctcctgacggtgtcgctgtgcgacaccaaccatatcatttgcgtgtcatacacgtccaaggagaacaccgtcctccgcgcagcccttaaccctgaaattgtgtcggtcattcctaatgccgtggaccctaccgatttcactccagacccctttcgcaggcatgactccataaccatagtcgtggtgtcccggcttgtgtacagaaaaggaatcgatcttctctccggaatcattcccgaactgtgccaaaagtacccagatctcaacttcataattggtggagaaggaccgaagaggattatactcgaagaagtgagagagcgctaccaacttcatgaccgagtgcgactgctcggcgcactggaacacaaggatgtccgcaacgtgcttgtccaaggtcatatcttccttaacacttcccttactgaggccttttgtatggcaatcgtcgaagccgcttcctgtggtttgcaagttgtctccacgagagtggggggaatcccagaagtgctgccagaaaacctgattatactttgtgagccatcagtcaagtctctttgtgaaggacttgagaaagcaattttccaactcaagtccggtacgcttcctgcacccgagaacattcataacatcgtgaaaaccttttacacttggcggaatgtcgccgaacgcactgaaaaggtgtacgatagagtgtcggtggaagctgttctccctatggataagagacttgatcgcctgatctcccattgcgggcctgtgactgggtacatcttcgcccttctggcggtctttaacttcctgttcttgatatttctgagatggatgacccccgattcgatcatcgatgtggcaattgatgcaaccggaccccggggtgcatggactaacaactactcgcatagcaagcggggtggagagaacaacgagattagcgagactcgt

SEQ ID NO: 250733 - DNA, 1452 bp, Artificial Sequence; identical to SEQ ID NO: 250730
  Description of Artificial Sequence: Synthetic coding sequence

SEQ ID NO: 250734 - DNA, 1452 bp, Artificial Sequence
  Description of Artificial Sequence: Synthetic coding sequence
atggcgtgtaggggcggggccgggaacgggcacagagcaagcgcaaccctgtctagggtgtccccagggtcgttatacacctgcagaaccagaacccataatatttgcatggtttccgattttttttaccccaatatggggggcgtagaaagccatatctaccagttgtcgcaatgcctaatcgaacgtggtcacaaagtgataatagtaacacacgcttacggcaacaggaaaggaatcaggtatcttactagcggattgaaggtctactacctgcccctgaaggtgatgtacaaccaatccactgcgaccacacttttccactcgttacccctattaaggtatatcttcgtgagagagagggttacaattatacactcacattctagcttctcggcaatggcccacgatgcactcttccacgcgaagacaatgggactgcagaccgtatttacagaccactccctgtttggattcgccgatgtttctagcgtgcttactaacaagctgcttacagtgtccctgtgtgacacgaaccacattatttgcgtatcctacacgtctaaagaaaatacagtccttagggctgcactcaatcccgaaatcgtgtccgttatccctaacgctgtagaccccaccgatttcacccctgatccattccgccgacatgattccattacaattgtggtcgtgagtagattggtctacaggaagggaatagatttgctgtcaggcatcatacctgaactgtgtcagaagtatcccgatctcaatttcatcatcggcggagaagggcccaagagaattattctcgaggaagtgcgagaacgttaccaactacatgacagagtgagactgttaggcgcccttgagcataaggacgtgaggaatgttctcgttcagggccatatctttttaaacaccagcctcactgaggctttttgtatggccatcgtggaagcggcatcctgcgggttgcaagtggtgagcacacgagtcggcggtattcccgaagtacttccggaaaatctgataattttgtgcgaacccagcgtgaagagcctttgtgaagggctggaaaaagctattttccagctgaagagtggtaccctgccagcgccggaaaatatccataatattgttaagacattctatacttggcgaaacgtggccgagcggactgagaaagtgtacgatcgtgttagtgtggaggccgtgttgcccatggacaagcggctcgacaggttaatttcacattgcggccccgtaacaggttatatcttcgcattgcttgccgtctttaactttttatttctcatatttctaagatggatgactcccgatagcatcatcgacgtagctatcgatgcgaccgggcctagaggtgcatggacgaacaattactcccacagcaaacgtggcggcgaaaataatgaaatcagcgagacgagg

SEQ ID NO: 250735 - DNA, 1452 bp, Artificial Sequence
  Description of Artificial Sequence: Synthetic coding sequence
atggcgtgcaggggaggagccggtaatggccaccgcgcttcggccaccctttctcgcgtgtctccgggatccctctacacctgtcggactcgaactcacaacatatgtatggtgtcggatttcttttatccgaacatgggaggtgtggaatcgcacatctaccaactttcacagtgcctgatcgaacgcggacataaggtgatcatcgtcactcacgcatacggaaatagaaagggtatcaggtaccttacgtcgggtttgaaagtgtactacctcccgttgaaggtgatgtacaatcaatccaccgccactactctgttccattcgctgccgctcctgaggtacattttcgtccgcgagagagtgaccatcatccattcccactcctcgttctcagccatggcacacgacgctctcttccatgcaaagactatgggtctgcagactgtgttcaccgaccactccctgttcggatttgcagacgtgagcagcgttctgaccaacaaactgctgaccgtgtcgctttgcgataccaatcacatcatttgcgtttcatacacctcaaaggaaaacacggtcctccgggccgccctgaacccggagatcgtgagcgtaatcccaaatgccgtggacccgactgacttcacccctgacccgtttaggagacacgactcgattactatcgtcgtggtgagccgtctggtgtatcggaagggcatcgacttgctttctggaattatcccggaactgtgtcagaagtaccccgatctgaacttcatcatcggaggggagggacctaaaaggatcatcctcgaagaagtgagagagcggtaccagctccacgatcgtgtgcgcttgctgggagcgctggaacataaggatgtccggaacgtgttggtgcaaggccacattttcctcaacacttccctgactgaggcgttctgcatggccattgtcgaagccgcgagctgcggactgcaggtcgtctccaccagagtggggggcatcccagaggtgttgcccgagaacctcatcatcctctgcgagccaagcgtgaagtctctgtgcgaaggcctggagaaagctatctttcagctcaagtcgggcacgcttccggcacctgaaaacatacataacatcgtaaaaactttctacacctggcgtaatgtggcagaacgaacggagaaggtatacgaccgcgtgtcggtcgaggctgtcctgcccatggataagcgcttggaccgccttatcagccactgcggaccagtgaccgggtacatctttgcgctcctcgccgtgttcaatttcttgttcctcatctttctgcggtggatgacccctgactcaatcatcgatgttgctattgacgcgactggcccacgcggagcctggaccaataactactcccattcgaaacggggaggggaaaacaatgagatctcagaaactcgc

SEQ ID NO: 250736 - DNA, 1452 bp, Artificial Sequence
  Description of Artificial Sequence: Synthetic coding sequence
atggcctgtaggggaggtgctggaaatggccacagggcctccgccacactaagccgggtgagtccggggtcattgtacacgtgccggaccaggacacacaacatttgtatggtttctgatttcttttaccctaacatgggcggagtggaaagccacatataccagctttcacaatgcctgattgagaggggccataaggtaatcatagtgacccacgcttatggtaaccggaagggcatacgttatctgacaagcggtctaaaagtatattatctgcctttaaaagtaatgtacaaccagtccaccgccacaacactgttccacagtctgcctctccttcgctatattttcgtccgtgagcgcgtgacaatcatccattcccactccagcttcagcgctatggcccacgatgcactgttccacgcaaaaaccatgggactacaaactgttttcaccgaccacagtctgttcggcttcgcggacgtgtcaagcgtattgacgaacaagctattgactgtctccttgtgcgacaccaaccacatcatttgcgtgagctatacaagcaaggaaaatactgttctgagagctgcactgaaccccgagattgtctctgtaatccccaacgccgtggatccgacagatttcacacctgatcctttccggcggcatgatagtataacaatcgttgttgtcagccgcctggtgtatagaaaagggatcgatctgctgagcgggatcattcccgagttatgtcagaaatatccggacctgaacttcattataggaggcgagggtccgaaacgaattatccttgaggaagtgagggaacggtaccagcttcacgacagagtgcgcttgctgggcgcgctggagcataaagatgttcggaatgtgttggtacaggggcacatttttctcaataccagcctgacagaggctttctgcatggcgattgtagaagctgcaagttgcggcctccaagtggtctctacgagggtgggcggtatccccgaggtgctgcctgagaatttaatcatactatgcgaaccatctgtgaagagcctctgcgaaggactggagaaggcaatttttcagttgaagtctggaactctgcccgccccagaaaatatccacaacattgttaaaaccttttacacctggcgcaatgtagccgaaaggacagagaaggtgtatgaccgggtgtccgtggaagccgttttgccaatggacaagaggctggatcgcttgatctcccattgtgggcccgttaccgggtatatttttgctctcctggccgtcttcaacttcctgtttctcatttttcttagatggatgacccctgacagcataatcgatgtcgccatagacgcaaccggcccccggggcgcctggaccaataactactcgcacagcaagaggggcggcgagaacaacgaaattagcgagacccgg

SEQ ID NO: 250737 - DNA, 1452 bp, Artificial Sequence
  Description of Artificial Sequence: Synthetic coding sequence
atggcctgccggggaggagcggggaatggacaccgcgcaagcgccaccctgagccgagtctctcctggctcgctctacacgtgccgcactcgcacgcacaatatctgcatggtgagcgacttcttctatcccaacatgggaggagtcgaatcacacatctaccagctgtcccagtgcctgatcgaacggggacacaaagtgatcatcgtcacccatgcctatgggaatcggaagggaatccggtatctgacttcaggactgaaggtctactaccttccgttgaaggtgatgtacaaccagtccaccgcgactactttgttccatagcctgccactgctccggtacatctttgttcgggagcgcgtgactatcattcactcccactcctcgttctcggcaatggcgcatgatgctttgttccatgccaagactatgggactccaaacggtgttcaccgaccattcactctttggctttgcggacgtgtcctcagtcctgaccaataagctgctcaccgtgtcactgtgtgataccaaccatatcatttgtgtgtcatacacctccaaggaaaataccgtgcttcgcgcggctctcaatccagaaatcgtgtcggtcataccgaatgcggtggacccaactgacttcactcccgacccatttaggcggcatgactccatcactattgtggtcgtgtccagattggtctaccgcaaaggcatcgacctcctgagcggcatcatccctgagctgtgtcagaagtacccggatctgaacttcatcatcggaggagaagggccgaagaggatcatactggaggaagttagggaacgttaccaactgcacgatcgcgtgcgcctgctcggcgctcttgagcataaggatgtgcgcaacgtcctggttcagggacacattttcctcaacacttccttgacggaagccttttgcatggctattgtggaggccgcctcctgcggtctgcaagtcgtgtcgaccagagtgggaggtatcccagaggtgctcccagagaatctgatcattctctgcgaaccctcagtgaagtcgctgtgtgaaggtctggagaaggcaattttccagctgaagtcgggaactctgccagcaccagaaaacatccacaacattgtgaaaacgttctacacctggcgcaacgtggccgaacgcactgaaaaggtgtacgaccgggtgtccgtggaggcagtcctgccgatggacaaacggctcgatagattgatatcgcactgtggcccggtgactggatacatctttgcgctgttggccgtgttcaatttcttgtttctgatcttcctgcgttggatgaccccggactccatcatcgatgtggccatcgacgccactggcccgagaggagcgtggaccaacaattacagccactccaaacgaggaggagaaaacaacgaaatctcggaaacccga

SEQ ID NO: 250738 - DNA, 1452 bp, Artificial Sequence
  Description of Artificial Sequence: Synthetic coding sequence
atggcatgccgtggaggagccggcaacggacaccgggcctcggctaccctctccagagtctcaccgggatccctgtacacttgtcgcactagaacccataacatctgtatggtgtcggattttttctacccaaacatgggaggagtcgaatcgcacatctaccagctgagccaatgcctcatcgaaaggggacacaaggtgattatcgtcactcatgcctacggcaaccgcaaaggaatccggtaccttacttcaggactgaaggtgtattacctgccgttgaaagtcatgtacaatcaatcaaccgcgacgacgctcttccacagcctgcctctcctgcgctacatttttgtgcgggaacgcgtgaccatcatccactcccactcctccttcagcgcgatggcccacgatgctctgtttcatgccaagacgatgggcctccagaccgtgttcactgatcattcactcttcggatttgcggatgtgtcgtctgtactcaccaataagctcctgaccgtttccctgtgcgacaccaaccatatcatttgcgtcagctacacctccaaggaaaacaccgtgttgcgcgccgctctgaacccggagatcgtgtccgtgatccccaatgccgtcgatccgactgactttaccccagacccttttcggcggcatgattctattactatcgtggtcgtgtcgcgcttggtgtacaggaaaggaatcgacctcctgtcgggaatcatccccgagctgtgccagaaatacccagacctgaacttcatcatcggcggcgaaggaccgaagcgaattatcttggaggaagtgagggagcggtaccagttgcacgacagagtgaggctcctgggggcactggaacacaaggacgtgcgcaacgtgctggtccagggtcatatcttccttaacaccagtcttactgaggccttctgcatggcaatcgtggaggccgcctcctgcggactccaagtcgtgtcgaccagagtgggtggtatcccagaagtgctccctgagaacctcatcatcctgtgcgaaccgagcgtcaaatcactgtgtgaagggcttgaaaaggcaatcttccagctgaagtccggcactctgccggcgccagaaaacatccataatatcgttaagacgttctacacctggagaaatgtggcggagcggaccgagaaggtgtacgaccgagtcagcgtggaggctgtgctgccgatggacaagcggttggaccggctgataagccactgcggcccggttactgggtacattttcgcgctgctggccgtgttcaatttccttttcctgatcttcctgagatggatgactcccgattcgattatcgatgtcgctatcgacgcaactgggcctcgcggtgcgtggaccaacaattattcacactcgaaacgcggcggggaaaataacgagatcagcgaaactcgc

SEQ ID NO: 250739 - DNA, 1452 bp, Artificial Sequence
  Description of Artificial Sequence: Synthetic coding sequence
atggcatgccgcgggggagccggaaacggccatcgggccagtgctacattgtctcgcgtgagccctgggtcactgtacacctgccgaacacgtacgcataatatttgtatggtgagcgactttttctatccaaatatgggaggcgtggaaagccatatctatcagttgtctcagtgcttgatcgaaagagggcacaaggtcattatcgtgacccacgcatatggaaatcggaagggtatccgttatctgaccagcgggctgaaagtctactacttgccgctgaaagtgatgtataatcagagcaccgccaccaccttatttcacagtctgcccctgttacggtacatctttgtgagggagagagtcaccattatccatagtcattcttctttctctgcaatggcacacgacgccctcttccatgctaaaacaatggggcttcagacagtgttcaccgatcactccttgtttggcttcgcggatgtgtcaagtgtgctgaccaataagctgctaaccgtgtcgctctgcgataccaaccacattatctgcgtgagttacacatcaaaggagaataccgtgctgcgggccgccctgaaccctgagatcgtaagtgtcattcctaacgccgtggatcccactgacttcacaccagacccttttagacgccatgatagcataactatcgtagtcgtctccaggctggtgtaccgcaagggcatcgatttgttatccggcataattcccgagctttgccagaagtatcccgacctgaatttcataattgggggagaagggcctaagagaataatcctggaagaagtgagggaaagataccagcttcacgaccgggtgcggcttctgggagccctcgagcataaggatgtgcgtaacgttttggtgcaggggcatatctttttgaatacatccctcactgaggccttttgcatggccattgtcgaggccgcctcctgcgggctacaggttgtgagcacccgcgtgggcggaatccccgaagtgctcccagagaatctgattatcttgtgtgagccctctgtcaaatctttgtgcgaagggttagaaaaggcaatctttcagctcaaatcagggactctgccagcacccgagaacatccacaatatcgtaaaaaccttttatacttggagaaacgtggctgagcggaccgaaaaggtctacgaccgggtgtccgtagaggccgttctccctatggataagagactggaccgcctgatctcgcactgcgggcctgtgactggatatatatttgccctattagcagtgttcaacttcctgtttctgatttttctccggtggatgacacctgatagtatcatcgacgtcgccatagacgcaacaggccctcgtggcgcctggactaataattactctcacagcaagagaggtggcgaaaacaatgaaatcagtgagacgcgc

SEQ ID NO: 250740 - DNA, 1452 bp, Artificial Sequence
  Description of Artificial Sequence: Synthetic coding sequence
atggcgtgcaggggaggcgctggtaacggacatcgagcttccgctaccctctctcgtgtgtcacctggttccctctacacgtgcagaacccgcactcataacatctgcatggtatccgacttcttctacccgaacatgggtggagtcgagtcgcacatttaccaactgtcgcaatgcctcatcgaacgggggcacaaagtcataatcgtgactcatgcgtacggaaacagaaagggaatccggtaccttacttcggggcttaaggtttactacctccctctgaaggtcatgtacaaccagtccaccgcgaccaccctgttccacagcctccctctgcttcgctacatctttgtgagggaacgggtgaccatcattcatagccactcgtcgttctccgctatggcccatgacgcgctgttccacgctaagaccatgggactccagaccgtgttcactgaccactcactgttcgggttcgccgacgtgtcctccgtcctgacgaataagctgttgactgtgtccctctgcgacaccaaccacatcatctgcgtgagctacacctcgaaggagaatacggtcctgagggcagcgttgaaccctgaaatcgtgtcggtgatccccaacgccgtggaccctaccgatttcaccccggacccgttcagacggcatgattccatcactatcgtggtcgtctcccggctggtgtaccgtaagggcatcgacttgctcagcggaatcatccctgagctctgtcagaaatacccagacctgaacttcattatcggcggagagggcccgaaacgcattatcctcgaagaagtccgtgagcgctaccaattgcacgatcgggtgcgccttctgggtgcactggagcacaaggacgtccggaatgtgttggtgcaaggacatatctttctcaataccagccttactgaagcattctgtatggccatcgtcgaagcggcttcgtgcgggctgcaggtagtctccactagagtgggaggaattcctgaggtcctgccagaaaacctcatcatactgtgtgagccgtcggtgaagtccctgtgcgaaggcctggaaaaagccatcttccaactcaagtccggcaccctcccggcgccagaaaacatccacaacatcgtgaaaactttctacacctggcggaacgtggccgagagaactgagaaggtctacgacagagtgagcgtggaggcggttctgcccatggataagcggctggacaggctcatctcgcactgcggtcctgttaccggttacatcttcgccctcctggcggtgtttaacttcttgtttcttatctttctgaggtggatgactccagactccattatcgatgtggctatcgacgcaaccggaccgcgcggcgcatggaccaacaattactcacattcaaagagaggaggagagaataatgagatcagcgagactcgg

SEQ ID NO: 250741 - DNA, 1452 bp, Artificial Sequence
  Description of Artificial Sequence: Synthetic coding sequence
atggcttgcagaggtggggcgggaaatggccatagagcctccgcgaccctgtcgagagtgtccccgggttccctttacacctgcagaacgcgaacccacaacatttgcatggtcagcgacttcttctacccgaacatgggcggagtggagtcgcatatctaccagttgtcccagtgcctcatcgaacgcggacacaaagtgatcatcgtcactcacgcctacggcaatcgcaaaggcatccgctaccttaccagcggactgaaggtctattaccttccactgaaggtgatgtacaaccagtccacggccacgaccctgtttcattcgctgcctctcctgcggtacatcttcgtccgcgagagagtgaccattatccactcccattcatcattctcagcgatggcccacgacgcattgttccatgcaaaaacgatgggactccagactgtgtttaccgatcattccctgtttggattcgccgatgtgtcaagcgtgcttaccaacaagctgttgactgtttcgctgtgcgataccaaccacatcatctgtgtgtcgtacacctcgaaggagaatacggtcctgcgggccgccctgaaccctgagatcgtgtcggtgatcccaaacgcggttgatccgaccgactttacccccgacccgttcaggcggcacgattccatcactatcgtggtcgtgtctcgcctggtgtacagaaaaggaatcgatctccttagcgggattatccccgaactgtgtcagaagtacccggacctgaatttcatcattggaggagagggcccaaagcgcatcatcctcgaggaggtgagagagcgatatcagctccacgacagggtgcgcctgctgggagccctggagcacaaggatgtccgtaacgttctggtgcaaggacacatcttcctcaatacctcactgactgaagccttttgtatggctatcgttgaggctgcaagctgcggactccaggtcgtgtcgacgagggttggaggaatcccagaagtgctgccggaaaacctgatcatcctgtgcgaaccgagcgtcaagtccctttgcgaagggctcgaaaaagccatattccaactgaagagcggaacgctgcccgccccagagaacattcacaatatagtcaagaccttctacacttggcggaacgtggcggaacggactgaaaaagtgtacgatagggtgtcagtggaagcggttcttcctatggataaacggctggatcgcctgatatcgcactgcgggcccgtgaccggttacatcttcgcgctcctggcagtgttcaacttcctgttcctgatcttcttgagatggatgactcctgactcgatcatcgatgtcgccatcgacgccactggaccgcggggagcgtggaccaacaattactcgcactccaaacggggaggcgaaaacaatgaaatctcggaaactcgc

SEQ ID NO: 250742 - DNA, 1452 bp, Artificial Sequence
  Description of Artificial Sequence: Synthetic coding sequence
atggcctgccgcggcggagccggcaatggccacagggcctccgccactttgtccagagtttcccccgggtcactctatacttgcagaacccggacccacaacatatgcatggtaagcgatttcttctaccccaacatgggcggcgtggagtcacacatataccagctgagtcaatgtcttatagagagaggccataaagtgattatcgtgactcatgcctacggcaaccgaaagggcattcggtatctgaccagcggcctcaaggtctattacctgcccctgaaggtgatgtataaccagtccactgccaccaccctgtttcactctctgccattactccgatatatattcgtgcgcgaacgggtcacaatcattcatagtcatagcagcttctcagccatggcccatgacgccctgttccacgcaaagacaatggggttgcagacagtctttaccgaccattcactattcggattcgccgacgtgagcagtgttttgactaataaactgctgactgtcagtctgtgtgataccaatcacataatctgtgtgagctacacatctaaggaaaatacagtgctgagggccgctctgaaccccgaaatcgtgtccgttattcctaatgccgttgatccaacagactttacacctgaccctttcagaaggcatgattccataactattgttgtggtcagtcgcctcgtttatcgcaaaggcattgacctcctgtctggcattatacctgagctctgccaaaagtaccctgatctaaattttattatcggcggagagggccctaaaaggattatcctggaggaggtgcgtgaaagatatcaactacacgacagagtgagactgctgggggccctggagcacaaagatgtcagaaatgtgctcgtccaaggacatatcttcctgaacacaagcctaactgaagccttttgtatggcaatagtggaggccgccagttgtggcctccaagttgttagcactagggtgggtggcatccccgaggttctgcccgaaaatctgataatactgtgtgaaccctctgtgaagtcactgtgcgagggccttgaaaaggccatattccagctgaaaagtggtacattacctgcccctgagaatattcacaacattgtcaagacattctacacctggaggaacgtggctgaaaggaccgagaaggtatatgatcgggtgtccgtggaggccgtgctgccaatggataaaaggttagatagactgataagccactgcgggcctgtcactgggtatattttcgccctcctggcagtgtttaactttctgttcttaatcttcctgagatggatgaccccagacagtataatagatgtggcaatcgacgcaaccggccctagaggcgcctggaccaataactattcccatagcaagagaggcggcgaaaacaacgaaatttcagaaacccgc

SEQ ID NO: 250743 - DNA, 1452 bp, Artificial Sequence
  Description of Artificial Sequence: Synthetic coding sequence
atggcctgccgcggcggggcaggcaacggccaccgcgcatcagccactctctcgcgcgttagcccaggctcgctgtacacctgccggactaggactcacaatatctgcatggtgagcgactttttctatccaaatatgggaggagtggaaagccacatctaccagctgtcgcaatgcctcattgaaagagggcacaaggtgatcatcgtgacccatgcgtatggcaataggaagggcatccggtacctgacgtccggcctgaaggtctactacctgcctcttaaagtgatgtacaaccagtcgactgcaaccactctgttccattcactgccactcctccggtacatcttcgtgagagagcgtgtgaccatcatccactcgcactcttcgttctccgctatggcccatgatgccctgttccatgccaagaccatgggactgcaaaccgtctttaccgaccattccctctttggatttgcggacgtgtcgtcggtgctcaccaataaactgctcaccgtgtcgttgtgcgacaccaatcacatcatttgcgtctcatacacttcgaaagaaaacactgtgctgcgcgccgcccttaatccggaaattgtgagcgttatcccaaacgccgtcgacccgactgactttaccccggacccgtttcggcgccacgattcgattaccatagtggtggtgtccaggctggtgtacagaaaaggtatcgacctccttagcgggatcatcccagagctctgtcaaaagtaccctgacctgaacttcatcatcggaggagagggaccaaagaggatcatcctcgaggaggtgagagaacgctatcagctccacgaccgcgtgaggctgttgggagccctcgagcacaaggatgtgcggaacgtgctcgtgcagggccatatcttcctcaacacctcccttactgaggccttctgcatggcgatagtggaggctgcatcttgcggattgcaggtcgtgagcacccgcgtcggtggaatccctgaggtgctgccggaaaacctcatcattctgtgcgagccttcggtgaaatcactgtgcgaaggactggaaaaggcgatcttccaactgaagtcaggaactctcccggcccctgaaaacatccataacattgtgaaaacgttctacacgtggagaaacgtggccgagcgcaccgaaaaggtgtacgaccgcgtgtcggtcgaagccgtcctgccgatggacaagcgcctggatcggctcatcagccattgcggacctgtcaccgggtacatctttgcactgctggcggtgtttaacttcctgtttttgatttttcttagatggatgactccagactccatcatcgacgtggctattgacgcgacgggcccgagaggagcttggaccaacaactactcgcattcgaagcggggaggcgaaaacaacgaaatctccgaaacccgt

SEQ ID NO: 250744 - DNA, 1452 bp, Artificial Sequence
  Description of Artificial Sequence: Synthetic coding sequence
atggcctgcagaggaggcgctggtaatggtcatagagcctccgctaccttgtccagagtgagtcccggctctctctacacctgcagaaccagaacccataacatttgtatggtgtccgacttcttctaccctaatatgggcggcgttgagtcccacatttaccagttgtcccaatgcctgatcgaacgtggccataaagtcatcattgtcacacacgcatacggaaataggaagggcatcagataccttacatccggcctgaaagtatattaccttcccttgaaggtcatgtacaaccagtccactgcaactactctgtttcacagtctgcctctgcttcgttatatctttgtgcgcgaaagggttacaatcattcactcccattcctccttctcagcaatggctcatgacgcactgtttcacgccaaaacaatgggtctgcagactgtgtttactgaccattccttgttcggatttgcagacgtcagctctgttctcaccaataaattgttgacagtgtctttgtgcgacactaaccacattatctgcgtatcttacacctccaaggagaacactgtcctgcgcgctgctcttaaccctgagattgtgtctgttattcctaatgccgtggatcccaccgactttacacctgatccattcaggaggcacgactccatcacaatcgtggttgtatccaggctcgtctaccgcaagggtatcgacctcttgtctggtatcatccccgaattgtgccagaaataccccgatctcaactttataattggcggcgaaggtcccaaaaggattatcctggaggaagtgagggagagataccagctccatgaccgcgtgcgtcttttgggcgcactcgagcacaaggacgttagaaacgtcttggtccagggtcatatattcctcaacacttctcttactgaggctttctgcatggctatcgtggaggctgcctcctgtggactccaggttgtgtccactagggtcggaggtatacccgaggtgctgcctgagaatctgatcatattgtgcgagcctagcgttaaatccctttgtgagggtcttgagaaggctatcttccaactcaagagcggcacattgccagctccagagaatattcacaacatcgtaaagaccttctacacctggcgtaacgtcgccgagagaactgagaaggtgtacgaccgcgtgtctgttgaggctgtcctgcctatggacaagagattggacaggcttatctcccattgcggaccagttaccggttacattttcgctctgctggccgtgttcaacttcctgttcttgatctttctcagatggatgacacctgactctataattgatgttgccatagatgctacaggacctcgcggagcatggactaataattatagccacagtaagaggggaggtgagaacaacgaaatcagtgagacacgc

SEQ ID NO: 250745 - DNA, 1452 bp, Artificial Sequence
  Description of Artificial Sequence: Synthetic coding sequence
atggcctgcagaggtggcgcggggaacggccaccgggcatcagcgactctgtcgagagtctccccaggcagcctctacacctgtagaactcgtacccataacatttgcatggtgtccgacttcttttatccgaatatgggtggcgtcgaatcacatatctaccaattgtctcagtgtctgattgaacgtggacataaggtgattattgtgacgcatgcttacggaaacaggaaggggattcgctatctgaccagtggactgaaggtgtactaccttcccctcaaggtcatgtacaaccaatcaactgctactaccctgttccattcacttcctctgctgcggtacatttttgtcagggagcgggttactatcattcattcccactcatctttctcagcaatggctcacgatgctctctttcatgcaaaaaccatggggctccaaaccgtgtttaccgaccacagcttgtttggatttgcagatgtctcatcggtactcacgaacaaacttctcacggtgtcactgtgcgataccaaccacatcatttgtgttagctacacttctaaagaaaacaccgtcctgcgcgcagcccttaaccccgaaattgtgtcagtgatcccaaacgcggtggacccgaccgactttaccccagacccttttcgtagacatgattcgattaccatcgtcgtggtgtcaaggcttgtgtacaggaagggcattgatctcctctccggaatcattccagagttgtgccagaagtatcccgatttgaatttcatcattggtggtgaaggaccaaagcgtatcattctggaggaagtgagagagcggtaccagctgcatgatagagtcagattgctcggtgcacttgaacacaaggatgttagaaacgttctcgtgcaagggcacatattccttaacacttcgctgactgaagcattctgtatggcgatcgtcgaagccgcatcctgtggactgcaggtggtatccacgcgcgtcggaggaatacctgaggtgttgcccgaaaatcttatcatcctctgtgagccgtcggtgaagtccctctgcgagggacttgagaaagcaattttccaactgaaaagcgggactctgcctgcgccagaaaacattcacaacattgtcaagacgttctacacttggagaaatgtcgctgaacggaccgagaaggtgtacgatagagtgtctgtggaagcagtcctgcctatggacaaacgacttgatagactcatctcgcattgtggacctgtcaccggttacatttttgcacttcttgcggtgtttaacttcctgtttttgatttttcttaggtggatgactcctgattccatcatcgacgtggccatagatgcaactgggccaaggggagcctggactaataactactcacattccaagcgaggtggtgagaataatgaaatatctgaaactaga

SEQ ID NO: 250746 - DNA, 1452 bp, Artificial Sequence
  Description of Artificial Sequence: Synthetic coding sequence
atggcatgtcgcggaggtgcaggtaacggacatcgcgcctcagcgaccctttcgcgggtctcgccgggatctttgtatacttgtcgaacgaggacacacaacatctgtatggtctctgactttttctaccctaatatgggtggggtcgagtcgcacatctaccagctcagtcaatgtttgattgagcgtggccataaggtaattattgttacgcacgcttacggaaatcgtaagggcattcgatacctgacgagcggactgaaagtatattacctcccccttaaggttatgtataaccaatcaactgcgactactctgttccactcccttccgctgctgcggtacatcttcgtcagggaacgggtgaccattattcattctcatagttccttttctgctatggcccatgatgcattgttccacgctaaaactatgggcttacaaactgttttcaccgaccactcactttttggttttgccgatgtctcttcagtgctgaccaataaattacttacagtcagcctgtgcgacaccaatcacatcatctgcgtcagctatacctcgaaggaaaacacagtcctgcgtgcagctctcaaccccgaaatcgtttcagtgatccccaatgccgtcgatcctaccgacttcacaccggacccctttaggagacacgactcgatcacgatcgtagtggtctcgcgtcttgtttaccgtaaggggattgatttgttatccggcataatacctgaattgtgccagaaatatcctgacctgaatttcattatcggaggagaagggcccaagcgtatcatcctggaggaagtgcgagagagatatcaactgcatgaccgagttcgactgctgggtgccctcgagcacaaagatgtcaggaacgtcttagtccaaggccatatctttttgaatacatcgctgaccgaggcattttgcatggccattgtcgaggctgcgtcgtgtggattgcaagtcgttagtacgcgtgtggggggaataccggaagttttgcccgaaaacttgatcatcttgtgcgaaccttccgtgaagtctctttgtgagggccttgaaaaggcgatttttcagttgaaatccggtacactcccggctcctgagaacattcataacatcgtcaagacgttctacacttggagaaacgtcgcggagaggaccgaaaaagtttatgatcgcgtctcagttgaagccgttctcccaatggacaagagactcgatcgacttatttcccattgcggaccagtcaccggctacatattcgccctcttggctgtgttcaacttccttttcttgatttttcttagatggatgactcccgactccatcattgatgtggccatcgacgcgaccggcccacggggtgcatggactaataactattcccattcgaagcgtggaggggagaataacgagatctccgaaacccga

SEQ ID NO: 250747 - DNA, 1452 bp, Artificial Sequence
  Description of Artificial Sequence: Synthetic coding sequence
atggcctgtcgcggaggagctgggaacgggcatcgtgcttctgcaaccctgagccgcgtcagcccgggcagtctgtacacctgtaggacaaggacccacaacatttgtatggtcagcgattttttttaccccaacatgggcggcgtggagtctcatatctaccagttatcccagtgtctcatcgagcgcggacataaggtgataattgttactcacgcatatggcaatagaaagggtatccggtacctgactagcggcctgaaggtgtactatcttccgctcaaagtgatgtacaaccagtctacggcaaccactctgtttcatagcctccctctgctgcggtacatcttcgtgcgggaacgtgttacaattattcactctcattcttctttcagtgccatggcgcatgacgcgctcttccacgcaaagaccatgggcttgcagacagtgttcactgatcactcactttttgggtttgccgatgtcagttcagtgttaacaaataaactgctcacagtgagtctgtgtgacaccaatcatatcatttgtgtttcctacacgtctaaagagaacacagtactgcgagcagccctaaatcccgaaattgtgtctgtgatcccaaatgccgtggatcctaccgacttcacgccggatccattccggaggcacgactctatcaccatcgttgtggtgagcagattggtatataggaagggaatcgatctgttgagcgggattattccggagctgtgtcagaagtaccccgatctgaacttcatcattgggggggagggtccaaagcgtattatcctggaagaggtgagagagagataccagctgcatgaccgggtgaggctcctgggggccttggagcataaagacgtccgtaacgttctggtccagggccacatattcctgaacacatcactgacggaagcattttgtatggcgatcgtggaagccgcgtcatgtggtctgcaggtcgtgagtacccgggtgggggggatacctgaagtgctgcccgagaacctcattattttgtgcgaacctagcgtcaagagcctgtgtgagggcctagagaaggctatctttcagctgaagagcgggaccctccctgctccagaaaacattcacaatattgtaaaaacgttctacacatggaggaatgtcgccgagcgaacagaaaaagtgtacgacagggtctctgtcgaagccgttctcccaatggacaagcgcttggatcgtctgatttcccattgcggaccggtgaccggttacatttttgccctgctggctgtcttcaattttctgttcctcatctttctgcgttggatgactccagactcaataatcgacgtagccattgatgccacgggcccacgcggcgcctggactaacaactacagccacagtaaaagagggggagagaataatgagattagcgagacacgg

SEQ ID NO: 250748 - DNA, 1452 bp, Artificial Sequence
  Description of Artificial Sequence: Synthetic coding sequence
atggcgtgtagaggaggtgcaggcaatgggcaccgggcaagtgctaccctctcaagggtctcccccggctctctgtacacatgccgcacacggacgcataatatctgtatggtctccgatttcttctatcccaacatgggcggggtggaatctcatatatatcagctgagtcaatgtctgattgaaaggggtcacaaggtcataatcgtgactcatgcctatggcaaccgcaagggcattcggtatctgactagcggcctgaaggtgtattacttgccactgaaagtcatgtataaccagagcaccgccaccacactcttccactctctccctctcctgcggtacatctttgtgagagagagggtgaccattattcactctcactcatccttctctgcaatggcccatgacgctttgtttcacgcaaagacaatgggactgcagactgttttcaccgaccattccctgttcggctttgcggacgtgagctcagtgctgaccaataagttgctgaccgtgtctctgtgcgatactaaccatattatatgcgtgtcatacacttctaaagagaacaccgtgcttagagcagctctcaatcctgaaatagtttccgttatcccaaatgctgtggaccctacagacttcacccccgaccccttccggcgccacgactccatcacgattgtagtggtgagcagacttgtttacaggaaagggatagatctgctctctgggattatcccggaactttgccaaaagtatccggatctgaactttatcattggtggtgagggacccaagcgcatcatcttggaggaggtgcgcgagcgctaccagctccacgaccgggtcagactgttgggcgcccttgagcataaggacgtcaggaatgttctggtgcagggccacattttcctcaacacttcactgaccgaagccttttgtatggcaatcgtggaagccgcaagctgcggactccaagtcgtgtccacccgggttgggggaatccccgaggtcctgccagagaacctcataattctgtgcgagcccagcgtgaaaagtctgtgcgagggcctggaaaaagcaattttccagttgaagagtgggactttgccagctcccgaaaacattcacaatatcgttaagacattctatacatggaggaatgtcgcagagcgcacagagaaggtctatgatagagttagtgtcgaggcagtgctccctatggataagcggttggatagacttatctcccattgtgggcctgtgaccgggtatatctttgcgcttcttgccgttttcaatttcctgttcctgatcttcctgaggtggatgacacccgacagtataatagacgttgcgattgatgccacaggtcctaggggagcctggactaacaactattcccattctaagaggggaggggagaataacgagatttctgagacgaga

SEQ ID NO: 250749 - DNA, 1452 bp, Artificial Sequence
  Description of Artificial Sequence: Synthetic coding sequence
atggcatgtcgcggtggggcaggtaacggacatcgcgcatctgcaactctctcgagggtgtcaccgggatccctgtatacttgccggactagaactcacaatatctgtatggtgtcagacttcttttaccccaacatgggaggcgtggaatcgcacatttaccaactctcgcagtgtctgatcgaaaggggacacaaggtgatcatcgtgacccacgcctacggaaatcggaaagggatcagataccttacttccggactgaaggtgtactacctgcccctgaaagtaatgtacaatcaatccaccgccaccaccctctttcatagcctgccactgcttaggtacatttttgtgagagaacgagtcaccattattcattcgcattcctccttctcggcgatggcgcacgacgcactttttcatgccaagaccatgggactgcaaactgtgtttactgaccattcgctctttggatttgccgatgtctcgtccgtccttaccaacaaacttttgacggtcagcttgtgtgataccaaccatatcatctgcgtgagctacacgagcaaggagaacactgtgcttagagcagcactgaatcccgagattgtgtcagtcatcccaaacgcagtcgacccgaccgattttaccccagatccatttagacgccacgatagcatcaccattgtggtggtgtcacgactggtgtaccgaaagggtatcgatctgctgtcgggcatcatcccggaattgtgtcaaaagtaccctgatctgaatttcatcattgggggagaggggccaaaacgaataatcctcgaagaggtcagagaaagataccagctccatgatcgggtccgccttctgggagcacttgagcacaaggacgtgcgaaatgtgctcgtgcaagggcatatcttccttaatacctcgctcaccgaggccttctgtatggcgattgtggaggcagcatcgtgcggcctgcaggtcgtctctacccgggtcggtgggattccagaagttctccctgaaaacctgattattctctgtgagcctagcgtcaagagcctctgcgaaggtcttgagaaggcaatcttccagctcaagagcgggaccctccctgcacccgagaatattcacaatatcgtgaaaactttctacacttggagaaacgtggctgaacggactgaaaaggtttacgaccgagtgtcggtcgaggcagtgctgcccatggataagcggttggaccggctgatctcacactgtggtcctgtgaccgggtacatcttcgctcttctggcagtgtttaacttccttttcctgatctttctgagatggatgacccccgactccataatagatgtggcaatagatgcgaccggacctaggggagcctggaccaacaactactcgcattcgaagagagggggagagaacaacgagatctcggaaacccgg

SEQ ID NO: 250750 - DNA, 1452 bp, Artificial Sequence
  Description of Artificial Sequence: Synthetic coding sequence
atggcctgtcggggtggcgcaggaaacgggcatcgagcctcagccaccctgtcccgggtgagccccggaagcctctacacatgtagaactagaactcacaatatctgtatggtttctgattttttttatccaaatatgggcggagttgaatcccacatttaccaactttcgcagtgcctgatagaaaggggccataaggtgattatagtgacgcacgcctacgggaaccgaaaggggatccgttatctgacgagcggtctgaaagtttattaccttccattgaaagtgatgtataaccagagcaccgccacaacactctttcattcattacccctcttgcggtatattttcgtccgcgagcgggtaaccatcatccactctcattcctcgttctctgcaatggctcacgatgcgctgttccatgccaagacaatgggacttcagacagtatttaccgaccatagtctcttcggcttcgcagatgtgtcttctgtgcttacaaacaagttactgacagtgtccctgtgcgacacaaaccatatcatttgcgttagctacacaagcaaggaaaatacagtgctgcgggcagcactcaaccccgagattgtgtcagtgattccaaacgcggttgacccaaccgactttaccccagacccttttcgaaggcatgattccattacaatcgtcgtcgtgtctaggttggtgtaccgcaaggggattgacttactgtccggcatcattcctgaactctgtcagaagtatccagatttgaactttataattgggggagaaggtccaaagcgcatcatcctggaagaagtgagggaaaggtaccagctacacgaccgggtccgattattaggagcgctggagcacaaggatgttaggaacgtgctggtgcaagggcacatcttccttaacacttctctgacggaggctttttgtatggcaatcgtagaagcagcatcctgtggactccaggtcgtctctaccagggtgggcggtattccagaggtgctcccagagaacctgatcattctgtgtgaacccagcgtgaaatcgttgtgcgagggcctcgagaaggcaatttttcagcttaagtccggtaccttgccggctcccgagaacattcacaatattgtgaagacattctatacttggcggaacgtggcagaacggaccgagaaggtttacgaccgcgtcagtgtggaggccgttcttccaatggataagaggctggatcggctgattagccactgcggccccgtcacaggatatatcttcgccttattggcagtgttcaatttcctgttcttgatattcctcaggtggatgacccccgacagcatcatcgatgtcgctatcgatgccacagggccccgtggcgcttggacaaataactattcccattccaaaagggggggtgagaacaatgaaatctctgagaccagg

SEQ ID NO: 250751 - DNA, 1452 bp, Artificial Sequence
  Description of Artificial Sequence: Synthetic coding sequence
atggcctgtcgcggtggcgctggcaacgggcatagggccagtgcaaccttgtccagagtgtcaccggggtctttgtacacttgccgcacaagaacacacaatatttgcatggttagcgatttcttctacccgaatatggggggggtggagagtcacatctatcaactgagccagtgtctgatagagcgcggtcacaaagtaatcatcgtcacacatgcctacggcaacagaaagggcatccgctatctgacatctggtctgaaagtctattatctccccctgaaggtcatgtataaccagtctactgccaccacactcttccactccctccccctgctccggtatatcttcgtacgagagcgcgtcaccatcatccattcacattcctcattcagcgccatggcccacgatgccttgttccacgcaaagactatgggtctgcaaacagtgttcacggatcattccctctttggtttcgccgacgtgagcagtgttcttacaaacaagctgctgaccgtcagcctgtgtgatacaaaccacataatctgcgtgtcctacacatccaaagagaacaccgtgctgcgggctgccttgaatccagagatcgtgagcgtgatacctaatgccgtcgatccaaccgatttcactccagacccattccggcgccacgattccatcaccatcgtagtggtgtctcgcctggtgtaccggaagggtattgatctcctctcagggattatacccgaactgtgtcaaaaatatcccgatctcaacttcatcattggcggtgaagggccaaagaggattatacttgaagaagtgagagagcgataccagctccacgatcgcgttcgccttctgggggccctggaacacaaggatgtgagaaacgtgttggtgcagggtcacattttcctgaacaccagtcttactgaggccttctgtatggccattgtggaagccgcttcctgcggccttcaggtggtgtctacacgggtggggggcatccctgaagtgctccccgagaatctcatcatattgtgcgagcccagcgtgaaaagcctttgtgaaggactggaaaaagcaatattccaactcaaaagtggaacgcttccggctcctgagaacattcacaacatagtaaagacattctatacttggcggaatgtggcagaaagaactgagaaggtctatgaccgggtgagcgtcgaggcagtgctgcctatggacaaaagactcgataggctgataagtcattgcgggcccgtaacgggctatatcttcgcgttgcttgccgtgttcaatttcctgtttttgatctttcttcggtggatgaccccagattctatcattgatgttgctatcgatgctacagggccccgaggggcctggactaataactatagccattctaagcgaggaggagagaacaacgagattagcgaaacaaga

SEQ ID NO: 250752 - DNA, 1452 bp, Artificial Sequence
  Description of Artificial Sequence: Synthetic coding sequence
atggcgtgtagaggaggagctgggaatggtcatcgcgccagcgcaacgttgagcagagtctcacccggtagcctgtacacttgtcgaactcgcactcacaacatatgcatggtgtcagactttttctacccaaatatgggaggagtggaatcacacatttatcagcttagccagtgtcttattgaaagagggcataaggtgataattgtcacgcacgcctatggtaacagaaaaggaatccgttaccttacttcgggactgaaggtgtattaccttcctctgaaagtgatgtacaaccaatcgactgcgaccaccctgtttcatagcctgcctttgcttcgctacatttttgttagagaacgagttaccattattcattcccactcctcgttttccgcaatggcccatgatgccctgtttcatgccaagactatggggctccaaacggtgtttaccgaccattccctgtttgggttcgcagatgtgagctcggtgctgacgaataagctgctgaccgtgtccctttgtgatactaaccacattatctgtgtgtcctacacttcaaaggagaacacggtcctgagggcggccctgaatccggaaattgtgtccgtcattcctaatgcggtggatcccaccgattttactccggatccatttcggcgccacgattcgattaccatcgtcgtcgtgtcgagactggtgtaccgaaagggtatcgatctcttgtcgggaattatccctgagctttgtcaaaagtacccagacctcaacttcatcattggaggcgagggtccaaagagaattatcctcgaagaagtgagagaaaggtaccagcttcatgatagagtcagacttcttggggctctcgaacataaagatgtgaggaatgtgcttgtgcagggccacatatttctgaacacttccctgaccgaggccttttgtatggcaatcgtggaagcagcatcctgcggtctgcaagtggtgtcaactcgcgtcggaggcatcccagaggtgctccctgagaatcttatcatcctgtgcgagccctcggtcaagtcactgtgcgaaggacttgagaaggccattttccaactgaaatccggaaccctccccgcgccagagaacattcacaatatagtgaaaactttttacacctggcgtaacgtggcagaaagaaccgaaaaagtctacgaccgcgtcagcgtggaagccgtccttcctatggacaagaggctggacagactgatttcgcattgtgggcctgtgacgggatacatttttgcacttctggcagtgtttaactttctgttcctgatctttctgcgatggatgacccctgattccattattgatgtggcgatagatgccactggcccgagaggagcctggaccaacaattacagccattccaagcgaggaggagagaacaatgagattagcgagactaga

SEQ ID NO: 250753 - DNA, 1452 bp, Artificial Sequence
  Description of Artificial Sequence: Synthetic coding sequence
atggcatgccgcggaggagccggaaacggccaccgcgcttcggccacactctcacgagtgtctcccggcagtctttacacgtgcagaactcgcacccacaatatttgcatggtgtctgatttcttctatccgaacatgggtggcgtagagtcccacatctatcaattatcccagtgtctgatcgaacgcggtcataaagtgatcatcgtcactcatgcctacggcaatagaaaggggattagatacctcactagcggtttaaaagtctattaccttccgctgaaagtcatgtataatcagtctacagctaccactttatttcattccttaccactgttgagatacatttttgttagagaaagggtgacaattattcatagtcactcaagtttcagcgccatggcacacgatgcgctcttccacgcaaagaccatgggattgcagaccgtttttactgatcatagcctatttggttttgcggacgtcagctcggtgctgacaaacaaactgttgacggtctccctgtgtgataccaaccacatcatctgtgtctcctacacgtctaaggagaacaccgttctccgtgcagcccttaatcctgaaattgtgtcagtcattccgaatgcggtggatcctaccgacttcacacctgatcccttcagacggcatgacagtatcacgatagttgtggtgagccggttggtgtacagaaagggcatcgatctgctgagtgggattatccccgagctgtgccagaaatacccagatctgaacttcatcattggcggcgagggcccaaagagaatcattcttgaggaagtccgtgagcgttatcagctgcacgatcgtgttagattgcttggggcactagagcacaaagacgtccggaatgtcctagtgcaggggcatattttcttaaacacctcactgactgaggccttctgtatggccattgtcgaggctgccagttgtggacttcaggtcgtgtcgactagggtaggaggaataccggaagtcctgcctgaaaaccttatcatcctatgtgagcccagcgtgaagagtttgtgcgaaggccttgaaaaagcaattttccaactgaaatcaggcaccctcccagctcccgagaatattcacaatatcgtgaaaaccttctacacatggcggaatgtggccgagaggacggaaaaagtgtatgacagagttagcgtcgaggccgtcctgcctatggacaaaaggttagatcgcctgataagtcattgtggtcctgtcaccggatacatattcgcgttactggccgtcttcaacttcttatttttgattttcttgcgttggatgactccagactcgattatcgacgtagcaattgatgctacagggccgcggggagcctggactaataactattcccactccaaaagaggcggagaaaataacgaaataagcgagacacgg

SEQ ID NO: 250754 - DNA, 1452 bp, Artificial Sequence
  Description of Artificial Sequence: Synthetic coding sequence
atggcctgtcgcggaggtgctggtaacggacatcgcgcgtccgccacactttctcgcgtctcgcctggtagtctttacacctgcagaacgcggacccataacatctgtatggtttccgacttcttctaccccaacatgggcggagtcgaatcgcatatttatcagttgtcccagtgtctgatcgaacgaggccataaagtcataatcgtgacacatgcctacgggaaccggaaagggatacgctacctgacctctggtttaaaggtgtattacctgcccctgaaagtgatgtacaatcagagcactgccacaaccctgttccactcactccctctgctccgctatatctttgttagagagcgggtcaccatcattcacagccactcgtccttctccgctatggcccacgacgcattgtttcacgcgaagacaatgggcctccagacagtgtttactgaccattctcttttcggcttcgctgatgtgtcctcagtgttgactaataagctgctgaccgtgtcactttgcgatacaaaccacatcatatgcgtgagttatacatctaaggaaaacactgtactgcgcgctgcattgaacccagagatcgtatccgtgattcccaatgcggtggatcctacagatttcacccccgatccgtttcggaggcacgatagcataaccatagttgtcgtatcgaggctggtctatcgcaaggggattgatctgttatccggcatcatccccgagctgtgtcagaagtaccctgaccttaactttattataggtggagaagggcctaaaaggatcatcctggaagaggttagggagcggtatcagctgcacgacagagtgcgcttgttaggggccctggagcacaaggatgttagaaacgttcttgtccagggacacatttttttgaacacctccctgactgaagccttctgcatggctatcgtcgaggcagcatcctgcggactccaagtagtgagcacacgcgtgggcggtatcccagaggtgctacccgagaacctcatcatcctgtgtgaaccctccgtgaagagcctctgcgagggattggaaaaggcaatttttcagctcaagtccgggactctaccggctcccgaaaatattcataatattgtcaagacattttacacttggaggaacgtggccgaacggactgagaaagtctacgatcgggtttctgtcgaagctgtactcccaatggacaaaaggctcgatcggttgatatcgcattgcgggccagtgactggctatattttcgccctactcgcagtcttcaatttcctgttcctgattttcctccggtggatgacccctgattcaattattgatgtcgccatcgacgccacgggtccgcggggggcttggaccaataactacagtcacagcaagagaggcggggaaaataacgaaatctctgaaacgcga

SEQ ID NO: 250755 - DNA, 1452 bp, Artificial Sequence
  Description of Artificial Sequence: Synthetic coding sequence
atggcatgccgcggaggcgccggtaatggacaccgcgcgtccgccaccctttcaagggtgagccctggaagcctttacacctgtaggactcgcacgcacaacatctgtatggtgagcgactttttctatccgaacatgggaggggtggaatcccacatctatcagctgtcgcagtgtctgatcgaaagaggacacaaagtgatcatagtgacccatgcctacggaaatcggaaaggtatccggtacctcacctcgggactgaaggtgtactacctgccgctcaaagtaatgtacaaccagtccactgcaaccaccttgtttcattccctgcccctcctgagatacatcttcgtgagagaacgcgtgaccatcatccactcgcattcctcgttcagtgcaatggcccatgacgccctgtttcacgcgaaaacgatgggcctgcaaaccgttttcactgaccactcacttttcggattcgctgatgttagctctgtgctgactaacaagctcctgactgtgtcactgtgcgacaccaaccatatcatttgtgtgtcgtacacttctaaggagaacaccgtgcttcgggcggcgctcaatcccgaaatcgtctcggtcatcccaaacgccgtggatcctaccgactttactccggatccgtttagacggcacgattccatcacgattgtagttgtgtcgagactcgtgtaccgcaagggaattgacttgctgagcggcatcattccagaactctgccaaaagtacccggatctgaactttatcatcggaggcgaaggtccgaagcgcatcatcctggaagaagtgagagagcggtatcaactgcacgacagagtgaggcttctcggggcccttgagcacaaggacgtgcgcaacgtgctggtgcagggtcatatcttcctcaacacgtcattgaccgaggcattctgcatggccatcgtcgaggccgcctcgtgcggcctgcaggtcgtgagcactcgagtcgggggtatccctgaggtcctgccggagaacctcatcattctgtgcgaaccaagcgtcaagtccctctgcgaagggctcgagaaagctattttccagctcaagtccggaacgctccccgctccagagaatatccacaatatcgtaaagactttctacacttggcggaacgttgcggaacgaactgaaaaggtctacgaccgtgtctcagtggaagccgtgctgccaatggacaagaggctcgaccggctgatatcgcattgcgggccggtgaccggctacattttcgcgctgttggctgtattcaatttcctgttcctgatcttcctccgatggatgacgcctgatagtatcatcgatgtggcgatcgacgcaactggcccgcggggagcttggaccaacaattactcgcacagcaaacgcggcggagagaataacgagatctccgaaacccgt

SEQ ID NO: 250756 - DNA, 1452 bp, Artificial Sequence
  Description of Artificial Sequence: Synthetic coding sequence
atggcctgccggggaggggctggaaacggacacagagcttccgctacactcagcagggtcagtccagggtcactctacacctgccggactaggacccataatatctgcatggtgtcagatttcttttaccccaatatgggtggggtggagagccacatttatcaactgagccagtgtttgatcgaacgcggtcataaggttattatcgttacgcacgcttatggaaatcgcaaagggatccgatatttgacgtcagggttgaaggtgtactacttacccctgaaggtgatgtataaccagagcactgccaccactctttttcacagcctccctctgctcaggtacattttcgtacgcgagagggtgaccataatccattcccatagttccttctccgccatggcacatgacgcactgttccatgctaaaaccatgggactgcagacggtgttcaccgaccatagtctatttggtttcgccgacgtatctagcgtgctcaccaataaactgcttacagtgtcactgtgcgataccaaccacatcatttgcgtgtcatacacttccaaagagaacaccgtgctcagggcggcattaaatccagaaattgttagcgtgatcccaaacgctgtcgatcccacagatttcacgcctgacccttttcgcagacatgactccattaccatcgtggtggtgtctcgcctggtgtacaggaagggcatcgatctattgtccggcatcattcccgaattgtgtcaaaagtatcccgatctaaatttcattataggtggagagggtcccaagcgtataatcctggaggaggtgagagaaaggtaccagcttcacgacagggttcggctgttgggggctctggaacacaaggatgtacggaacgtcttggttcaggggcacatttttctcaatacttcattaaccgaggctttctgcatggctatagttgaagcagcatcctgcgggcttcaggtggtctccacccgcgtgggcggtattcctgaggtgctgcccgagaaccttattattctgtgtgagccatctgttaagtctctttgcgagggcctggagaaagcaattttccagctgaagagtgggacgttgcccgccccggagaacattcataatatagtgaaaaccttctatacatggagaaacgttgcagaacgaacagagaaggtctacgaccgcgtcagtgttgaggccgtgctaccgatggacaagagactggatcgcctaattagccactgtggacctgtcaccggatatatcttcgccctgcttgctgtgtttaacttccttttcctcatcttcttacgatggatgacccctgattccattattgacgtggctatagatgccacaggacctcggggtgcctggaccaataattacagccacagcaagcggggaggtgaaaataacgagatttctgagacacgg

SEQ ID NO: 250757 - DNA, 1452 bp, Artificial Sequence
  Description of Artificial Sequence: Synthetic coding sequence
atggcgtgcagaggaggagcaggaaacggtcatcgcgctagcgccaccctctcccgggtgagcccagggagcctgtacacttgtcgaacccgcactcacaacatctgtatggtgtcggatttcttctacccaaacatgggaggcgtcgagtcgcatatctaccagctttcgcagtgcttgatcgaacgcggacataaggtgatcatagtcacccacgcgtacggcaacaggaaagggatcagatacctcacgtccggcctgaaagtctattacctccctctgaaggtgatgtacaaccagtcgaccgccaccactcttttccacagcctgcccctcctgagatacatctttgtacgggaaagggtgaccatcatccactcccactcgagcttttccgcgatggcacatgacgcgctgtttcacgccaagactatgggtctgcagactgtgttcaccgatcactccttgttcggcttcgcggatgtgtcctccgtcctgactaataagctgcttaccgtgagcctctgtgacacgaatcatatcatctgcgtctcctacacctctaaggaaaacactgtgctgcgggctgcactgaatccagagatcgtctcggtgatccccaatgccgtggacccgactgatttcaccccagatcctttccggcgtcacgattcaatcactatcgtcgtcgtgtcaagactcgtgtacaggaaggggatcgacctgctgagcggcatcatcccggaactgtgtcagaagtatccagacctgaatttcattatcggtggagagggaccgaagcggatcatcctcgaagaggttcgcgagagatatcaactgcatgacagggtgaggctgctgggagcgctcgagcacaaagacgtgcgcaacgtgctcgtgcaaggccatatctttttgaacacttcacttaccgaggcgttctgcatggccattgtggaagccgcctcgtgtgggctgcaggtggtcagcactcgcgtgggaggaattccggaagtgctcccggagaacctcatcattctgtgtgaaccgagcgtgaagtcgctctgcgaaggcctggagaaagctatcttccagcttaagtccggcacgctgccggcacctgagaatattcacaacatcgtcaaaaccttttacacttggcgaaacgtggcggagagaactgaaaaggtgtacgaccgggtgtcggtggaggccgtcctgccgatggacaagaggctggaccgtctgatcagtcactgtggaccggtgaccggatatatctttgccctcttggctgtgttcaattttctcttcctcatctttcttagatggatgaccccggatagtatcatagatgtggctatcgatgccactggcccacgcggagcctggacgaacaattactcgcactcgaaacgcggaggagagaacaatgaaatctcagaaaccaga

SEQ ID NO: 250758 - DNA, 1452 bp, Artificial Sequence
  Description of Artificial Sequence: Synthetic coding sequence
atggcatgcaggggaggagcgggaaacggacaccgtgcctccgccactctctcccgagtgtctcccggatcactctacacttgcagaactcggacgcacaatatctgtatggtgtcggacttcttttacccaaacatgggaggcgtcgaatctcatatctaccaactgtcccagtgcttgattgagagagggcacaaagtcatcatcgtgacccatgcgtatggtaatcggaaaggcatccgctacttgacttccggtctgaaggtctattacctcccgctcaaggtgatgtacaaccaaagcactgcgactaccctgttccacagcctgccactcctgcggtacattttcgtgcgagaacgcgtgactatcatccacagccattcctcattctccgcaatggcccatgacgcgttgttccacgcgaaaaccatgggactgcagaccgtgttcaccgatcacagcctttttggattcgccgatgtgtccagcgtgctgactaacaagttgttgaccgtgtcactctgcgacactaaccacattatctgcgtgtcctacacctcgaaggaaaacactgtcctgcgagcagcactgaaccctgaaatcgtgtcggtgatcccaaacgccgtcgatccgaccgactttactccggacccgtttcggcgccacgacagcatcactatcgtcgttgtctcacgcctggtgtaccgtaagggtatcgatctgctgtccggcatcattcccgagctttgtcagaaataccctgacctgaatttcatcatcggaggtgaaggacctaagcgcatcatactggaagaagtgagggagcgctaccagctgcatgaccgcgtccggctgcttggggcattggagcataaagatgtgagaaacgtcctcgtacagggtcatatctttctgaatacgtctctcactgaggccttctgcatggcaattgtcgaggccgcttcctgtggtctgcaggtcgtctcaacccgggtggggggaatccctgaggtgttgccagagaatctgattatcctttgcgaaccgagcgtgaagtcgctgtgcgagggattggaaaaggccatatttcaactcaagagcggaacgctgccagcccccgaaaacatccataacattgtgaaaactttctacacttggcggaacgtggcggaaaggaccgaaaaggtgtacgacagggtttcggtcgaggcggtcctccccatggataagcgtctggatcgactcatttcgcactgcgggccggtgaccggctacatcttcgcccttctggccgtctttaacttccttttcttgattttcctgagatggatgaccccggacagcatcatcgatgtggctatcgatgccacgggaccgcggggagcatggaccaataactactcacactcgaagagaggtggggagaacaatgaaatctctgaaacccgg

SEQ ID NO: 250759 - DNA, 1452 bp, Artificial Sequence
  Description of Artificial Sequence: Synthetic coding sequence
atggcttgccgaggtggcgccggaaatggacacagggccagcgcaacactctccagagtgtcacccggctctctgtatacctgccggacccgaacgcataatatttgtatggttagcgatttcttctatcccaatatgggcggcgtggagtcccacatataccagctgtcccagtgcctaattgagagggggcacaaggtcatcatagttacccacgcgtacggaaacagaaaaggaatccggtacttgacctccggtctgaaggtctattacctgcccctgaaagtgatgtataatcagagtaccgccacgacacttttccattctctcccattgctgcggtacatatttgtccgcgagagggtgaccatcatacacagtcacagcagctttagcgcaatggcacatgatgcgctgttccacgcaaagactatgggcttgcagacagtgtttacggaccatagccttttcggttttgcggatgtgagcagcgtgctgacgaacaaactgctaaccgtatctctctgtgatacaaaccatattatctgcgtctcttatactagtaaggagaataccgtgctgcgggccgctctgaacccagagattgtgagcgtcatcccaaacgctgtggatcctaccgactttacacctgacccatttcgtaggcatgattcaatcaccatagtagtggtgtctaggctggtctacagaaaaggcattgacttgctgagcggcattattccagaactgtgccagaaataccccgacctgaatttcataattggcggagaaggtcccaaacgcattattctagaggaagtcagagaacggtaccaactccacgacagggtgcggctacttggcgctctggagcacaaggacgtgaggaatgtgctggtgcaaggtcacatcttcttgaacacttccttgactgaggccttctgcatggccattgtcgaggccgcctcctgcgggctccaagtggtgagtacccgcgtgggcggaatcccagaggttttgcccgagaacttgattatcctttgcgaaccatctgttaagtcactctgcgaaggcctggagaaagctatatttcagctcaaaagcggcacactgccagcccctgagaacattcacaacattgtgaaaacgttttacacgtggaggaacgtggctgagcgcacagagaaagtgtacgatcgcgtatctgtcgaagccgttctcccaatggataaacgcctggatcggttaatcagtcattgtggccccgttaccggatatatcttcgctttgctggccgtttttaattttctttttcttatcttcctccgatggatgacacccgattctatcatcgacgtagcaatcgatgccaccggcccacgcggcgcctggacaaataactatagccactctaagcgaggaggagaaaacaatgagatcagcgagactcgc

SEQ ID NO: 250760 - DNA, 1452 bp, Artificial Sequence
  Description of Artificial Sequence: Synthetic coding sequence
atggcttgccgcggcggtgccgggaacgggcaccgcgccagcgccaccctgtcgcgtgtctctccgggctcgctatacacttgccgcacccgtactcacaacatatgtatggttagtgattttttctatccaaatatgggcggggtcgagtcccacatctaccagctctcccaatgcctgatagaaagaggccacaaggttattatagtgacccatgcttatggtaatcggaagggtatacgctacctgaccagcggcctgaaagtgtactacctgccgcttaaggtgatgtataaccagtcaaccgccaccactttgtttcatagcctccctctgctccgttacatattcgtgcgcgagcgtgtgaccattattcactcgcactcaagcttctccgctatggcgcacgacgcactgtttcacgcgaagactatgggactgcaaaccgtctttaccgaccacagtttgttcggttttgcggatgttagcagcgtgctgactaataaactcctgacagtgagcctgtgcgacaccaatcacataatttgcgtgagctataccagtaaagaaaatacagttctccgcgcagcgctcaaccctgagattgtttctgtgattccgaacgctgttgaccctaccgacttcactccagacccattccgccgacacgactccatcacgatcgtggtcgtgagccgcttggtgtacaggaaaggcatcgacttgctgtctgggatcatcccggagttatgtcaaaagtatccagacctgaattttattatcgggggtgagggacccaaacgcataatattggaagaagttcgcgagcgataccagctgcacgatcgcgttcgcttgttgggcgctttggaacataaagatgttcgaaatgtgctggtccagggccacatctttctgaacacttcactcacggaagcattttgtatggcaatcgtggaggcagccagttgtggtctgcaggtggtgagcacccgagtaggtggcattccagaggtgcttcctgaaaatctgattatactctgcgaaccgagcgtgaaaagcctgtgcgagggactggagaaggcaatttttcagctgaaaagtggcaccctccctgctcctgagaacattcacaacatcgttaagacattctacacctggcgcaacgtcgcagagcgcactgagaaggtctacgaccgggtgagcgttgaggctgttctgccgatggataaacgcctggatcgcctgattagccactgtgggccagtgacgggctatatatttgcactgttggcggtttttaacttcctcttcctcattttcctgagatggatgaccccggatagtattatcgacgttgcgatcgatgccactggaccgagaggtgcctggactaataactactcgcactctaagcgcggcggtgagaataatgagatctcggagactcgt

SEQ ID NO: 250761 - DNA, 1452 bp, Artificial Sequence
  Description of Artificial Sequence: Synthetic coding sequence
atggcatgcaggggtggagcgggaaacggtcatagagcatcagcaaccctttcgcgggtgtcacctggaagcctctacacttgcaggacccgcacccataacatttgcatggtgagcgactttttctacccaaacatgggaggagtcgaatcccacatctaccagttgtcgcagtgtctgattgagcggggtcacaaagtgatcattgtgacgcacgcatacgggaacagaaagggaatcagataccttacctccggactcaaggtctactacctgccccttaaggtgatgtacaaccaatcgactgcaaccaccctttttcactcacttccactgcttagatacatattcgtcagagagagagtgaccattatacatagccactcgtcgttttcggctatggcacacgacgcactcttccatgcaaagaccatgggcctgcagactgtgtttacggatcactcgctgtttgggttcgcagatgtctcttcagttctcactaataagctgttgactgtgtcgctgtgtgacaccaaccatatcatctgcgtgtcctacacttcaaaagagaacactgtgctccgtgctgcgttgaacccagaaattgtgtcggtgattccgaacgcagtggatccgactgatttcacccccgatccttttagacgacacgattcgatcaccattgtcgttgtgtcacgtctggtgtatcgcaaaggtattgacctgctgtccgggattattcctgaactgtgtcagaaatatccggatttgaatttcattattggaggcgaagggcctaagcgcatcattctcgaagaggtccgtgaacggtaccaactccatgaccgcgtcagattgcttggcgcgcttgaacataaagacgtcagaaacgtccttgtgcaaggccatatctttcttaacacctccctgacggaggctttctgtatggccatcgtcgaggcagcatcctgtggcctgcaagtggtgtcgactcgcgtgggcgggattcctgaggtgcttccagaaaatctgatcattctgtgcgaaccatccgtgaagtctctttgcgagggcctggaaaaggcaatcttccagctgaaatcaggtactctccctgcaccagaaaacattcataacatcgtgaaaaccttttacacctggcgtaatgtagcagagcgaaccgagaaagtgtacgaccgggtgtcggttgaagcagtgcttcctatggacaagaggcttgatcggctgatatcccactgtggaccggtcactggatacattttcgcactgctggcagtgttcaattttctgtttctgattttcctgaggtggatgaccccagatagcattatcgacgtggcaatagacgcaaccggacctagaggggcatggactaataactactcacactcaaaaagaggaggagagaacaatgagatttccgagactaga

SEQ ID NO: 250762 - DNA, 1452 bp, Artificial Sequence
  Description of Artificial Sequence: Synthetic coding sequence
atggcctgcagaggcggagccggcaatggccacagggcttccgcaacgcttagtagggtctcccccgggagcctttacacttgcagaacacgcactcataatatttgcatggtttctgatttcttttaccccaatatgggcggtgttgagtcgcatatctatcagttgtctcagtgcctgatcgagaggggccataaagtaataatcgtcacacatgcctacggtaatcggaaaggcatccgctatctgacttccggccttaaggtgtattacctccccttgaaggtgatgtacaaccagagcaccgccactacattgttccatagcctgccgttgctccgctatatctttgtgcgagaacgagtgaccattattcactcccactcctccttttctgcaatggcacacgatgccctgttccatgccaagacaatgggccttcagacagtcttcactgatcacagcctgttcggctttgccgacgtctcttcagtgctgaccaacaagcttttgaccgtttctttatgtgacacaaaccacatcatctgtgtaagctacacgagcaaggagaacactgtactcagagcggccttgaatcccgaaattgtgtcggtgatcccgaacgcagtcgacccaacagacttcaccccggaccccttccggcgccatgactctattacaatcgttgtggtctcacgattagtgtacagaaaagggatcgacctgcttagtggcataattcccgaactctgtcagaaatatcccgaccttaattttatcatcggcggcgaaggtcccaagcgtattatcctggaagaggttcgagaacggtatcagttacacgacagagtacgtctgttgggcgccctggaacacaaggatgttagaaacgtgctggttcaggggcacatttttttgaacactagccttactgaggcattttgcatggccattgttgaggccgcttcgtgcggacttcaggtcgtaagtactagagtgggaggcatacctgaggtgctcccagagaacctgatcattctctgcgagccttccgtaaagagtctgtgtgaaggcctagaaaaggctatatttcagttgaaatccggcacgctacccgcccctgaaaacattcacaacatcgtcaagactttctatacatggagaaacgtggccgaacgaacagagaaagtgtatgatcgggtgagcgtggaagcagtactccctatggataaacgactggatcggctgatctcccactgcgggcccgtgacaggctatatcttcgccctgctggccgttttcaatttcttatttcttattttccttcggtggatgacaccggactctatcatagatgtggctatcgatgcaacaggaccacgcggcgcctggaccaataactattctcattcgaagagaggcggtgaaaacaacgaaattagcgaaaccagg

SEQ ID NO: 250763 - DNA, 1452 bp, Artificial Sequence
  Description of Artificial Sequence: Synthetic coding sequence
atggcatgtcgcggtggggcagggaacggtcatagagccagcgccaccctctctagggtcagcccggggtccctgtacacttgtcggacccgaactcataacatctgtatggtgtcggactttttctacccaaatatgggtggagttgaatcccatatctaccagctctcgcaatgtctgatcgaacgaggacacaaggtgatcattgtcacccacgcatacggcaatcgaaagggcatacgctacctgaccagcggactcaaggtgtactacctgccactcaaagtgatgtacaaccaatccactgctacgactcttttccactctctgccacttctgcgatacatctttgtccgggaaagggtgaccattattcattctcactcatccttttccgcaatggcacatgacgcactcttccatgccaaaactatggggctccagaccgtgttcactgatcattcgctttttggttttgcggatgtttcgagcgtgcttaccaacaagttgctgaccgtgagcctttgtgatactaatcacattatctgtgttagctacacctctaaggagaatactgtgcttagagcggcactgaaccctgaaatagtgagcgtgatcccaaacgccgtcgatcccactgattttaccccagacccatttcggcggcacgattcaatcaccatcgtggtggtgtcaaggctggtgtataggaaggggatcgatctcctgtccgggattataccggagctttgccagaagtaccccgacctcaacttcatcattggaggagaggggcctaagaggataatcctcgaggaggtccgtgaacgctatcaactccatgatagagtgcggcttctgggagcgctggagcataaggatgtgagaaacgtccttgtgcaaggacacatctttcttaatacttccctcactgaagcattctgcatggcaattgtggaagcagcatcgtgcggcctccaagtcgtgtcaacgcgggtgggtggaattccagaggtcctgcctgaaaaccttatcattctctgtgaaccttcggtgaaatcgctctgcgaagggctcgaaaaggcgatttttcagctcaaatctggaaccctgccggctcccgagaacattcataacattgtgaaaaccttttacacctggcgcaacgtggcggaacggactgaaaaggtgtacgacagagtgtccgtcgaagccgtactgcctatggataagaggctcgatcggctgatttcccattgtggaccagtcaccggatacattttcgcacttttggcagtgttcaatttcctgtttttgatattccttagatggatgacccccgacagcattattgacgtggcaattgatgctaccggtccacgcggtgcgtggacgaacaactactctcattcgaagcggggtggagaaaacaacgagatttcggagactcgc

SEQ ID NO: 250764 - DNA, 1452 bp, Artificial Sequence
  Description of Artificial Sequence: Synthetic coding sequence
atggcgtgtagagggggcgcaggcaacggtcacagagcttcagcaaccctctcgcgcgtgtcccctggatctctttacacttgtcggacccgcactcataacatttgcatggtgtcggacttcttttacccgaatatggggggcgtcgagtcgcacatttaccaactttcgcaatgtcttatcgagcgcggtcataaagtgataatcgtgacccacgcctacggaaatcggaaagggattagataccttacttcagggcttaaagtgtactaccttcctctgaaggtcatgtacaaccagtctaccgcaaccaccctctttcatagcctgccattgttgagatacatctttgtgagagagcgggtgacgatcatccattctcattcttccttttcagctatggcgcatgatgcgttgttccatgcaaagactatgggcctgcagaccgttttcaccgaccatagcttgtttgggtttgcagatgtgtcctccgtgctcactaataagttgctgacggtgtcgctttgtgataccaaccacattatctgtgtgtcgtacacttcgaaggaaaacaccgtcttgcgcgcggcacttaaccctgaaattgtctcggtcatccctaatgctgtggatcctaccgactttaccccagatcctttccgccgacatgacagcatcactattgtggtggtgtcacggcttgtgtataggaagggcatcgatctgctttcggggataattccagagctgtgccagaaataccccgaccttaacttcattatcggcggagagggacctaaacgcattatcctcgaagaagtgagagaaagataccaactgcatgatcgcgtccgtctccttggcgcacttgagcacaaggacgtgagaaacgtgcttgttcaaggccacatttttctgaatacttcgcttactgaggccttctgcatggcaatagttgaggccgcaagctgcggtctgcaagtggtcagcaccagagtgggtggaatcccagaagttctgccagaaaacctgattatcctgtgtgagccatcggtcaaatccctgtgtgaaggcctggaaaaggctatctttcaacttaagagcgggaccctgcccgcaccagagaatattcataacattgtgaaaaccttctacacctggaggaacgtcgccgaaagaaccgaaaaggtgtacgatcgggtcagcgtcgaggcagtccttccaatggacaaacgtcttgatcgtctcattagccattgcggacctgtgaccggctacattttcgccctcctcgcagtgttcaactttttgttcctgatttttctgagatggatgactccagattccattatcgatgtggcaatcgatgccactgggccccgcggcgcatggaccaacaactactcgcattcgaaacgaggaggtgaaaacaatgaaatctccgaaacgcga

SEQ ID NO: 250765 - DNA, 1452 bp, Artificial Sequence
  Description of Artificial Sequence: Synthetic coding sequence
atggcctgccgtggtggtgccggaaacggacatagagcttctgctacacttagtcgggtgagtcctggatccttgtacacatgccgaacacgtactcataacatctgtatggtttctgacttcttctacccgaatatgggtggagttgagtctcacatatatcaactttcgcagtgcctgatcgaacgtggacacaaggtgattatcgtgacacatgcctacggaaatagaaaaggcatacgttatctcacatctggattaaaggtctattatcttccactgaaggtcatgtacaatcagagcactgcaactacgttgttccatagtttgccactccttcgatatatcttcgttagagagagagttactattatacactctcattctagctttagtgccatggcacacgatgcactcttccatgctaagaccatgggattgcaaaccgttttcacagatcatagcttgttcggattcgcggacgttagctccgttctcaccaataagctcttgacagtttccctctgtgacacaaatcacattatctgcgtttcttacacgagcaaagagaacaccgtgcttagggccgctctcaaccccgaaatagttagtgtaattcccaatgccgttgatccaacagattttacgcctgatccgtttcggaggcacgattcaattacaatcgttgttgtcagccgtttggtgtatagaaagggcattgatcttctgtcgggtatcataccagagctttgccagaaatatcctgatctgaacttcattattggaggggagggtccaaagagaattattctcgaagaagttagagagcgttaccagcttcatgatcgagttcgactcctgggagcactcgaacataaggatgttagaaatgtactggttcagggacatatttttttgaataccagtttaacagaagccttctgtatggcaattgttgaagctgcctcatgcggcctccaagtagttagtacacgagttgggggtattcctgaagtccttccagagaacttgattattctgtgcgaaccttcagtgaaatctctttgtgagggtctcgagaaggccattttccagcttaaatctggtaccttaccggctccagaaaacatacataacatagttaaaaccttctacacgtggaggaatgtcgcagaacggaccgagaaggtttacgacagggtctctgttgaagccgtcctacctatggataaacggttggatcgtcttatctcgcactgtggtcccgtgaccggatatatttttgccctcttggcggttttcaatttcttgtttctgatctttcttaggtggatgaccccagattccatcatcgacgtcgctattgatgctactggtccacgaggggcttggaccaataattatagccattccaaaagggggggagaaaataatgaaattagcgagactaga

SEQ ID NO: 250766 - DNA, 1452 bp, Artificial Sequence
  Description of Artificial Sequence: Synthetic coding sequence
atggcgtgcagaggaggtgcaggcaacggccatagggcctccgcgaccctgtcaagagtctcgccggggagtctctacacttgccgcactagaacccacaatatctgtatggtcagcgacttcttctacccaaacatgggtggagtggaatcgcatatctaccagctgtcgcagtgcctgatcgaacgcggtcacaaggttatcattgtgacccacgcctacggaaatcggaaggggatcaggtaccttactagcggactgaaagtctactacctgccgctgaaggtcatgtataaccagagcactgccaccactttgttccactctctgccactcctgcggtacatcttcgtgcgggaacgggtcaccatcatccattcgcacagctccttttctgccatggctcacgatgctctgttccacgctaagaccatggggctgcagaccgtctttaccgaccatagcctgttcggattcgcggacgtatcgtcagtgctcaccaataaacttctgaccgtgagcctgtgcgataccaatcacatcatttgtgtgtcgtacacttctaaggaaaacactgtgttgcgcgcagccctcaacccagaaatcgtgtccgtcattcctaatgcagtcgaccctaccgacttcactccggacccgttcaggagacacgattccatcaccatcgttgtcgtgtcgcgccttgtctacagaaagggtatagacctcctttccggcatcatcccagagttgtgccagaagtacccggatcttaacttcattattggcggtgaaggcccgaagcgcatcatcttggaggaggttagagagaggtaccagctgcatgatcgggtgcgcctgttgggagcgctcgaacataaagacgtgcggaacgtgctcgtgcagggccacatcttcctcaatacgtctctgaccgaggctttctgcatggcaatcgtggaagccgcgtcatgcggactccaagtggtgagcacgagagtgggaggaattccggaagtcctgccggaaaacctgatcatcctgtgtgagccgtctgtgaagtcactttgcgagggattggagaaggcgatctttcagctgaagtcaggtaccctgcccgctccggaaaacatccataacatcgttaagaccttctacacctggcggaatgtggcggagaggaccgagaaagtgtacgaccgcgtgtcggtggaggcagtgctgccaatggacaagagactcgacagattgatctcgcactgcggtccagtgaccggatacatcttcgcgctcctggccgtgtttaacttcctgtttctgatcttcctgcgctggatgaccccagattccattatcgatgtggccatcgacgccaccggaccacgcggcgcctggactaataactactcgcactccaagcgtggaggagaaaacaatgaaatctccgaaacccgg

SEQ ID NO: 250767 - DNA, 1452 bp, Artificial Sequence
  Description of Artificial Sequence: Synthetic coding sequence
atggcgtgcagaggcggtgctggcaacgggcaccgcgcgagcgctacactatctcgtgtgtcacccgggagcctgtatacttgccgcacccgtactcataacatttgcatggtgtctgactttttttatcctaacatgggaggagtcgagtctcatatctaccagctctcccagtgcttgatcgagcgtggccacaaagttatcatcgtgacacacgcctatgggaaccgaaagggcatccgctacctcacctccgggctgaaggtgtattacttgcctctgaaggtcatgtacaaccagagtaccgctacgactctgttccactctctgcctctgctgcggtacattttcgtgcgtgagcgtgtgacaataatccactctcactcatcattttctgccatggcccacgatgccttgttccatgctaaaactatggggctgcaaactgtgtttaccgaccacagcctgtttgggttcgccgatgtctcttctgttctgactaacaagctgttaactgtgagcctctgcgacactaatcacatcatatgtgtctcttatacctcaaaagaaaacactgttctgagggccgcgcttaaccctgagattgtgtccgtcatccccaacgctgtcgaccctaccgacttcacgccggatccttttcggaggcacgattcaatcaccatagtcgtggtctctcgtctggtgtataggaaagggatcgacctcctcagcggaattatacccgagttgtgtcagaagtatcccgatcttaattttatcattggaggcgaaggtcctaagcgcataatcctggaagaggtgcgtgaaagataccagttacacgatcgggttcggctgctgggcgccctggagcacaaggacgtgcgcaacgttttggttcagggacacatcttccttaacacatcactgactgaggccttctgcatggctatcgtggaagccgcgtcctgcggactccaggtcgtaagcaccagagtgggcggcattcctgaggtgctgcctgagaacctgatcattctgtgcgagcccagtgtgaaaagtctgtgtgaaggactggagaaggccattttccagctcaagtcgggaaccctacccgcccccgagaacatacataacatcgtgaaaaccttttacacctggcggaacgtggccgagcgtactgagaaagtctacgatcgcgtgtcagtggaggctgtcttgcccatggataagcgactggaccgcctgatctcgcactgcggacccgtcacaggatacatcttcgctttattggccgtatttaactttctgttcctgatattcctgagatggatgacacctgactctatcattgatgtggctatcgatgccaccggaccacggggagcctggactaacaattactcccattctaagcggggcggcgagaacaacgaaatttctgagacccgg

SEQ ID NO: 250768 - DNA, 1452 bp, Artificial Sequence
  Description of Artificial Sequence: Synthetic coding sequence
atggcctgccgcgggggagctggcaacgggcacagagcatccgctactctgtcacgggtgtcaccgggatccctgtacacttgccgtacccgtactcacaacatctgtatggtgtccgatttcttctatccgaatatgggaggagtcgaatcgcacatatatcagctcagccagtgtttgatcgaacgaggccataaagtgatcatcgtcacccacgcctacggcaaccggaagggaatacgatacctcacttcaggacttaaggtgtactatctgccgctcaaagttatgtacaaccaatccaccgcaacgaccttgttccattcgctcccgctgcttcggtacatattcgtccgggaacgcgtgactatcattcacagccattcgtcgttctcggccatggcgcatgatgcgttgtttcacgccaagacgatgggcctgcaaactgtgttcaccgaccattcgctttttggatttgcggatgtgtcctctgtgctcactaacaagctgctcaccgtgagtctgtgtgacactaatcatatcatctgcgtgagctacacttccaaggagaacaccgtgctccgggccgcgctgaacccagaaatcgtgtccgtcatcccgaacgcggttgacccgacggatttcaccccagacccattccggcggcatgacagcattaccatcgtggtggtatcgcggcttgtgtaccgcaagggaatagatctgctgtctggcattatcccggaactttgccagaagtaccccgatctgaatttcatcatcgggggagagggacctaaaagaatcatcctggaggaggtgcgggagaggtaccagcttcacgatcgggtccggcttctcggcgctctggagcacaaagatgtgcgcaacgttctggtgcagggacacatctttctcaatacctcactcactgaggccttctgtatggcaatcgtcgaagctgcaagctgcggtttgcaggtggtgagcacccgcgtgggagggattccagaggtcctgccggagaacctgattatcctgtgcgagccttctgtgaagtcgctctgcgaaggccttgagaaggcgatttttcaacttaagtcaggcaccctgcctgcccccgagaacatccacaatatcgtgaaaacgttctacacctggcgcaacgtcgctgaaaggacggaaaaagtctacgacagagtgtcagtggaagcggtcctgccaatggacaagcggctggacagattgatttcccactgcggacccgtgacggggtacattttcgcgctgctggccgtgtttaacttcctgtttctcatcttcctgaggtggatgacgccggactccatcatcgacgtggcaatcgacgccaccggccctagaggagcctggactaataactactcacactcgaagcggggtggagagaataacgaaatctcagaaacccgg

SEQ ID NO: 250769 - DNA, 1452 bp, Artificial Sequence
  Description of Artificial Sequence: Synthetic coding sequence
atggcgtgtagagggggggccggcaatggccaccgggctagtgccacgctgtctcgtgtgtcccccggcagtctctacacatgccgcacgaggacgcataacatctgcatggtgtcggactttttttaccctaatatgggaggagttgagagccatatttaccagctttctcagtgtttgatcgaacgcgggcacaaggttatcatagtgacgcacgcgtacggcaatcgcaagggtattcgctatctgacgagtggtctcaaggtatactacttgccgttaaaggtgatgtacaatcagtccacagccaccaccctgttccattccttgccgttgctgaggtacatctttgtaagggagagggtgactattatccactcacattcctccttttcagccatggcacatgacgcattgtttcatgctaagaccatgggtctgcagacagtctttactgatcattctctgtttggcttcgcggacgtcagttccgttctgactaacaagctgctgacagttagcctgtgcgataccaatcacattatctgcgtgtcttatacttctaaggaaaatacagtactacgagccgccctaaatcctgaaatcgtttctgtgattcctaatgctgtcgacccaactgatttcacccccgatcccttcagaaggcacgattctattaccatagtcgttgtctcccggcttgtctacagaaagggcattgacctgctgagcggtattattcctgagctgtgtcaaaagtacccagacctgaactttattatcggcggcgagggaccaaagcggatcatcttagaggaagtgcgtgagaggtaccagcttcacgaccgggtgagactgctgggcgccttggagcataaggacgtccgtaatgtgcttgttcaagggcacatcttcctgaacacctcattaacggaggccttctgtatggctatcgttgaggccgcatcctgtggcttgcaggtggtctcaaccagggtggggggtatccccgaggttctccccgagaatctgattatactgtgtgagccgtccgtcaaatctctgtgcgaaggactggagaaggctatttttcaactgaagagcggaaccttaccagcacccgaaaatatccacaatatagtgaaaacattctacacctggcggaacgtggctgagaggaccgagaaggtgtacgaccgcgtctcggtcgaggccgttttgccgatggacaagagactggatcgcctgatcagccactgcggacctgtgacagggtatattttcgctctcctggccgtgttcaattttctttttctgatcttcctgcggtggatgacccccgacagtatcatagatgtggctattgacgccactggcccccgaggggcctggacaaacaactatagtcatagtaaaagaggcggggagaataacgaaatcagcgaaacacgc

SEQ ID NO: 250770 - DNA, 1452 bp, Artificial Sequence
  Description of Artificial Sequence: Synthetic coding sequence
atggcgtgccgcggcggcgccggtaacggtcacagagctagcgccactctgtcacgggtgtccccgggctccctgtacacttgccggactagaacccacaacatctgtatggtgtcggactttttctaccctaatatggggggtgtcgagtcccacatataccagctgagccaatgcctcatcgaaagagggcacaaagtcatcattgtgactcatgcctatggcaataggaagggaatccggtacttgacttcgggactcaaggtgtactaccttcctctcaaagtgatgtacaaccagtccaccgcgactaccctgtttcatagcctgccgctcctccgctacatcttcgtgcgcgaacgtgttactatcatccactcgcactcgagcttctccgccatggcgcacgacgcactgtttcacgccaagactatggggctgcagactgtgtttacggaccacagcctgttcggcttcgccgatgtctcgtctgtcctgaccaataagctgctgaccgtgtcactgtgtgacaccaaccacatcatctgcgtctcctacacttccaaggaaaacaccgtgctgcgcgccgctctcaatccagagatcgtgtctgtgatcccaaacgccgtggatccaacggatttcaccccggacccgttcagacgtcacgactccatcacgattgtggtagtctcccggctcgtgtatcggaaaggaatcgacctgcttagcggaatcatcccggagctgtgccagaaatacccggatctcaatttcatcatcggcggcgagggaccaaaacgcatcattctggaggaggtgcgcgaacggtaccaacttcatgaccgggtgcggctgcttggagctctcgaacacaaggacgtcagaaatgtcctcgtccaaggacacatcttccttaacacttcgctcaccgaggctttttgcatggccatcgtggaagcagcgagctgtggcctccaggtggtgtcaaccagagtgggcggaatcccggaggtgctgcccgagaatctgattatcctctgcgaaccgtccgtgaagtccctctgcgaggggctcgagaaggccatctttcagttgaagagcggcaccctcccggccccagagaatatacacaatatcgtgaaaaccttttacacctggagaaatgtggcggagcgcaccgaaaaagtgtacgaccgcgtgtccgtggaggcagttttgcccatggacaagagactggaccgattgatctcacactgcggaccagtgactggatacatcttcgccctcctggctgtgtttaacttccttttcctcatctttctgcgctggatgacccccgactcgatcatcgatgtggctatcgatgcgactggccccaggggagcctggaccaacaattacagccactctaaacggggaggagagaataacgagatttcggaaaccaga

SEQ ID NO: 250771 - DNA, 1452 bp, Artificial Sequence
  Description of Artificial Sequence: Synthetic coding sequence
atggcctgtaggggcggcgctggcaacggtcatcgggcgtcagcgacattgtcccgcgtctcaccaggatccctgtatacttgcaggacccggacccataacatctgcatggtgtcagacttcttctacccaaacatgggaggtgtcgagtctcacatctaccagctcagtcagtgcctgatcgagcgaggacataaggttatcattgtgacacatgcatatggcaaccggaaaggaatccgctacctgaccagtggtctgaaagtgtactacttgcccctgaaggttatgtacaatcagtcaacagctactacgctgttccacagtctgccgttactacggtatattttcgtacgagagagggtgacaatcattcactctcactcaagcttcagtgctatggctcatgacgcacttttccatgcgaagacgatgggactgcaaacggtctttactgatcactccctattcggatttgcagatgtatcatcagttctcaccaataaattgctgaccgttagcttatgcgacaccaaccacatcatctgtgtatcttacactagcaaagaaaataccgtgctccgggcagcacttaacccggagatcgtatctgtaatcccgaacgctgtcgacccaactgatttcacaccagaccctttcaggaggcatgattcaatcaccatcgtcgtcgtgtccagactcgtgtatcggaaaggcatagacttgctgtctggcattatccccgagctgtgtcagaagtaccctgatctgaactttataatcgggggcgaaggtcctaaacgcataatcctggaggaagtgcgggagcgctatcagctgcacgacagagtgcggctgctcggagcactcgaacacaaggatgtccggaatgtccttgtccaggggcacatctttctgaatacttctctaaccgaggccttctgtatggctatcgtggaagccgccagctgcggccttcaggttgtatcgactcgagtgggtggcattccggaggttctgcccgaaaatttgattatcctctgtgagccctcagtgaaatctctctgtgagggactggagaaagccattttccaactgaaatccggcacactcccagcaccagagaatatacataacattgtcaagaccttctacacatggcggaacgtggcggaacgcacagagaaggtgtacgacagggtgagtgtggaggccgttctccccatggacaagcggctggatcgcctcatcagccactgtgggccggtgacgggttatatctttgccctccttgcagtgttcaacttcttgttcctgatctttctcagatggatgacaccagactccattattgatgtggcaattgatgccacagggccacgaggcgcttggaccaacaattattcgcattccaagcgaggcggtgagaacaacgagatatctgaaacccgc

SEQ ID NO: 250772 - DNA, 1452 bp, Artificial Sequence
  Description of Artificial Sequence: Synthetic coding sequence
atggcatgtagaggaggagcaggaaatggacatagagctagtgctactctttctagggtatctccaggaagtttatatacatgtcgaactagaactcataatatttgtatggtttcagacttcttctatcctaatatgggaggagttgaaagtcatatttatcaattgtcccagtgtctcattgaaagaggacataaggtaattattgttactcatgcatatggtaatagaaagggtattagatatttaacatcaggacttaaagtttattatttaccattaaaagttatgtataatcaatcaacagcaacaactttattccattcacttccactattaagatatatctttgttagagaaagagttacgataattcattctcatagtagttttagtgctatggcacatgatgctctttttcatgctaagactatgggattacaaactgtctttacagatcattcattatttggttttgctgatgtttcttccgttttaactaataagttattaacagttagtttatgcgacactaatcatataatttgtgtttcttacacttctaaagaaaacacagtacttagggcagcacttaatccagaaattgtatctgttattcctaatgcagtagatccaacagattttactccagatccatttaggagacacgatagtattacaattgttgttgtttcacgtttagtttatcgtaaaggtattgatttattaagtggtattataccagagctttgtcaaaaataccctgatttaaattttattattggaggagaaggacctaaacgaattatattagaagaagtaagagaacgatatcaattacatgatagagttaggcttcttggtgctcttgaacataaggatgtacgtaatgttttagtgcagggtcatattttcttaaatacatctttaacagaagctttttgcatggctatcgtggaagctgcaagttgtggtttacaagttgtatcaactagagttggtggtattcctgaagtactccctgaaaacctcattattttatgtgaaccaagtgttaaatcattgtgtgaaggacttgaaaaagcaatcttccaattaaaatcagggactttaccagcacctgaaaatattcataacatcgttaaaactttctatacatggcgaaatgttgctgaaagaactgaaaaagtttatgatagggtttctgttgaagcagttttaccaatggataaaagattagatcgattaatttcacattgtggtccagttacaggatacatttttgcattattggcagtttttaattttttatttttgatttttttaagatggatgactcctgattcaattatcgatgtagcaattgacgcaactggaccacgaggagcatggactaataattattctcattctaaaagaggaggagaaaataatgaaatttccgaaacaaga

SEQ ID NO: 250773 - DNA, 1452 bp, Artificial Sequence
  Description of Artificial Sequence: Synthetic coding sequence
atggcctgccgcggcggcgccggcaacggacacagagcctctgccacactgagccgagtgagcccgggaagcctctacacttgtcgcactcgcacccacaacatctgcatggtgtccgattttttctaccccaacatggggggtgtcgaaagccatatataccagctgagtcagtgcctgatcgaacgtggccataaggtaatcatagtcacccatgcctacggaaaccgcaaaggcattaggtacctgacgtccggtttaaaggtgtactatctgcccctgaaggtcatgtataatcagagcactgctaccacgctctttcacagtctaccattgctgcgttacatctttgtgcgagaaagggtcaccataattcattcgcactccagtttctccgctatggcccacgatgcgctatttcacgcaaagactatgggcttgcagacagtgtttaccgatcattccctgttcggattcgccgacgtgagcagcgtgctgacaaacaagctgctgactgtttccctatgcgatacgaatcacataatttgtgtgagctacacgtcaaaagagaatacggtactccgggccgccctgaatccagaaatcgtctcggttatacccaacgctgttgaccctaccgatttcacccccgaccccttccgccgccatgactccataacgattgtggtggtaagtcgcctggtgtatcggaagggtattgacctgctgagcgggatcatccctgaactgtgtcagaagtaccccgatttgaatttcatcatcggcggcgaaggtccgaagagaattattttggaagaggtacgagagcgatatcagctacacgaccgcgtgcgactgctgggtgcgctcgagcacaaggacgtccgcaacgttctcgtgcaggggcatatctttttgaatacctcacttacggaggcattttgcatggctatcgtggaggcggcctcctgtggtctgcaggtggtgagcaccagagtcggaggtatccctgaggtgcttccggagaacctcattatcttgtgcgaaccgagcgtcaagtcactgtgcgaaggactcgagaaggcaatattccaactcaagagcggaaccctcccagcgcccgagaatatacacaatatcgtgaaaacattctatacgtggcgtaatgtggcggaacgcaccgaaaaggtttacgatcgcgtcagcgtcgaggccgtgctcccgatggacaagcgccttgaccgtctgatatcacactgtgggccagtgacgggctatattttcgccctcttagcggtcttcaactttctgtttctgatttttttgcgctggatgaccccggacagcatcatcgatgttgcgatagacgctacaggcccgcgtggggcctggaccaataattactcacactctaagcgcggcggtgagaacaacgagatttccgagacgaga

SEQ ID NO: 250774 - DNA, 1452 bp, Artificial Sequence
  Description of Artificial Sequence: Synthetic coding sequence
atggcatgtcgcggcggcgccggcaacggacacagagcctcggcaactctcagccgagtctcacctggatccctgtacacttgcagaactcgaactcacaacatttgcatggtgtccgatttcttttatcctaatatgggaggggttgaatcccatatctaccaactgtcgcaatgcctgatcgaacgaggacacaaagtgatcatcgttacccacgcgtacggaaaccgaaaaggcatccggtacttgaccagtggactgaaggtgtactaccttccactcaaggtgatgtacaatcagagcactgctacgactctttttcactcgctccccctcctgcggtacatcttcgtcagggagcgcgtgaccataatccattcccatagttccttctctgccatggcacatgatgcactcttccacgctaagaccatgggacttcagactgttttcactgaccactcgctctttggctttgccgatgtgtccagcgtcctgacgaacaagctgctgaccgtctcactttgcgataccaatcacataatctgcgtctcgtacacttcaaaggagaacactgtactgcgcgctgcgctcaacccagaaatcgtgtcggtcatcccgaatgccgtcgacccgaccgatttcaccccggacccgttcaggcgacatgactctatcaccatcgtcgttgtgtcgagactggtgtaccgcaagggaatcgacctcctgtccggaatcattcctgaactgtgccagaagtacccggatttgaatttcatcataggaggggaaggtcctaagagaattatccttgaagaagtccgggaacgctaccagttgcatgatcgggtgcgcctcctgggagccctggagcataaggacgtgcggaacgtgctggtgcagggccacatcttcctgaatacttcactcacggaggctttctgcatggcgatcgtggaagccgcgtcatgtggtctgcaggtcgtctcgactagggtgggaggtatccccgaagtgctcccagagaatctcatcatcctgtgcgaaccgtcagtgaaatccctgtgtgaggggctggaaaaggccattttccaactcaagagcgggactctcccggcgcccgagaacatccacaacatcgtgaaaaccttctatacctggaggaatgtggctgaacgcactgaaaaagtgtacgaccgcgtaagcgtggaggcggttcttcctatggacaagagacttgatcggctgatctcccactgcggaccggtgaccggatacatttttgccctcctggccgtgttcaactttttgttcctgatcttcctgcgttggatgaccccagacagcatcatcgacgtggcgattgacgctactggcccgcggggagcctggacgaataactacagtcatagcaaacgcggaggcgaaaacaacgagatctcagagactaga

SEQ ID NO: 250775 - DNA, 1452 bp, Artificial Sequence
  Description of Artificial Sequence: Synthetic coding sequence
atggcttgtagaggaggcgccgggaatgggcaccgggcctctgccaccttgagtcgcgtgagtcctggttccctgtatacttgcagaacccggacccataacatatgtatggtgtccgactttttctatccaaacatgggaggagtggaatctcacatctaccaactttcgcaatgcctgattgagcggggacacaaagtgattatagttacccacgcgtacggaaatcgtaaaggaatccgctacctgacatctggccttaaggtatattacctaccccttaaggtcatgtataaccagtccactgcaacaacgttatttcatagtctccccctgcttcgctacatttttgtgcgcgagcgtgttaccattatccactctcactcctcttttagcgccatggcccacgacgcactgtttcacgctaaaacgatggggctccaaactgtttttacggaccatagcctttttggattcgctgatgtgtcgtccgtgctgacaaataagttgttgacagtcagcttgtgtgacacgaaccacataatctgtgtgagctacactagtaaggagaacaccgtcttacgcgccgccctgaatcctgaaatcgtctccgtcatccctaacgccgttgatcctacagactttacgcccgatccgttccggcgacatgactccattacaatcgtcgtcgtgagccggctggtctatcgaaaaggtattgacctactgtcaggcattatcccagaactgtgtcagaaatatccagatctcaactttatcatcggtggtgaaggccctaagaggatcatactcgaagaggttagagagaggtatcagctccatgaccgagtgagactcctaggcgcactcgaacacaaggatgtgcggaacgtgctggtgcagggccacatcttcttgaacaccagtctaacagaggctttttgcatggccatcgtcgaggcagcatcgtgcgggttgcaagttgtgtctactagggtgggcggaatccccgaggtgctccccgaaaacctaatcatcctgtgtgaaccgagtgtaaaatctttgtgcgaggggcttgagaaggccatcttccaactgaagagtggtaccctgcccgctcctgagaacattcacaacattgtgaagactttctacacttggagaaatgtagctgaacgaactgaaaaggtgtacgaccgcgtatcggtggaggccgtgctgcccatggataagaggctagataggctcatatcacattgtggacccgttacgggatacatttttgcactcttggccgtgtttaactttctctttctgatctttctgcggtggatgactcccgatagtattatagatgttgctattgatgctactggccctagaggggcctggaccaacaattacagccattcaaagcggggcggcgaaaataatgagatttccgaaaccaga

SEQ ID NO: 250776 - DNA, 1452 bp, Artificial Sequence
  Description of Artificial Sequence: Synthetic coding sequence
atggcttgcagaggtggagctggaaatggccacagggcctctgcaacccttagcagagtgtcccctggatccctttacacttgtagaactcgcactcacaacatttgcatggtgtcggactttttctaccccaacatgggcggtgtcgaatcccatatctatcaactttcacaatgtcttattgaacgcggtcataaagtcattattgtgactcatgcatacgggaacagaaagggaattagataccttacctcaggactcaaagtgtactacctccctctgaaggtcatgtacaatcagtccaccgcaaccacgctttttcattcgctcccacttcttaggtacatctttgtccgcgagagggtcacgatcatccactcccattccagcttctccgcaatggcgcacgacgccctctttcacgcaaagacgatgggacttcagacggtgttcaccgaccactccctcttcggttttgccgatgtgtcgtccgtgctgactaacaaacttcttaccgtgtcgctgtgcgatactaaccacataatctgtgtgtcatacacctcaaaggaaaacactgtgctgcgggcggcactgaaccccgaaattgtctcggtcatcccaaatgcagtggaccctactgatttcactccagatccattccgtcgacatgattcgatcactatcgtcgtggtttcgagactggtgtaccgcaaggggatcgatcttctgtcgggaatcattcctgagctgtgccaaaagtacccagatctcaactttatcattggcggcgaaggtccaaagagaatcatactcgaagaagtgagagaacggtaccaattgcacgatagagtgagacttctgggggcactcgaacataaggacgtccgtaacgtcttggtgcaaggacacatctttctcaacacctcccttactgaagccttctgtatggcaattgtcgaggcggcgtcgtgcggtctgcaggtggtgtccactagagtgggcgggattcctgaagtcctgcctgagaacctgatcatcctctgcgagccaagcgtcaagtcgctttgcgaaggtcttgagaaagcaatattccaactgaaatcaggaacccttcccgcccccgagaatatacacaacattgtcaagaccttttacacttggaggaatgtcgccgaaagaactgaaaaggtgtacgatagagtgtcggtggaagcagtgcttcctatggataaaagattggatcgacttatatcccattgtggtccagtgaccggatacatctttgcccttcttgcggtgttcaatttcctgttcttgattttccttagatggatgacgcctgattcgattatcgatgtggcaatcgatgcaactggaccgaggggagcctggactaacaattacagccattcaaagcgtggaggagaaaacaacgaaatcagcgagactaga

SEQ ID NO: 250777 - DNA, 1452 bp, Artificial Sequence
  Description of Artificial Sequence: Synthetic coding sequence
atggcctgccgggggggcgcaggaaacggacacagagcttccgctaccctttccagggtaagccctggctcactttacacttgtcgcacgcggacccacaatatctgcatggtctccgatttcttttacccaaacatggggggagtggagtcacacatctaccaactgagccagtgcctgattgaaaggggccacaaggtgatcatagtcacacatgcctacgggaatcgcaaaggaatacgctatctcaccagcggccttaaggtgtattatctgccactgaaagtgatgtataaccaatccacagctaccacactctttcactccttgccattgctcaggtacatcttcgttagagaaagagttacgatcatccacagtcactctagcttcagcgcgatggcgcatgatgccttgttccacgcgaagacgatgggtctgcaaacagtctttaccgaccacagcctgttcggcttcgcggacgtttcctccgtgttgacaaacaagttgctgactgtgtccctgtgcgacactaaccatatcatttgtgtcagctatacgtccaaggaaaataccgtgctcagggccgccctcaatccagaaattgtgtctgttattcccaacgctgtcgatcccaccgactttacacctgatccttttagacggcacgactcaattacaattgtggttgtgtctcgcttggtctatcggaaaggaatcgacttgctgtcaggcataatcccagagctgtgccagaagtatccggatttgaactttatcatcggcggggagggaccgaagcgaatcatccttgaagaggtgcgagagcggtatcagctccatgacagggtgaggctgctgggggccctcgaacacaaggacgtgagaaacgttctcgtgcagggtcatatcttcctgaataccagcctgactgaagcattctgtatggctattgtggaggcagcctcatgtggccttcaagtcgtatctactcgggttgggggaatacccgaagtgttgcccgagaacctgatcatactctgtgagccttccgttaaaagtctgtgtgagggacttgaaaaagccatctttcagctgaagagcggtactttgcctgcgcccgagaacatacacaacatagtcaagacgttttatacctggaggaatgtcgcggaaaggactgaaaaggtttatgatagagtgtccgtggaggcagtgctgcctatggataagagactggacaggcttatttctcactgtgggcccgtgactggctatattttcgcgctgctggcagtctttaattttctcttcctgatctttctgcgctggatgacaccggactccatcatcgatgtggcaatcgacgcaaccggccctcggggcgcttggactaacaattacagccactcaaagcgcggtggggagaacaatgagatatcagaaacacgc

SEQ ID NO: 250778 - DNA, 1452 bp, Artificial Sequence
  Description of Artificial Sequence: Synthetic coding sequence
atggcgtgtcgtggtggtgcgggtaatggtcatcgtgcgtcggcgacgctatcgcgtgtttcgccgggttcgttatatacgtgtcgaacgcgtacgcataatatatgtatggtatcggattttttttatccgaatatgggtggtgttgaatcgcatatatatcaactatcgcaatgtttaatagaacgaggtcataaagtaataatagtaacgcatgcgtatggtaatcgaaaaggtatacgttatttaacgtcgggtttaaaagtatattatctaccgttaaaagtaatgtataatcaatcgacggcgacgacgctatttcattcgttaccgctattacgatatatatttgtacgagaacgtgtaacgataatacattcgcattcgtcgttttcggcgatggcgcatgatgcgctatttcatgcgaaaacgatgggtctacaaacggtttttacggatcattcgttatttggttttgcggatgtatcgtcggtactaacgaataaattattaacggtttcgctatgtgatacgaatcatataatatgtgtatcgtatacgtcgaaagaaaatacggtactacgtgcggcgttaaatccggaaatagtttcggtaataccgaatgcggttgatccgacggattttacgccggatccgtttcgtcgacatgattcgataacgatagtagtagtatcgcgactagtttatcgtaaaggtatagatttactatcgggtataataccggaattatgtcaaaaatatccggatctaaattttataataggtggtgaaggtccgaaacgtataatactagaagaagttcgtgaacgatatcaattacatgatcgtgtacgactactaggtgcgttagaacataaagatgttcgtaatgttttagttcaaggtcatatatttctaaatacgtcgctaacggaagcgttttgtatggcgatagttgaagcggcgtcgtgtggtttacaagtagtatcgacgcgagtaggtggtataccggaagtattaccggaaaatctaataatattatgtgaaccgtcggttaaatcgttatgtgaaggtttagaaaaagcgatatttcaattaaaatcgggtacgttaccggcgccggaaaatatacataatatagttaaaacgttttatacgtggcgaaatgttgcggaacgaacggaaaaagtatatgatcgtgtttcggtagaagcggtattaccgatggataaacgattagatcgattaatatcgcattgtggtccggtaacgggttatatatttgcgttattagcggtatttaattttctatttttaatatttctacgttggatgacgccggattcgataatagatgtagcgatagatgcgacgggtccgcgtggtgcgtggacgaataattattcgcattcgaaacgaggtggtgaaaataatgaaatatcggaaacgcga

SEQ ID NO: 250779 - DNA, 1452 bp, Artificial Sequence
  Description of Artificial Sequence: Synthetic coding sequence
atggcgtgcaggggtggagccggaaacggacacagagccagcgcaactttgtcaagggtgagcccggggagcttgtacacttgtcgaactcggacccataacatttgtatggtatccgacttcttctacccgaacatggggggagtcgaatcccacatttaccagctctcgcaatgcctgattgagagagggcataaggtgatcatcgtgacccatgcctacggaaaccgcaagggaataaggtatctgacttcgggactcaaggtgtactaccttccgcttaaggtgatgtacaatcaatccaccgcaacgactttgttccactcgctgccactgctgcgctacatctttgtgcgcgaaagggtcaccatcatccactcgcacagttctttttcggccatggcacacgacgccctgtttcacgcaaagactatgggactgcagactgtgtttactgatcattcgctcttcggtttcgcagatgtctcatcggttctcaccaacaagctgctgaccgtgagcctgtgcgacaccaatcacatcatctgtgtgtcatacacgtcaaaagaaaacaccgtgctgcgggcggccctgaatccggaaatcgtgtcggtgatcccgaatgcagtggatccgactgatttcacgccagacccatttcggagacatgactccatcaccattgtggtcgtctcacgccttgtgtaccggaagggaatcgacttgctctccggtatcattccggagctgtgtcaaaagtatccagaccttaacttcatcatcggaggagagggaccgaagcggatcatcttggaagaagtcagagagcgctatcaactccatgaccgggtgcgcctcctgggcgcccttgagcacaaggacgtgaggaacgtgctggtgcagggacatatcttcctcaacacgtcgttgaccgaagccttctgcatggccatcgtggaggctgcgtcctgcggccttcaggtggtcagtactagagttggagggatcccagaggttctgcccgagaatcttatcattctgtgcgaaccatctgtgaagtccctctgcgaaggactcgagaaggccattttccaactgaagagcggtaccctgccggcgccagaaaacatccacaatatcgtgaaaaccttctacacgtggagaaatgttgccgagcgaactgaaaaggtgtacgatcgggtcagcgtcgaggcggtgctgcccatggataaacggctggaccggcttatttcacattgtggtccggtgaccggatacatttttgcactcctggcggtgtttaacttcctgtttctcatcttcctgcgctggatgaccccggactcaatcattgatgtggctatcgacgcgacgggaccgcggggagcctggactaataactactcacacagcaaaagaggcggagagaacaatgagatctcagaaacgcgc

SEQ ID NO: 250780 - DNA, 1452 bp, Artificial Sequence
  Description of Artificial Sequence: Synthetic coding sequence
atggcatgtcgtgggggtgcagggaacggccacagggcttctgctaccttatctagagtgagtccagggtcactgtacacatgccggacgcgaacccacaacatttgcatggtctcagacttcttctatccaaatatgggcggcgtggaatcgcacatctaccagttgtcgcaatgcctgatcgagcgtggacataaagttatcatcgtcacccatgcttatggaaatagaaagggtatccgttacctaactagtggcttgaaagtgtactatttacccctgaaggtgatgtataaccagtccacagccacgactctttttcacagcctgccccttctgcggtatatcttcgtgagggagcgggttactattatccatagccatagtagtttctctgccatggcgcacgacgcactcttccacgccaaaacgatgggtttacagactgttttcaccgaccattctctgtttggattcgcagatgtttccagcgtcctgaccaataagctgcttacagtctctctttgtgatactaaccatattatctgtgtgagctacacctccaaagagaatacagtgctgcgcgctgcacttaatccagaaatagtctcggtgatccctaacgctgttgacccaaccgattttacccctgaccctttccgccgccacgattcaatcactatagtcgtggtaagtagactcgtatatagaaagggtattgacctgctcagcggtatcataccagaactgtgtcagaaatatccagatttgaacttcatcatcgggggggaagggccgaagagaataattctggaggaagtgagagaacgatatcaacttcacgacagggtacgtctgctcggtgccctggagcacaaggatgtgaggaacgtactagtgcagggccacatcttccttaacacctccctaactgaggccttctgtatggctatcgtggaagccgcctcttgcggattacaggtcgtctctacaagagtgggggggattcctgaggtcttacctgagaatttgatcatcctgtgtgagccaagcgtcaagtctttatgcgaaggtctcgagaaggctatcttccagctgaaaagtggaacactacctgccccagaaaacatccataatatcgtaaaaactttctacacctggcgcaatgtggccgagaggaccgagaaagtttatgacagagtgagtgtagaggctgtgctacccatggacaagagattggaccggctaatcagccattgtggaccagtaaccggatacatcttcgctctgctcgcagtgtttaatttccttttcctgatttttcttaggtggatgacccctgattccataattgacgtcgcgatagacgccaccgggccgcgcggcgcatggaccaacaactattcacacagcaaacgtggcggcgaaaataatgagatcagtgaaaccagg

SEQ ID NO: 250781 - DNA, 1452 bp, Artificial Sequence
  Description of Artificial Sequence: Synthetic coding sequence
atggcgtgtagagggggtgccggtaatggacacagggcatcagccactctgtcacgggtgtcccctggttcgctgtacacctgtagaacccggacgcacaatatctgtatggtgtcggatttcttctacccaaacatggggggtgtcgagtctcatatctaccaactcagccaatgtctgatcgagagaggacacaaggtgattatcgtgactcatgcttacggaaaccggaagggaatacgttacctgactagcggtctgaaggtgtactacctgcccctgaaggtcatgtacaatcaatcgaccgcaactaccctgtttcactcgctgccactgttgaggtacatcttcgtgcgtgaaagggttaccattatacattcacattcctcattttcagctatggcacatgatgcactctttcatgcaaagactatgggcctgcaaaccgttttcactgaccattccctttttggatttgccgacgtttcgagcgtgctgactaataagctcctcaccgttagcctctgtgacaccaaccacatcatttgtgtctcgtacacttctaaagaaaataccgtgctccgtgcggctttgaaccctgaaattgtgtccgtgattccgaatgctgtggaccccaccgacttcaccccagatccttttcggcgccatgattctatcaccatagtagtggtgtccagacttgtctacagaaagggtattgacttgctgagcggaatcatccctgaactttgtcagaagtaccctgatctgaactttatcattggaggagagggaccaaagcggattattcttgaagaagtgcgcgagaggtaccaacttcatgacagggtgaggttgcttggcgcccttgagcataaggatgtgcgcaacgtccttgtgcagggccacatctttctcaacaccagcctgaccgaagcattttgtatggcaattgtcgaggctgcatcgtgcggactgcaggtcgtgtcgacgagagtggggggtatccccgaagtgcttccagagaaccttatcatcctttgtgaaccctcagtcaagtccctttgtgaaggtcttgaaaaagcaatcttccagcttaagtccggaacgcttcctgccccggagaacattcataacattgtcaagacgttttacacctggagaaatgtggcagaaaggactgaaaaggtgtacgatcgggtcagcgtcgaagctgtgctgcccatggataagagactcgacagactgattagccactgtggcccagtgaccggatatatctttgccctccttgccgtgtttaactttcttttcctgatattccttcggtggatgaccccagattctattatcgacgtggccatcgatgcaactgggccacgcggagcatggacgaataactattcccacagcaagaggggtggggagaataacgaaatctccgaaaccaga

SEQ ID NO: 250782 - DNA, 1452 bp, Artificial Sequence
  Description of Artificial Sequence: Synthetic coding sequence
atggcctgccgaggaggcgctggcaatggccatcgggcctccgctactctctctcgggtcagtcccggcagcctttacacatgccgcacccggacccataacatctgtatggtcagcgactttttctaccccaacatggggggagtcgagagccacatctaccagctgtcccagtgtcttatcgaaaggggccacaaagtgataattgtgacccatgcatatggaaatcggaaagggatccgctacctgacctccgggctgaaagtttactatctgccactgaaagtcatgtacaatcagtctacagctacaaccctgtttcactccctccctctcttgcgctatatcttcgtgcgcgaacgtgtcacaatcatacattcccactccagtttttcagccatggcacacgatgcccttttccacgccaaaactatgggactgcagacagtgtttacagaccacagcctcttcggattcgccgacgtgagcagtgtgctgaccaacaagctcctcacggtttcactctgtgatacaaaccatataatttgcgtatcctacactagcaaagaaaatacagtgctgcgtgccgccctcaaccctgagatcgtttctgttatcccaaatgcagtggaccccacggactttaccccggatcctttccgccgccacgattccattaccattgtggtggtatctcgcctggtctatagaaagggaatcgacctgctctccggaatcattcccgagctatgccagaagtatcctgaccttaacttcatcattggtggagaaggaccaaagcgcattattctagaagaagtccgagagaggtatcagctgcacgatcgagttcgactcctgggagctttggagcacaaggacgttaggaacgtgttggtgcaaggccacattttcctgaatacctctctgacggaggctttctgcatggcgattgttgaagccgcctcatgcggcctccaagtagtcagcaccagggtgggaggcataccagaagtgcttccggaaaatctgattatcctttgcgaaccgtccgtgaagtcgctatgtgagggactagaaaaagcaattttccagctgaagagcggaactctgcctgcccctgagaacattcacaacatcgtcaaaaccttctacacctggcgcaacgtggccgaacgcactgagaaagtgtatgacagggtatctgtggaagccgtgctgccaatggataaacggctcgataggcttatcagccattgcgggccagtgacaggatacatcttcgctcttctggccgtatttaactttctctttcttattttcctccggtggatgacacctgactctataattgacgtcgcgattgatgcaaccggaccaaggggcgcctggactaacaactactcccacagtaaaaggggcggggagaataacgagatcagcgagactcgt

SEQ ID NO: 250783 - DNA, 1452 bp, Artificial Sequence
  Description of Artificial Sequence: Synthetic coding sequence
atggcctgtagagggggagcgggaaacggtcatcgcgcatccgcaactctttccagggtgtcccctggctcgctgtacacctgtaggactcgcactcataacatatgtatggtcagcgatttcttctacccaaacatgggtggtgtggaatcgcacatttaccaactttcacaatgtttgattgaacggggtcataaagtgattattgtgacccacgcatacggcaaccgcaagggtatccgttacctcacctccggtcttaaggtgtactaccttccactgaaggtgatgtataatcaatctaccgcaacgacccttttccattccctgcctctcttgagatacatctttgtcagagaaagagtgacgattattcactcccacagctccttttccgcaatggctcacgacgcactcttccacgctaagaccatggggcttcaaactgtgttcactgaccactcgctgtttggctttgcagatgtgtcaagcgtgctgaccaacaagctccttactgtgtcactgtgcgataccaatcacattatctgcgtgtcgtatacttcaaaggagaatactgtgcttcgagcggcgctgaatccagagatcgtctcagtgattccgaatgccgtggatcctaccgatttcactcccgaccctttccgcaggcatgattcgattaccatcgtggtcgtgtcgagacttgtgtacagaaagggtatcgatcttctctcggggataattcccgagttgtgccagaagtacccagatctgaatttcataatcggaggcgaaggccccaagagaattatcctggaggaagtgcgggagcgctaccaactccatgatagagtccgactgcttggagcgttggagcacaaggatgtgagaaacgtgcttgtgcagggacacatttttctgaacacgtcactgaccgaagccttctgcatggcaattgtcgaagcagcatcatgtggacttcaagttgtgagcacccgtgtcggaggtatccctgaagtcctgcctgaaaacttgatcattttgtgtgagccttccgttaaatcgctctgtgaaggactggagaaggcaatctttcaacttaaatccggaactctgcctgcccccgaaaacatccataacattgtcaaaaccttttacacctggagaaacgtcgccgaacgcaccgagaaggtgtacgacagggtgtctgtggaagccgtgcttccaatggacaaaaggctggacaggctgattagccactgcggacctgtgacgggttacatctttgcccttcttgcagtgtttaactttctgtttctgatttttcttcgctggatgacccctgacagcattatcgacgtggcgatagatgcgacgggccctagaggggcatggaccaacaactactcgcattccaagaggggtggcgaaaacaatgaaatttcagaaactaga

SEQ ID NO: 250784 - DNA, 1452 bp, Artificial Sequence
  Description of Artificial Sequence: Synthetic coding sequence
atggcatgtcgaggtggagcaggtaatggtcatcgggcaagcgcaaccctgtcgcgtgtctcgccgggatccctgtacacctgtagaactagaactcataacatttgtatggtgtcagactttttctacccaaatatgggtggagtcgaatcgcatatctaccagctctcccagtgcctcattgaaaggggccataaggtcattattgtgacccacgcctacggtaacagaaagggtataagatacctgacttccgggctcaaagtgtactaccttcctcttaaggtgatgtacaaccagtcgaccgccacgaccctcttccattccctgccgcttctgcgctacatctttgttcgcgaaagggttaccatcattcacagccattcgtccttttccgcaatggcacacgatgccctttttcatgcaaaaactatgggcctgcaaacggtttttaccgatcattccctctttggatttgctgatgtgtccagcgttctcaccaacaaacttctgactgtgtccctctgtgacactaaccacattatctgtgtcagctatacctccaaggaaaacaccgtgcttagggctgcactcaaccctgagatagtgtcagtcataccaaacgcagtggacccgaccgactttacccctgatcctttccggagacacgatagcattactatcgttgtcgtgtcacgactggtttacaggaaaggcattgatcttcttagcggaatcatccctgagctgtgtcagaagtatcctgatttgaactttatcataggaggtgaaggacctaagcggattattcttgaggaggtgcgcgaacggtaccaattgcatgaccgggtgcgcctgttgggggcacttgaacataaagacgtcagaaacgtgctggtgcaaggacacatttttcttaacaccagccttactgaggccttttgcatggccatcgtcgaggccgcgtcatgcgggctgcaagtcgtctcgacgagagtgggtggaattccagaagtgctccctgaaaacctcattatcctttgtgaaccttcggtgaagtcactttgtgaggggctcgagaaggccattttccaactgaaaagcggtacgctccctgccccggaaaacattcataacatcgtcaagaccttttacacctggagaaatgtggctgaacgcaccgaaaaggtgtacgaccgggtgtccgtggaagcggtgctgcctatggacaaaagactggatagattgatcagccattgtggcccagtgactgggtacatctttgcactccttgctgtctttaactttctttttcttatcttcttgcgttggatgacgccagactcgattattgatgtcgcgatcgacgccaccggtccgagaggagcctggactaacaactacagccattcgaagcgtggtggagagaacaacgaaattagcgaaacccgg

SEQ ID NO: 250785 - DNA, 1452 bp, Artificial Sequence
  Description of Artificial Sequence: Synthetic coding sequence
atggcctgccggggcggtgccggtaacggtcaccgtgcttccgcaactctgtcccgagtctcacctgggagcctgtacacgtgtcggacccgaactcataacatttgcatggtcagcgactttttctacccgaatatgggaggcgttgaatctcacatttaccaactctcgcagtgtcttatcgaacggggacacaaggtgatcattgtgacccatgcttacggaaaccgtaagggaattcggtaccttactagcggactcaaggtgtactaccttcctcttaaggtcatgtacaaccagagcaccgcaactacccttttccattcactccctcttctcagatacattttcgtgcgggaacgcgtgaccattattcattcgcattcctcgttctcggcaatggcacatgatgcacttttccatgccaaaaccatgggtctgcaaactgtattcaccgatcattcgctttttggatttgccgatgtgtccagcgttctcactaacaagctgctcactgtgagcctttgtgacaccaaccacattatctgtgtgtcgtacactagcaaggagaatactgtgctgagagcagctcttaaccctgagatcgtgtcggtgattccaaacgcagtggaccctacggattttactcccgatccgtttcgccgtcatgactcaataactatcgtggtggtgtcgcgccttgtctaccggaagggaattgatctcctgtccggaattatcccggagctctgtcagaagtaccctgatctcaatttcataattggcggagaagggccgaagagaatcattctcgaagaagtcagagaaagataccagcttcacgatcgggtgaggcttcttggagctctggagcacaaggatgtgagaaacgtcctggtgcaaggtcatatctttctgaacacttccctgaccgaagcattttgcatggcgatcgtggaagcggcctcctgtggacttcaagtcgtctcgacccgagtggggggtatccctgaggtcctgccagaaaacctcatcattctgtgcgagccatcggtcaagtcactttgtgagggactcgaaaaggcaattttccagctgaaatcggggactcttccagcgcctgagaatatccacaatatcgtgaaaaccttttacacctggcgtaatgtggcagagcggaccgagaaggtgtatgatcgagtgagcgtcgaggcagtcctgcctatggacaagagattggatcgccttataagccactgcggtcctgtcactggctacatttttgccctgcttgcagtgttcaattttctgtttcttatcttcctgagatggatgactcctgatagcatcatagacgtggctatcgacgcgaccggtcctagaggagcctggaccaacaactactctcattcgaagcgtggaggcgagaacaacgaaatctcggaaactcgc

SEQ ID NO: 250786 - DNA, 1452 bp, Artificial Sequence
  Description of Artificial Sequence: Synthetic coding sequence
atggcctgcaggggcggcgcaggcaatgggcaccgagctagcgctacgctgagccgcgtgtcccccggtagcctctacacttgcaggacgcgcacccacaatatctgtatggtatccgacttcttctacccaaatatgggcggggtagagagccacatctatcagctgagccaatgcctgatcgaaagaggacacaaggtgataatcgtaactcatgcctacggcaatcgaaagggaattcgctacctgacttcaggcctgaaggtgtactacctaccccttaaggtgatgtacaatcagtctacagctactaccctgtttcattcactccctttactgagatatatttttgtgcgggaaagagtgacgattatccacagccacagcagcttctcggcaatggcccacgacgcactctttcacgccaaaacaatgggtcttcagacagtgttcacagaccatagcctgttcgggtttgcagacgtgtcctcagtgctgacaaataaattgctgactgtcagtctgtgcgatacaaatcatatcatctgtgtgtcctatacctccaaagagaatacggttctccgcgctgcccttaatccagagatcgtaagcgtcataccaaatgcagttgatcctaccgatttcacccccgatccattccgtcggcatgattctattaccatcgtggtcgtgtcacgcctggtgtaccgcaagggcattgatcttctgtctggcatcatcccggagctttgtcagaagtaccccgacctgaattttatcattggaggagaaggccctaagagaataatccttgaagaagtacgggaaagataccagcttcatgacagggtgagactgctcggagcactggaacataaagatgtacggaacgtcttggtgcaagggcacatatttctgaatacctcactcaccgaggccttctgcatggcaatcgttgaggccgcatcctgcggtttgcaagttgtgtctacacgggtcggcggcatccctgaggtgctgcctgagaacctcatcatcctttgcgaaccctcagtgaagtcactctgcgagggccttgaaaaggcgatctttcagctgaaatctgggactctcccggcaccagaaaatattcataacattgtcaagacattttacacatggaggaatgttgccgaaaggactgagaaggtgtatgaccgtgtgtcagtcgaggcggttttacctatggacaagcggctggataggctgatcagccattgcgggcccgtcactggatatatcttcgcgctgctggctgtatttaattttttgttccttattttccttcgctggatgacccccgacagcattatagacgtggccatcgacgccacgggaccacggggtgcctggaccaacaattactcacatagtaaacggggcggagagaacaatgagatctccgagactcgt

SEQ ID NO: 250787 - DNA, 1452 bp, Artificial Sequence
  Description of Artificial Sequence: Synthetic coding sequence
atggcctgccgtggaggtgcgggaaacgggcacagagcttctgcaaccctcagccgggtttcacctggctccctttacacgtgccggactagaactcataacatttgcatggtgtcggacttcttctacccgaacatgggcggcgtggaaagccacatctaccaattgagccagtgtctgattgaacgcggccacaaggttatcatcgtgactcatgcgtacggtaatagaaaaggaatccgctacctcacttcgggactgaaagtctactacctgcccctcaaggtcatgtacaatcaaagcactgccaccaccctcttccattctctgccgcttctccgctacattttcgtgcgcgaacgcgtgacgatcatccactcgcattcatcattctccgcaatggcacacgatgccctgttccacgcgaaaactatgggcttgcagactgtgtttactgaccattccctctttgggttcgcagacgtgtcatcagtgttgactaacaaacttcttacggtgtcactgtgcgataccaatcacatcatctgcgtctcctatacctccaaggaaaacacggtgctccgggccgcgctcaatcctgagatagtgtcggtgatcccaaacgccgtggatccaactgactttaccccggatcccttcagacggcatgattcgatcaccattgttgtggtgtccagactggtctaccggaagggaatcgatctcctgtcagggatcatccctgagctgtgtcaaaagtacccagacctgaacttcataatcggaggcgaggggcctaagcggattattctggaagaagtcagggaacggtaccagctccatgaccgtgtgagactgctcggtgcactggagcataaggacgttcgaaacgtgctggtccagggtcacatcttcctgaataccagcctgacggaagcgttctgcatggccatcgtcgaagccgcttcctgcggtctgcaagtcgtgtccacccgagtggggggaatcccggaagtgctgccggaaaacctgattatcctgtgcgagccgtccgtcaagtcattgtgtgagggcctcgagaaggcaatctttcagctgaagtccggaaccctgccggctccggaaaacatccacaacatcgtcaagaccttttacacctggcggaacgtggcggaacgcactgagaaggtgtacgatcgcgtttcagtcgaggcagtcctcccaatggacaagcgactcgaccggctgatctcgcactgtggacccgtgactggatacatttttgcactgttggccgtgttcaatttcctcttcttgatcttcctgcggtggatgaccccggacagcatcatagatgtcgccatcgacgcgacgggaccacgcggagcctggacgaataactattcgcactcgaaaagaggaggtgagaataacgagatctccgaaactagg

SEQ ID NO: 250788 - DNA, 1452 bp, Artificial Sequence
  Description of Artificial Sequence: Synthetic coding sequence
atggcatgcagaggaggagcaggcaacggtcatagggcctccgcgactctgtcccgagtcagcccaggctccctttacacctgtcgaactagaacccacaatatctgcatggtgtcggatttcttctacccgaacatgggtggggtggagtcacacatataccaactttcacagtgtcttattgaaagaggacataaagtgatcatcgtgactcatgcatacggcaataggaaaggaatcaggtacctcaccagcggactgaaagtgtactaccttcctctgaaggtgatgtataatcagtcgaccgcaactaccctgtttcattcgctcccactccttcggtacattttcgtccgggaacgggtcacgattatacatagccattcgtcgttttccgcaatggcacatgatgcactgttccacgcaaagaccatggggcttcagaccgtgttcaccgatcatagcctttttggatttgctgacgtgtcatcggtgttgaccaataaactgctgaccgtctcactgtgcgatactaaccacatcatttgtgtgtcgtacaccagcaaggaaaatactgttctgcgcgcggcccttaaccctgaaattgtttccgtgattcccaatgcggtggatcctactgactttacgccggacccatttcgcagacacgattccattactattgtggtggtgtcacggcttgtgtacagaaaaggaatcgacctgctgagcggcattattcccgagctgtgtcaaaagtacccagatttgaactttatcattggaggggagggccccaagagaatcattctcgaagaagtgagagaaagataccaactgcatgatagagtcagactgctgggtgcactggaacataaggacgtgcgaaacgtgcttgtgcaaggtcacattttcctgaatactagcctgactgaggcattctgtatggctatcgtggaggccgcatcctgtggcctgcaggtggtgtcgaccagagtgggcgggataccagaagtgctgcccgaaaacctgattatactgtgtgagccatcagtcaagtccctttgtgaagggctcgaaaaagcaatctttcaactgaagtcgggaaccctgccggcacctgaaaacatccacaatatcgtgaaaacgttctacacctggaggaacgtggcggaacgaactgaaaaggtgtacgatagagtgtcggtggaggcagtgttgccaatggataagcgacttgatagactgatctcccactgtggtccagtgacgggatacatatttgcactgctcgccgtgtttaactttttgtttttgatttttcttcgctggatgactccagattccattattgacgtggcaatcgacgcaacgggacccaggggcgcatggaccaacaattacagccattcaaagagaggtggggaaaacaacgaaatttcggagacgaga

SEQ ID NO: 250789 - DNA, 1452 bp, Artificial Sequence
  Description of Artificial Sequence: Synthetic coding sequence
atggcttgtcggggaggagcgggtaatggacatagggcgtccgcaaccttgtccagagtcagccccggatccctgtatacttgtcggacacggacccataacatctgcatggtctctgactttttttatccgaatatggggggagtagaatctcacatataccagctatctcagtgcctgatagagcggggacataaagttataatagtcactcatgcctatggcaacagaaaggggatccgctatctgacgtcaggattgaaggtctattatttacccttgaaagtgatgtataatcagtcaaccgccaccaccctgtttcactctctgcccttactgcgttatatcttcgtccgtgaacgcgtgacgattatacacagccacagctctttttctgccatggcccacgacgcactcttccatgctaagaccatgggcttgcagaccgtcttcacagatcacagtctttttggcttcgccgacgtctcctcagtcttgactaacaagctgttaacagtgtcattatgtgatacaaaccacatcatctgcgtttcatatacctctaaggagaacacagtgctacgcgctgctctgaaccctgaaatcgtaagtgttatccctaatgccgtggatcccaccgatttcaccccagacccttttcgccggcatgacagcatcaccatcgtagtcgttagccgcttggtgtaccggaaagggattgacctcctctcaggaataatccccgagttgtgtcagaagtacccggaccttaactttatcatcggcggggaaggaccaaagcgtatcattctcgaggaagtgcgggagcgctaccagcttcatgatcgggtcagactactgggagcgctggagcacaaggatgtccggaatgtgttggtacaggggcacatcttcttgaacacaagcctgaccgaggccttttgtatggctattgtggaagccgccagctgcgggctccaagtcgtgtccaccagggtcggaggcattcccgaggtgctgcccgagaatcttatcattttatgtgaacctagcgtgaaatccctttgcgagggcttggagaaagcaatttttcagttgaaatctggtaccctgccagctccagagaatattcacaatattgtcaaaaccttctatacatggaggaacgtggctgaacggacggagaaagtttatgacagggtgagcgttgaagctgtgcttcccatggataagaggctcgaccgactgatatcacattgtggtccggttaccggatatattttcgcactgcttgctgtcttcaactttttgtttctcatatttctcaggtggatgacccccgattcaatcatagacgtggcgattgatgcaaccgggccacgcggtgcttggacaaacaactactcccacagtaaaaggggcggcgaaaataacgaaatctctgagacgaga

SEQ ID NO: 250790 - DNA, 1452 bp, Artificial Sequence
  Description of Artificial Sequence: Synthetic coding sequence
atggcatgccgtggaggagcaggcaatggacatagagcatccgccactctgtcaagagtgtcccctggctccctttacacctgccggaccagaacccataacatctgcatggtgtcggactttttctaccccaacatgggaggggtcgaatcgcacatctaccagctgagccaatgtctcatagaacgtggacacaaagtgattattgtgacccatgcctacggaaaccgaaagggaattcgctaccttactagcggtttgaaagtgtactaccttccactcaaggtgatgtacaaccaatccaccgccactaccctctttcactcgttgccactcttgaggtacatctttgtccgagagcgcgtgaccattatccatagccattcgtcattctccgctatggcacatgatgcactgttccatgcaaagacgatgggattgcaaaccgtgtttaccgatcactcgctgtttggattcgctgatgtgtcctccgtgcttaccaataagttgctcactgtctcattgtgtgacacgaaccacataatctgtgtgagctacaccagcaaggaaaacacggtgcttcgagcagcacttaacccggaaatagtgtccgtgattccaaatgcagtggatcccactgattttactccagatccctttaggcggcatgactcaattactattgtcgtggtgagcagacttgtctatcgcaaaggaatcgaccttctgtcaggcattatcccagaactgtgccagaaatatcctgatctcaacttcatcataggcggtgagggtcccaagagaattatcttggaggaggttcgagaaaggtaccaattgcatgatcgagtgcggctccttggtgcactcgaacacaaggacgtgcggaacgtcctggtgcaaggacacatcttcctcaacacctcccttactgaggccttctgtatggccattgtcgaagcagcaagctgtggtctgcaagtggtgagcactagagtcgggggtatcccggaggtgctgccagaaaatctcattatactttgtgaaccttcggtcaagtctctgtgtgagggtctggaaaaagccatttttcagcttaagtccggcacccttcctgcaccagagaatattcataacattgtgaaaaccttttacacttggcggaacgtggcagaacgcactgaaaaggtttacgatagagtgtcagtggaggccgtgctccctatggacaagcgtctggacaggctcattagccattgtggaccggtgactgggtacattttcgctttgctcgcagtgtttaactttctgtttctgattttccttcgctggatgactcctgactctattatcgatgtggcaatcgacgcaaccggtcctcgcggagcttggaccaataactacagccacagcaagcggggcggcgaaaacaatgagatttccgaaaccaga

SEQ ID NO: 250791 - DNA, 1452 bp, Artificial Sequence
  Description of Artificial Sequence: Synthetic coding sequence
atggcttgccgcgggggggctggcaatggacatcgggcttcagccaccctgtctagggttagcccgggatccctctacacctgcaggacgcgcactcataatatctgtatggtgtcagatttcttctatccgaacatgggaggcgtggagagccatatttaccagctctctcagtgccttattgagaggggccataaagttattattgtgacccatgcgtacggcaatagaaagggcatccgctacctcacaagcggtctgaaagtttactacctgcccctgaaggtgatgtacaatcaatccacggccaccacgctgttccactccctgccactgcttcgatacattttcgttcgcgaaagggttaccatcatccattcccactctagcttcagcgctatggcccatgatgcgctgttccatgccaagacgatgggactccaaaccgtgtttaccgaccactctctgttcggtttcgctgacgtttctagcgtgctcaccaacaaactccttacagtttcgctgtgcgacacaaaccacataatatgtgttagctatactagtaaggaaaataccgtcttgagggctgccttgaatcccgaaatcgtgagcgtgatccctaacgctgtagacccaaccgatttcacccccgatccatttcgaagacatgactctatcaccattgtggtcgtgtcgaggctcgtttaccggaaagggattgacctgctgagcggtatcattcctgaactgtgccagaagtatccggacttaaattttatcattggaggtgaaggaccgaagcgcatcatcctggaggaagtgagagaacgttatcagcttcatgatcgggttcggcttttaggggcactcgagcacaaagatgtgagaaacgttctcgttcagggtcatatctttctgaatacttctctgacggaggccttctgtatggccatcgtggaggccgcttcatgcgggctgcaggtggtgtctacaagagttggaggtatccccgaggtgctcccagagaatctaataatcctgtgcgaaccgagcgtgaaatctttgtgtgagggactcgagaaggctatctttcagctgaagtctggcacccttcccgctcccgagaatatacacaatatagttaaaaccttttacacctggcgcaacgtggccgagcggaccgagaaggtctatgaccgggtgagcgtagaagcagtgcttcccatggacaagcgactcgacaggctcattagtcattgcggacctgtgaccggctatatcttcgccctcctcgccgtgtttaacttcctcttcctgatttttctaaggtggatgactcccgactcgattatcgacgtggcgatagacgcaaccggcccaagaggggcctggacgaacaattatagtcactccaagcggggaggcgagaacaacgaaatatctgaaacgcgg

SEQ ID NO: 250792 - DNA, 1452 bp, Artificial Sequence
  Description of Artificial Sequence: Synthetic coding sequence
atggcatgcaggggaggggccggaaatggacacagggcttccgcaaccctgtcacgagttagcccaggctcgctttacacttgtaggacccggacccacaatatttgtatggtgtctgatttcttctatcccaatatggggggggtagagtcccatatttatcagctcagtcagtgcctcatagagcgtggacacaaggtcattatcgtaacgcatgcctatggtaaccgaaaaggcataagatatcttacgagtggcctgaaagtgtattatctaccgcttaaggttatgtataaccagtccacggctacaactctttttcatagccttccactgctgcgatatatcttcgtgcgggaacgagtgacaatcatccattcacactcatctttttctgcaatggcccatgacgcgttgttccacgctaagaccatggggcttcagacagtattcactgaccacagcttgtttggatttgcggatgtgtcctctgttctgaccaataagctccttaccgtgagtctctgtgacaccaaccacattatttgtgtgagttacaccagcaaggagaacactgtgttacgcgcggcacttaaccctgagattgtgagtgtgataccaaatgccgtggatcctacagattttacccctgaccccttccgaaggcatgattccattacgatcgtcgttgtcagtcgcctcgtttaccgaaaaggcattgacttattgtctggaataataccggaactatgtcagaagtaccccgatctaaattttattattggtggagagggccccaagagaatcatcctcgaggaggttcgcgagagataccagctgcatgatagagttcgactgctcggtgccttggaacacaaggacgtgcgtaacgtgctcgtgcaggggcacatcttcctgaatactagtctgacagaggctttctgcatggccatcgtcgaagctgcgtcatgtggccttcaggtggtgtccacaagggtagggggtatcccagaggtactgccagagaatctgataattctctgcgagccctctgttaagtctctgtgcgaaggccttgaaaaagctatctttcagctgaagagtggtaccctgcccgccccggaaaatattcataacatcgtgaagacattctacacttggcggaacgttgccgaacggacagagaaagtttatgatagagtctcagtcgaggccgtgttgcctatggacaagcgactggatcgcctgataagccattgcggcccagtcacaggctatatctttgcgttgctcgctgtgtttaatttcctgtttttgatatttcttagatggatgacccccgactctattattgacgtggccatagatgccacggggcctaggggcgcatggaccaacaactactcgcatagtaaacgcgggggagaaaacaatgagatctccgaaacgcga

SEQ ID NO: 250793 - DNA, 1452 bp, Artificial Sequence
  Description of Artificial Sequence: Synthetic coding sequence
atggcctgcagaggtggagcgggaaacggacaccgcgcctcagctaccctgtcccgggtgtccccgggatcgctttacacctgccggactaggactcacaacatttgtatggtttccgacttcttctatccgaatatgggcggcgtggagtcgcacatctaccagctctcccagtgcctcatcgagaggggacacaaggtgattatcgtgacccatgcatacgggaacagaaagggtattcggtacctcaccagcggacttaaggtgtactatctgcccctgaaggtgatgtacaatcagtcaaccgcaactactctgttccactccctcccactgctgaggtatatcttcgtgcgggagcgggtgaccatcatccactcacattcatcgtttagcgcaatggcgcacgacgctctgtttcacgccaaaaccatgggtttgcagacggttttcaccgaccactccctcttcggcttcgccgacgtttcgtctgtcttgactaacaaactgctgaccgtctcgctttgcgacactaatcacatcatttgtgtgtcttacaccagcaaggaaaacaccgtgctccgggccgccctcaaccctgagatcgtctccgtgatcccaaacgcagttgatccaaccgattttacgccagaccccttcaggcggcacgattctatcaccatcgtggtggtgtccagactggtctaccgcaagggtatcgatttgctctccggaattatcccggaactgtgccaaaagtacccggacctgaacttcatcatcggaggggagggaccgaagcggatcattttggaggaggtgcgagaacgctaccagttgcatgaccgagtgagactcctgggggcactcgaacacaaggacgtccgaaacgtcctggtgcagggccacatcttcctgaacacttcattgactgaagcgttctgcatggcaattgtggaagctgcatcatgcggtctgcaggtcgtttcgactcgcgtgggcggcattccggaggtgctgcctgagaatttgatcatcctctgcgaaccgtcggtgaagtccttgtgtgaaggacttgaaaaggctatcttccagctgaagtcgggcaccttgcctgctcctgaaaacattcacaacatcgtgaaaactttttacacctggaggaacgtggcagagcgtaccgaaaaggtctacgacagggtgtccgtcgaagccgtgcttcctatggataagcgcctcgatcggctgatctcacactgcggacccgtgaccggatacatcttcgccttgctggccgtattcaatttcctgtttctcattttcctgcggtggatgactccggattcgatcatcgacgtggcgattgacgcgactggcccacggggcgcctggaccaataactactcgcattccaagagaggtggggaaaacaatgagatcagcgagactaga

SEQ ID NO: 250794 - DNA, 1452 bp, Artificial Sequence
  Description of Artificial Sequence: Synthetic coding sequence
atggcttgcaggggcggggccggcaatggacatagagcttctgccaccctttcaagagtgtcacctggatccctgtatacgtgcaggacaagaacccataatatatgcatggtatctgattttttctaccccaacatgggtggggtagaatcccacatctatcagctcagccaatgtcttatagagcgcggccataaggtgattatcgtcacccacgcttacgggaatcggaagggaattaggtacctgaccagtggcctaaaggtgtactatctgcctctgaaggtgatgtataaccagtcaaccgctaccaccctgtttcatagcctacccctgctgcgctatattttcgtccgggagagagttacaattatccatagccactccagtttttctgcaatggctcatgacgctctgtttcatgcaaagaccatgggtctccagacggtgtttacagaccatagcctgtttggctttgcagatgttagcagcgttcttaccaacaaattgttaaccgtgagtctgtgtgatacgaatcatattatctgcgtctcatatacctctaaggagaacaccgtactgcgcgctgcactgaatcccgagattgtgtccgtgatacctaacgcggtcgaccccactgacttcacccccgatccttttcgtcgccatgacagtatcacaatcgtggtggttagtcgcttggtctaccgaaagggcattgacctactctcgggtattatccctgagctttgtcagaaatacccagacctaaactttattatcggcggtgagggaccgaagaggatcatactcgaagaggtgcgcgaacgctaccagctgcacgacagggttcggctgctgggggccctggagcataaagacgtgagaaacgtcctcgtccaagggcatatcttcctaaacacctccttaacagaggcattctgcatggccattgtggaggctgcatcctgtggcctgcaggtcgttagtacacgggtggggggtatccctgaagtgcttcccgagaacctaatcatactgtgcgagccaagcgttaaatctctgtgcgagggcctggagaaggcgatattccagctcaagtccggtacattgcctgcgccagagaacattcacaacatagtcaaaaccttttacacctggaggaacgttgccgagagaaccgagaaagtctacgacagagtgtccgtcgaagccgttctgcccatggataagaggctggacagactgatctctcactgcggaccagtcaccggctatatatttgctcttctggctgtttttaacttcctgttcctcatctttttacggtggatgacgcccgatagcattattgatgtggcaattgacgcgactgggccccggggcgcgtggactaataactacagccactccaagagaggtggggagaataatgaaataagtgagacacgg

SEQ ID NO: 250795 - DNA, 1452 bp, Artificial Sequence
  Description of Artificial Sequence: Synthetic coding sequence
atggcctgcagaggtggagccggtaacggtcacagagctagcgccaccctgtcccgggtgtctcctggaagcctttatacctgccgcactcgcacacataatatctgcatggtgtctgacttcttctaccctaatatgggtggtgtggaaagccacatttaccaacttagccagtgcctcatcgaaaggggccacaaagtgatcattgttacccacgcttatggaaacaggaagggcatcagatacctgacgtcgggactgaaggtgtattatttgcctctcaaagtgatgtacaaccaaagcaccgcaaccaccctgtttcacagcctccccttactgagatatatctttgtccgcgagagggttactatcatccattcacatagcagcttcagcgccatggcacatgacgctctgtttcatgctaaaacaatgggcctgcagacagtgttcaccgaccatagcctattcggtttcgctgatgtctccagcgtgttgaccaacaagctgctcaccgtcagcctctgcgataccaaccacatcatctgtgtaagttataccagtaaagagaacactgtgctccgcgccgctctgaaccccgaaatagtgtccgtcatcccgaacgctgtcgaccctaccgacttcacccctgatcctttcaggcgtcacgatagcataactatagtggtggtatcacggctcgtgtaccgtaaaggaatcgacctgctgtcgggaatcattcctgaactgtgccaaaaatatcccgacctgaattttataatcgggggtgagggaccaaaaagaatcatattagaagaggtgcgcgaacgctaccaactgcacgatcgtgtgagactgctcggagctcttgaacataaggacgtaaggaacgtgctcgtgcagggtcacatcttcctcaacacaagcctgactgaagctttctgtatggccattgtcgaggccgctagctgcggccttcaggtggttagcacaagagtgggtggtatcccggaagttctccccgagaacttgatcatactctgtgagccatctgtcaaaagcctgtgcgagggtctggaaaaagccatctttcaacttaagagcggaacattgccggctcccgagaatatccacaacatcgtcaaaacgttttacacctggaggaacgttgcagagaggacagagaaggtctacgatagggttagtgtcgaagcagtgttgcctatggacaagagactggacagacttatttctcattgcggcccagttaccggctacatctttgcactgctcgctgtgttcaactttctgtttctgattttcctgagatggatgactcctgatagtattatcgacgtggcaatcgatgccacaggacccaggggggcctggaccaataattatagccacagcaaaaggggaggcgaaaataatgaaatcagcgagacacgg

SEQ ID NO: 250796 - DNA, 1452 bp, Artificial Sequence
  Description of Artificial Sequence: Synthetic coding sequence
atggcatgcaggggaggagccggcaacggtcatcgggcatcggccactctttctcgggtgtctcccggaagcctgtatacgtgtcgaaccagaacccataacatctgtatggtgtccgacttcttttaccccaatatgggcggggtggaatcacacatctaccagctttctcagtgcctgatagaaagaggacataaagtgataatcgtcacgcatgcctacggaaacagaaaaggcattaggtacctgacctccggtcttaaggtgtattacctcccactgaaggtgatgtacaatcagtcgaccgcaaccaccttgttccactccctgccacttctgcggtacatctttgttcgtgaacgggtgaccattatacactctcactcatcatttagcgcaatggcacacgatgcactctttcatgctaagacgatggggcttcaaactgtgtttactgaccatagcctgttcgggtttgcggacgtttcatcagtgctgacgaataagttgctgaccgtgtcgctttgtgataccaaccacattatctgcgtctcctacacttccaaagagaatactgtgctgcgtgcggcattgaacccggaaatcgtctcggtcatcccgaatgccgtcgaccctactgatttcacccctgacccattccggcggcacgatagcattacgattgtggtggtgtcgcgccttgtctaccgaaaaggaatcgaccttttgtccggtataatccctgaactttgccagaagtacccagatctgaactttatcattgggggtgagggacctaaacgaatcatacttgaagaagtgcgagaaaggtaccaactccatgatagagtgcgcctcctcggagcgttggaacataaggatgtcagaaacgtcctggtccagggacacattttccttaacacttccctgaccgaggcattttgtatggccattgtggaagccgcaagctgtggtttgcaagtggtcagcactcgcgtgggtggcatccctgaggtgcttccggagaatctcattattctgtgtgaacccagcgtcaagtcattgtgtgagggcttggaaaaggccatttttcaacttaagtccgggacccttccagcaccggaaaacattcacaatattgtcaagaccttttacacgtggcgcaacgtggccgagcgtactgaaaaagtgtacgatcgggtgagcgtcgaggcggtgctgcctatggataagagacttgacagactgattagccattgcggacctgtgactggttacatttttgctcttctggcagtgtttaactttttgttcctgatttttcttcggtggatgaccccagactccattatagatgtggctatcgatgcaaccggaccacgtggagcatggaccaacaattactcgcactcaaagagaggaggtgagaataacgagatatccgaaactcgg

SEQ ID NO: 250797 - DNA, 1452 bp, Artificial Sequence
  Description of Artificial Sequence: Synthetic coding sequence
atggcctgccggggtggcgcaggaaatggacatcgggcctccgccacacttagccgagtgtcaccaggatcactctatacctgcaggacacgtacccacaacatttgtatggtcagtgattttttttaccccaacatgggaggagtggagagtcacatttatcagctgtcacaatgtctcatcgaacggggacacaaggtgattatagttacccacgcctatggcaacagaaaggggatccgatacctaaccagcggactgaaagtgtactatctgccactgaaggtcatgtataaccaaagtacggcaaccactctcttccactctttacctctcctgaggtacattttcgtgcgtgagcgtgtgaccataatacacagccacagctcattttctgccatggcccacgatgccctgttccacgctaagacgatgggactgcagacagtcttcacagaccatagtctctttggatttgccgatgtgtccagtgtccttacgaataaactgctcaccgtgtcattgtgtgacacgaatcatatcatctgcgtcagctatactagcaaagagaacacagttctgagggcggctctgaacccagaaatcgtgtcagttatcccaaacgccgtggatccaactgattttacccctgatccattccgacgacacgatagcattaccatcgtggttgttagccgactggtctatcgtaaaggcatagaccttctctctggcattatacccgagctgtgccaaaagtatcccgatctcaactttataatcgggggcgaggggcctaaacgaattatcctggaggaagtccgcgaaaggtaccagctgcacgacagagtcaggctgctgggagctctggagcacaaagacgtgaggaacgtcctcgtccaagggcacatcttcctgaacaccagcctgacagaagcgttttgtatggcaatcgtggaggcagcctcttgcgggctgcaggttgtgagcaccagggtgggggggatcccggaagtgttgcctgagaatcttattatactctgtgagccttcggtgaaaagcctctgcgaaggcttagagaaggcaatcttccagctgaagtctggaaccctgcccgccccagaaaatatccacaacatcgtgaagaccttctacacctggagaaacgtagctgaacgcaccgaaaaagtctacgaccgggtcagcgtggaggcagtgctacctatggataagaggctggaccgattaatcagtcactgtggaccggtgaccggatacatctttgcgctgctggccgtgttcaactttctgtttctgattttcctgcgatggatgacacccgattccataattgatgtggctatcgacgccacaggacctcggggcgcatggactaacaactactcacactcaaaacgagggggagaaaataatgaaataagtgagacgcga

SEQ ID NO: 250798 - DNA, 1452 bp, Artificial Sequence
  Description of Artificial Sequence: Synthetic coding sequence
atggcatgccgtggtggggccggtaacggacatcgtgcaagcgcaaccttgagcagagtctcacctggatccctatatacttgtagaacccgaacacataatatttgcatggtaagcgactttttctatcctaatatggggggggtggagtcccacatctatcagttgtcacagtgtctgatcgagcgcggacacaaggtgatcatcgtaacacacgcctacgggaaccgcaaaggcattcggtatttaacctcaggtcttaaagtctactacttgcctttaaaggtcatgtataaccaaagcaccgccacaactctatttcatagcctgcctctgctgcggtatattttcgtgcgcgagcgggtcaccatcattcattcccactccagcttcagcgctatggcgcacgatgctcttttccatgctaagactatgggcctgcagactgtgttcactgatcatagtctgtttgggtttgcggatgtgtcaagtgtgctcactaataagttgttgactgttagtctgtgcgacacaaatcatatcatctgtgtgagttatacctcaaaggaaaacacagtgctgcgggccgctctcaacccagagatcgttagcgtgattcccaacgccgtcgatcctacagactttacacccgatccttttcgtcgtcacgattctatcaccattgtggtcgtcagccggctggtgtaccggaagggtatcgatttgctcagcggaattatccctgaactgtgccagaagtatcctgacctgaatttcatcatcggtggtgaaggccccaagagaataattcttgaagaagtcagagagaggtaccaattacacgacagagtaagactgctaggagctctcgagcacaaggatgtacgcaacgtgctggtccagggtcacatatttctaaacacaagtctcaccgaagccttctgtatggcaatcgtggaggcagcttcttgcggcctccaagtggtgagcactagagtgggagggatacccgaagtgttgcccgaaaacttaatcatcctttgcgagccaagtgttaagtcactttgcgagggcctcgagaaggccatattccagctgaagtctggcaccctccctgctccagagaatatccacaatatcgtcaaaacattctatacctggagaaacgtggctgaaaggactgaaaaggtctatgacagagtcagcgtcgaagcggtgttgcctatggacaagcggcttgatcggctgattagtcattgcggacccgtcaccggctacatcttcgccctcctggcggtcttcaacttcctgtttctcatcttcctgcgctggatgactccagatagtattattgacgtggctattgacgccactggtccgaggggtgcatggacaaataattattcccattctaagcgggggggtgagaacaacgaaatcagtgaaacgagg

SEQ ID NO: 250799 - DNA, 1452 bp, Artificial Sequence
  Description of Artificial Sequence: Synthetic coding sequence
atggcgtgccggggtggcgctggtaacggacaccgtgcgagcgccacactgagcagggtaagcccgggatccttgtatacgtgcaggacgcggacccataacatctgtatggtgtccgattttttctaccctaatatgggtggtgtggagtcacacatataccagctcagccagtgcctgatcgaacgcgggcacaaggttatcattgtgacacatgcctacgggaaccggaaggggatccgatatctaacttcaggtcttaaggtctactatcttccattgaaggtcatgtacaaccagagcacagctactacactgtttcactccctgcccctcttgcgttatattttcgttcgggagagagtaactattattcactcacattcatctttctctgccatggctcatgatgccctttttcacgctaagacaatgggactgcagactgtgtttaccgaccactcacttttcggctttgccgatgtatcttcagtgctcaccaacaagttgctcaccgtcagcctatgcgataccaatcatatcatttgcgtctcttatacttccaaggaaaacactgtattgagggcggctttgaatcctgagatcgtgagtgtaataccaaacgcggtggaccccactgacttcacccctgaccccttcaggcgtcatgattcgatcacgatcgtggttgttagtcgcctcgtatatagaaaaggcatagatcttctttctggcatcataccagaattgtgtcagaagtacccagaccttaattttatcattggcggagaggggccaaagcggatcatattggaggaggttcgcgagcgctatcagctgcacgacagggtgcggctgctaggcgccctcgagcacaaggacgtgcgaaatgtcctggtgcagggtcatattttcctgaacaccagcctcaccgaagcattttgcatggcaatcgtcgaagccgcatcttgtggtttgcaggtagtgtcaacaagggttggtgggatccccgaagtgctgcccgagaacctgatcatactctgtgaaccttctgtcaagtccctctgcgagggcttggaaaaagctattttccagcttaagtcgggaactctgccggctccagagaacattcataatatcgtcaaaaccttttatacctggcgaaacgtggccgagaggacggaaaaggtctatgaccgcgtgtcagttgaggcggtactgccaatggacaagagactggatagactcatcagccactgtggcccggtaacaggctacatcttcgccttgctggctgtcttcaatttcttatttctgatatttcttcggtggatgactcccgacagcattattgacgtggccatcgacgctacaggaccccgaggcgcgtggactaataactactcacatagcaagaggggcggcgagaacaacgaaatctccgaaactagg

SEQ ID NO: 250800 - DNA, 1452 bp, Artificial Sequence
  Description of Artificial Sequence: Synthetic coding sequence
atggcgtgtagagggggcgccgggaacggccatagggcttccgccaccctgtctcgtgtgagtcctggaagtctgtatacctgcagaacaagaacccataacatctgcatggtatcagacttcttctacccaaacatggggggcgtggaaagccacatataccagttatcacagtgtctgatcgaacgcggccataaagttatcatcgtgacccacgcctatgggaacaggaagggtatccgctatctcacttcaggcctaaaggtgtattatcttccactaaaagtgatgtataatcagtctacagctacaaccctgttccatagccttccgttgctgagatacatcttcgtgcgagaacgtgtgactatcattcattcccatagttcattttccgccatggcccatgacgcactgttccacgccaaaactatgggcctgcagactgtctttaccgaccattccctttttgggtttgccgacgtgtcatccgtgctcactaacaagttactgactgtgtcactgtgcgacacaaatcatatcatctgcgtcagctacacatcaaaagagaataccgtcctgcgtgctgcgctaaaccctgaaattgtgtcagttattcccaatgcggttgatcctaccgatttcacacctgatcctttccggagacacgatagcattacaattgtagtcgtatcccgccttgtgtacaggaagggcattgatctcctttctggcattatacctgagctttgtcagaaataccctgacctgaacttcatcattggaggggaaggaccgaaaaggatcattttagaggaagtcagggagcggtaccagctgcatgatagggttcgcctgctcggagccctggagcataaagatgtccgaaatgtgctggtccagggtcacatatttttgaacacatccctcaccgaagctttctgtatggccatagtagaagcagcgtcatgcggcctgcaggtcgtgtcaactcgagtagggggaattcctgaggtgctgccagaaaatttaatcatcttgtgtgagccctcggtcaaatcgctttgcgagggcctggaaaaggccatattccagttgaagtcaggcactttgccagcacccgaaaacattcacaatattgtaaagaccttctatacgtggcgcaacgtggctgaaaggactgagaaggtttatgacagagtcagcgttgaagcagtcctccccatggataagaggctggaccgattgatctcgcattgcggccctgttactgggtacatttttgctctactggcggtcttcaactttttgtttctaatcttcttacgctggatgacgcccgacagcattattgacgtagccattgacgccaccggcccacggggtgcctggacgaacaattactctcacagtaaaaggggcggcgagaacaatgagatctccgaaacgagg

SEQ ID NO: 250801 - DNA, 1452 bp, Artificial Sequence
  Description of Artificial Sequence: Synthetic coding sequence
atggcttgcagagggggcgctggtaacgggcacagggcctcagccactttatcccgagtgagtccaggttcgctctatacttgccgcactcgcacacataacatttgcatggtctcggattttttctatccgaatatggggggtgtcgaaagccatatttaccagctgtcacaatgcttgatagaaagaggacataaggtgattatcgttacacatgcctacgggaatagaaagggtattcgctatcttacttcaggactgaaagtatattatttgccactgaaagtaatgtataatcagagtaccgctacgacgttgtttcactcactcccgttacttcgatatatttttgtacgagagcgagttacgatcatccactcacatagttctttctccgcaatggctcatgatgcgctgtttcatgctaaaacgatgggcttacaaacggtctttacggaccatagcctgtttggcttcgccgatgtttcatcggtgttaacgaacaaacttcttactgtcagcttgtgtgacaccaaccatattatctgtgtgtcatacacaagcaaagaaaatacggtcctgcgcgcagccctgaatcctgaaattgtttcagtaatcccgaatgctgtggatccgaccgatttcacacctgatccgtttcgcagacatgattccattacaattgtcgtagtgagtcgtctagtttaccgtaaagggatagatttgcttagcggaatcattcctgaactttgccagaaatatccggatcttaattttattatcggcggtgagggacctaaacgtataatattagaggaagtaagggagagatatcagttgcatgatcgtgtcagactcttgggagcactggagcataaggacgtcagaaatgttttggttcaaggccacatttttttgaatacatctctcacggaagcattttgtatggccatcgtggaagcggcttcatgtggccttcaggttgtttcaacgagagtcggaggaattcctgaagtgctacctgagaatttaatcatcctttgtgaaccctccgtaaaatcgctttgtgagggccttgagaaagcgatttttcaattaaagtccggaacgttgccagctccggaaaacattcacaatattgttaagacgttttacacgtggcggaacgtcgccgagcgcacggagaaagtttacgatagggtgtcagtcgaagccgtactgccgatggataaacgccttgataggctaataagtcattgtggcccagtcacggggtacattttcgcgctgcttgcggtatttaattttctgttccttatcttcttaagatggatgacccccgattctatcattgatgttgcaatcgatgcaacgggacctcgcggggcgtggacaaataattactctcatagtaaacggggcggagaaaacaacgagatctccgaaacacgg

SEQ ID NO: 250802 - DNA, 1452 bp, Artificial Sequence
  Description of Artificial Sequence: Synthetic coding sequence
atggcttgtaggggcggcgccggtaatgggcatagggcctcagctaccctaagtcgcgtatcacccggatccttgtacacctgccgcacccgcacgcacaatatttgcatggtctctgacttcttctatcctaatatggggggcgtggagtcacacatttatcagttgtcccaatgcctgatagagcgaggtcacaaggtcatcatcgttacacacgcgtacggcaaccgaaaaggaatcaggtatctgacatctgggctcaaggtttattacttgcctctgaaagtcatgtataatcagtcaactgccactactctgtttcactctctgcctctcttacggtacatcttcgtgagggagagggttacaataatccactcacacagctccttttctgcaatggcccatgacgcccttttccacgccaaaaccatgggactccagactgtctttaccgatcactccctattcggctttgccgacgttagctctgtgctgactaacaaactgcttaccgtgtctctatgcgataccaaccacatcatttgtgtttcgtacacctccaaggaaaacactgtactccgcgcagcccttaatccggagattgtgtctgtaataccgaatgccgtggacccaaccgacttcacacccgacccgttccgacgacatgactctataaccatcgtggtagtatcacgcctggtctacaggaagggtatagatctgctgtcaggcatcatccccgagctttgccagaagtacccagatctcaattttattatcgggggcgaaggaccaaaaagaataattttggaagaagtgcgggagagataccagctgcacgacagggtgcgccttctgggggccctggagcacaaagatgtgagaaacgttctggttcagggccatatattcctcaacacaagtcttacagaagccttctgcatggctatcgtggaggcagctagctgcggcctacaggtggtcagtactcgagtgggaggaatccccgaggtgttgcctgagaatctaatcattctctgcgagccgtctgtcaagagcctttgcgaaggactggagaaggctatctttcagttaaaatccggcactttgcccgctcctgagaacattcacaacatcgtgaagacgttttatacctggcgcaacgtcgcggaacgaactgagaaggtgtatgatagagtgtccgtagaggccgtacttcctatggataagcgtctggataggctcatctcccactgtgggccggtgacgggatacatcttcgccctcctggcggtcttcaacttcctgtttctcatcttcctccgctggatgactcccgatagcataatcgatgtggctatcgatgccactggtcccagaggggcgtggactaacaactatagccattctaaacgcggcggtgaaaataacgagatcagtgagacccgg

SEQ ID NO: 250803 - DNA, 1452 bp, Artificial Sequence
  Description of Artificial Sequence: Synthetic coding sequence
atggcgtgccgcggtggtgcaggcaatggtcatcgcgcgagcgcaactctgtcgagagtttcccctgggtcactttacacttgcaggacccggacgcataacatttgtatggtatccgactttttctaccctaacatgggaggagtggagtcccacatttatcagctttctcaatgtctgattgagagaggacacaaggtgataattgtgacccatgcatacggcaataggaagggaattcgttacctgacctcaggtcttaaggtgtactacctcccactgaaggtcatgtacaaccagtcgacggcaaccactctctttcactcgctgcctttgctcagatacatttttgtcagggagcgggtcaccattatacattcccactcctcgttctcagccatggcacatgacgcactgtttcatgcaaaaactatggggcttcagaccgtgtttacggatcatagccttttcggtttcgcagatgtgtcatccgtcctgaccaacaaactccttactgtctcactctgtgacaccaaccacattatctgcgtctcatacacctcgaaggaaaacaccgttctgagggctgcactcaaccctgaaattgtgtctgtcatccctaatgctgttgaccctactgattttactccagatccatttcggcgccatgactcaatcaccatcgtcgtggtgagccggcttgtgtaccggaaagggattgatctgctgagtggcattataccggaactttgtcagaagtacccggatcttaacttcataatcggcggagaaggccccaagaggattattctcgaagaagtccgagaaagataccaactgcatgatcgcgtgagacttctgggggcgctggaacataaggatgtgagaaatgtgttggtgcaaggacacattttcctgaatacttccttgaccgaggcattttgcatggctatcgtggaagcagcgtcgtgtggcctccaagtggtcagtactagagtgggagggatcccagaagtgctgcccgagaacttgatcatcctgtgtgagccaagcgtcaagtccctgtgcgaaggactggaaaaggcgatatttcaactgaagtcaggaacccttcccgcacctgagaacattcacaacatagtgaaaacgttctatacttggagaaacgtggccgaacgcactgaaaaagtttacgaccgtgtcagtgttgaagccgtgcttcctatggataagcgtctcgatcgcctcatctctcattgtggtccagtaacgggatacatctttgcccttctggcggtattcaactttctgtttcttatctttctccggtggatgacccccgacagcattatcgatgtggcaattgatgccactgggccaaggggtgcttggaccaacaattactcgcattcgaagcgaggaggagagaataatgaaatttctgagactcgt

SEQ ID NO: 250804 - DNA, 1452 bp, Artificial Sequence
  Description of Artificial Sequence: Synthetic coding sequence
atggcctgtagaggcggcgccgggaacggacacagggcatccgcaactctgtcacgagtgtcaccaggttctctgtatacgtgtcgtacccgcacccacaatatctgcatggtttcggatttcttctacccgaacatgggcggtgttgaaagccacatctaccaactgtcacagtgtctcatcgagagaggtcataaggtgattatcgttactcatgcatacggtaacagaaaggggatcaggtaccttacttccggtctgaaggtgtactacctgcctcttaaggtcatgtataaccagagcaccgcaaccacgctgtttcactcgcttccattgctcaggtatatcttcgttagagaacgggtgacgattattcattctcattcatccttttccgcgatggcacatgatgcactttttcacgcgaaaacgatgggactgcaaaccgtctttactgaccattcgctctttggttttgccgacgtgtcctccgtgctgactaacaagctgcttaccgtgtcgctttgcgacaccaaccacattatctgtgtgagttacaccagcaaagaaaacactgtgctccgagcggcgcttaatccagagatagttagcgtaatcccaaacgcagtggatcccactgattttacccccgatccctttaggagacatgacagcatcaccatcgtcgttgtctcaagacttgtgtaccggaaggggattgacctcctcagcggcatcatacctgaactgtgccagaagtaccctgatctgaatttcattatcggcggcgaagggcctaaacgaattatcttggaagaggtgcgtgaaagataccaattgcatgatcgagtgcgtctgctgggcgcgcttgaacataaagacgtccgcaacgtccttgtgcagggccatatctttcttaacacctcgcttaccgaagcattctgtatggctatcgtggaagcagccagctgtggactgcaagtggtatcgactcgcgtgggtggaatccccgaagtgctgccagaaaacttgatcattctttgtgaacccagcgttaagtctctttgcgagggactggaaaaggcaattttccaactgaaaagcgggacccttcccgcccctgagaatattcataacatcgtcaagaccttctacacgtggcggaatgtggcagagagaacggagaaagtgtacgatcgagtgtcggtggaagcagtgctgccaatggataagagattggatagactcatttcacactgcggtcctgtcactgggtacatctttgcactgctcgcggtgtttaactttctgttcctcattttccttcgttggatgactccagactcgatcatcgacgtggcgattgatgccactggtcctcggggagcatggaccaacaattactcccactcgaagcgcggaggggagaacaacgagatttccgaaactaga

SEQ ID NO: 250805 - DNA, 1452 bp, Artificial Sequence
  Description of Artificial Sequence: Synthetic coding sequence
atggcatgccgcggaggagccggaaatggacatcgcgcttccgctactctatcccgggtatcacccgggtcactatacacatgtcgcacacgaacacacaacatatgcatggtatctgatttcttttatcccaacatggggggggtggaatcgcatatctaccagctgtcacagtgtctcatcgaacgaggacacaaagttataatagtgactcacgcctacgggaataggaaggggattcggtatttgacatctgggcttaaagtgtattatctccctctgaaagtaatgtacaaccaatctactgctacaacactttttcacagtctccctctgttgagatatatatttgtacgggaacgggtgacaattatccactcacacagttccttctcagctatggcacatgatgcactatttcacgccaaaactatgggacttcagactgtattcacagatcactccctatttgggtttgctgatgtgagttcagtgctaacaaacaagctcttaacagtctcactctgtgatacaaatcacattatatgtgtgtcctatacaagtaaagaaaatactgtcttgagggctgctctcaaccctgaaatagtctcagtgatccctaatgcggtggatcctacagatttcacacccgatccctttcgaaggcatgattcaataactatcgttgtggtctcccgacttgtataccgaaaaggaatagatctgctgtcaggaatcatacctgagctatgccagaaatatcccgatcttaactttataattggaggagaaggacctaaaaggatcatacttgaggaagtacgggaacgatatcagctccacgatcgcgtgagactcctgggggcccttgagcacaaagatgtgaggaatgtactagtccaggggcatatatttctaaacacatccctaactgaagccttctgtatggctatcgtcgaagcagcaagttgcgggctacaggtggtgtccactcgagtagggggaatccctgaagtactgcctgaaaatttgattatactgtgtgaaccgtcagtgaagtctttatgcgaagggctcgaaaaggccatcttccagctcaagtccgggacactacctgctcccgagaacatccacaatatcgtaaaaacattttacacatggcggaatgtggccgagcggacagaaaaagtgtatgatcgagtctcagtggaagcagtgcttcccatggataaacgattagatcggctgatcagtcactgtggacctgtcactggatacattttcgccctcttagcagtcttcaactttctttttctaattttcttaagatggatgactcctgattcaatcatcgacgtggctatagatgcaacagggccccggggagcttggacaaataactacagtcattcgaaacgaggaggagaaaacaatgaaatttcggaaactcga

SEQ ID NO: 250806 - DNA, 1452 bp, Artificial Sequence
  Description of Artificial Sequence: Synthetic coding sequence
atggcttgccgcggcggtgcaggtaatggtcatagagcaagcgcaaccctgagccgcgtctcccccggctctctgtacacctgcagaactcgcacccataacatttgtatggtatctgatttcttctaccccaacatgggaggagtggaatcccatatctatcaactgagccagtgccttatcgaaagaggccataaggtaatcattgtgactcacgcctacggaaatcgcaagggtatcagatatctcacgagcggactcaaggtttactacctgccgctgaaagtcatgtacaaccaatctacggccactaccctgtttcactctctccctctcctgcgctacatctttgtccgcgagcgcgtcacaattatccattctcactcttcattctctgccatggcccacgatgccttgttccacgccaagaccatgggactgcaaacagtcttcaccgatcacagcctttttggcttcgccgatgtctcctctgtgctcacaaacaagctgctcaccgtcagcctgtgcgatactaaccacatcatctgcgtgagttatacaagtaaggaaaacaccgtcctccgcgccgccctgaaccccgagatcgtctctgtgatccctaacgcggtcgatcccaccgacttcaccccggacccattcagaaggcatgattcaatcaccatagtggtcgtgagcagactggtgtacaggaagggcatagatctgttgagcggaattatcccagaactgtgccagaagtatcctgaccttaactttatcattggaggcgaaggtcctaagcgcattatcctggaagaggtccgcgaacgctaccaactccacgacagggtcagacttcttggtgctttggagcataaagatgtgcgcaacgtgcttgtccagggacatatcttcctcaacacaagcctgactgaggccttctgtatggcgatcgttgaagctgcatcctgcggattgcaagtggtgtctacaagagtaggcggtatacctgaggtactgcccgaaaatctgattatactctgcgagccctccgtgaagtctttgtgcgaaggtctcgaaaaggctatttttcagctgaaaagcggaaccctgcctgcacccgaaaatattcataacatagttaagacattctacacttggaggaacgttgccgaaagaactgaaaaagtgtacgatcgcgtctcagttgaagcagtgttgcctatggacaagagattggatcgcttgatctcccattgcggacctgtgaccggatacatattcgcgcttctcgccgttttcaacttcctcttcctgattttcctgaggtggatgactccggattcaatcatagatgtagcgatcgacgccactggtccaaggggagcatggactaacaactattctcatagtaagagaggaggtgaaaacaacgaaatctccgagacccgc

SEQ ID NO: 250807 - DNA, 1452 bp, Artificial Sequence
  Description of Artificial Sequence: Synthetic coding sequence
atggcatgtaggggcggcgctggcaatggccacagagcttccgcgacgttatctcgtgtctctcccgggtctctgtacacttgccgcacccggacacataacatctgcatggtgtcagacttcttctacccgaacatgggcggagtggagagccatatctaccaactcagtcaatgccttattgagagaggacacaaggttataattgtgacccatgcatacggaaacaggaaaggaatcagatacttgacctccgggctcaaggtgtactatctgcctctgaaagtcatgtacaaccagagcacagccacgacactgtttcacagcttacccctactcaggtacatcttcgtgcgcgagcgagtgacgatcatccactcccattcaagtttttcggccatggcgcacgatgctctgttccacgcaaaaacaatgggactgcaaaccgtctttactgaccactcactctttggattcgctgacgtgtcaagcgtacttacaaacaagctgctgactgtgtcattgtgtgatactaatcatatcatatgcgtaagctacacctctaaagagaatacggtcctccgagccgccctgaatcctgagattgtgagcgtcatcccaaacgctgtggatccgacggattttacgcctgacccgtttcggagacatgactccataacaatcgtggttgtgtcaagactggtctatcggaaaggcatagacctcctctctggaatcatcccggaactatgccagaagtatcccgatttgaactttataattggaggagagggcccgaaacggatcattctggaggaggtgagagagaggtaccaactgcatgacagagtgcgtctgctcggagccctggagcacaaagatgtgcgaaacgtgctagtgcagggccatatcttcctgaacaccagcttaacagaggccttttgcatggccatagtggaggccgcatcgtgtgggcttcaggtggtgagcactagggtagggggtatccctgaagtgttgcctgagaacctgattatactgtgcgaaccatcagtgaagtcactgtgcgaaggtctggagaaagcaatcttccaactcaaatcaggcactttgccggccccagagaacatccacaacatcgtaaaaaccttctatacctggagaaacgtcgcagagaggacagaaaaggtgtatgaccgcgtctctgtggaagctgtgttaccaatggataaaagactggaccggcttatcagtcactgcggccctgtgaccggctatatatttgccctgctggccgtgttcaatttcttgttcctcattttcctgagatggatgaccccagattcaatcatcgatgtggccattgatgctaccggacctcgaggtgcttggacaaacaactattcccattccaagaggggcggcgagaacaacgaaatcagtgagacacgg

SEQ ID NO: 250808 - DNA, 1452 bp, Artificial Sequence
  Description of Artificial Sequence: Synthetic coding sequence
atggcatgccgcggaggcgcaggaaacggtcaccgcgcatctgctacgctgagtcgggtcagcccgggaagcctgtatacctgcagaactagaacccataacatctgtatggtgtcagattttttctatccaaacatgggaggtgttgagagtcatatctaccagctgtcccaatgcctcattgaaaggggacacaaggtgatcattgtaacccacgcttatggaaaccgaaaagggatccgttaccttaccagcgggttgaaagtgtactacctgccattgaaagttatgtacaatcagtcgacagctacaaccctttttcatagccttcccctgttgaggtatattttcgttagagaaagggtgactatcattcacagccacagcagcttcagcgcaatggctcacgacgccttgtttcacgccaagacgatgggacttcagacagtgttcaccgaccactcactgttcggcttcgccgatgtgagtagcgtcttgaccaacaaacttctcaccgtttcactctgcgacaccaaccacattatttgcgtttcttacactagcaaggaaaataccgtactgcgcgccgcccttaacccagagatcgtatctgtcatccccaacgcagtggatcctaccgattttactccggatccttttaggaggcatgatagcatcactatcgtggtagttagccgcctcgtgtataggaagggcatcgaccttctttcaggaattatccccgagctctgccagaaatatccagatctgaacttcattatcggcggcgagggccctaagaggatcattctggaggaggtgagagagaggtaccaacttcatgatagagtgagactgctgggggccttggagcacaaggatgtgcgcaacgtattggtacagggccacatctttctcaacacctcattgaccgaagctttctgcatggctatcgtggaggcagcgagctgtggacttcaggtcgtttcaacgcgggtggggggcatccccgaggtgttaccagagaaccttatcatcctttgcgaaccaagcgttaaaagtctgtgcgaagggctcgagaaggccatctttcagctgaagtctggcaccttgccagcacctgagaatatacacaacatcgtaaaaacattctacacctggcggaacgtggctgagcggacagagaaagtttacgacagggtctccgttgaagcagtacttcccatggataagcggttggacagacttattagtcactgcggaccagtgaccggctacatctttgcacttctggctgtcttcaattttctgttcctgatattcctgcggtggatgacccccgactcaatcatagatgtggctatcgacgcaacaggtcctagaggagcatggacaaacaactattctcatagcaagcggggaggggaaaataatgagatctcagagaccaga

SEQ ID NO: 250809 - DNA, 1452 bp, Artificial Sequence
  Description of Artificial Sequence: Synthetic coding sequence
atggcctgccgtggcggtgcaggtaatggacaccgcgcgtcagcaaccctcagcagggtatctcctggctccttatatacatgcaggaccaggactcacaatatctgcatggtatccgattttttctaccctaacatggggggcgtggaatcccatatctaccagctgtcccagtgtctgatcgagagaggccataaagtgatcattgtgacccacgcttatgggaaccgaaaaggcattagatacctcacatccggcttgaaggtctactacctgccgcttaaggtgatgtacaatcagtccaccgccactactctgtttcattcgctacctctgctccgttatatcttcgtccgggagagggtaaccatcatccactctcacagctcattttctgcaatggcccacgatgctttattccacgcaaagaccatgggtctccaaaccgtatttacagatcacagcctcttcggattcgcggatgtatcatccgttcttaccaataagttactgaccgtatccctgtgcgacactaatcacatcatatgtgtctcatacacctccaaagagaacaccgtactccgcgccgccctgaaccccgagattgtcagcgtaatccccaatgcggtggatcccaccgacttcacccccgatccctttaggcggcatgacagcatcacgattgtggttgtgagccgcctggtgtataggaaaggcatcgatctgttaagcggaatcatccccgagctgtgtcagaagtaccccgacctaaacttcatcataggtggcgaggggccaaaacggataattttagaagaagttagggaaagataccagctccatgaccgggtgcggttactgggagctctagaacataaagacgtccggaacgtgctcgtgcagggacacatcttcctgaacacatcgctgactgaggctttttgcatggccatagtagaggccgccagctgcggtctccaggtggtgtctaccagggtaggcggaattccagaagtgctccctgagaatcttattattctgtgtgagccaagcgtgaagagcctgtgtgaggggctcgagaaggcaatctttcagctaaagtctggtacactgccagctccagagaacatacacaatatcgtaaagaccttctatacgtggagaaacgtggctgaacggactgaaaaggtatatgatagagtatcagtagaggcagtcctgcccatggataaacggcttgaccggctgatatcccactgcggaccagtcactggttatatattcgcactgttggccgtgtttaactttctgtttctaatctttttgagatggatgactcctgatagcattatcgatgtggctatcgatgctaccgggcctcgcggcgcgtggaccaacaattacagtcactctaagcggggaggggaaaataatgaaattagcgagaccaga

SEQ ID NO: 250810 - DNA, 2541 bp, Artificial Sequence
  Description of Artificial Sequence: Synthetic coding sequence
atggcaaagccactcactgaccaggagaagagacgtcagatctcgatccgaggtattgtgggggtggaaaacgtcgctgaactgaagaagagctttaatcgacatctgcactttaccctggtgaaggaccggaacgtggcaaccactcgggattactatttcgcccttgctcataccgtcagggaccatctggtcggtcgctggattcgcacccaacaacactactatgataaatgcccaaaaagggtgtactacctgagccttgaattctacatgggacgtactctccaaaatactatgattaacctgggtctgcagaacgcctgcgatgaagcaatttaccagctgggtctggatattgaagaactcgaagaaatcgaagaggacgccggacttggtaatggtggtctgggaaggcttgcagcatgttttttggattcgatggccactcttggactggctgcatacggttacggaatccgttacgagtatgggattttcaaccagaaaatacgggatggctggcaagtcgaggaggcagatgattggcttagatacggcaatccttgggagaagagtagaccggaattcatgctccccgtgcacttttacggtaaggtggaacataccaataccgggaccaagtggattgacacccaggtcgttcttgccttgccatacgatactccggttccaggatacatgaacaatactgtcaatacgatgcgactgtggtcggcacgcgccccaaatgatttcaaccttagggacttcaacgttggagactatatccaagcagtcctggaccgaaaccttgccgagaacatttcacgagtcctgtaccctaatgacaacttcttcgagggaaaggaacttcggttgaagcaagaatactttgtagtcgctgcgactctgcaagacataattcgcaggttcaaggcttcaaagtttggatcgaccagaggagcaggaactgtgtttgatgcatttccagaccaagtggcaattcagctgaacgacacgcatcctgcattggccatacctgagcttatgagaatctttgtcgatattgaaaagctcccatggtccaaagcatgggaacttacccaaaaaacttttgcatacactaatcataccgtgctgcccgaagcactcgaaagatggcctgtggatcttgtggaaaaacttcttccaaggcatctcgaaatcatatacgagataaaccaaaagcatctcgaccgtattgtcgctcttttccccaaagatgtggatagactccgtcggatgtcactcattgaggaagagggaagcaagagaattaacatggcacatctttgcatcgttggatcccatgcagtcaacggggtggcaaagatccactcagacattgttaagacgaaggtgttcaaggacttctcggagttggagcctgataagtttcagaacaaaacgaacggaatcacccctaggcggtggctcctcctctgtaatccgggacttgcagagctgattgcagaaaagatcggagaagattacgtgaaggatctgagccaactgaccaagctgcattccttccttggtgacgatgtttttcttcgggagctcgcaaaggtgaaacaggaaaacaagctgaagttttcccaatttctcgaaactgaatacaaagtgaagattaatccctcgtctatgtttgatgtacaagtaaaaagaattcacgagtacaagaggcaattgctcaattgtctgcacgtcattacgatgtacaatcgaatcaagaaggatcccaagaaactctttgtgcctcgtaccgtgatcattggcggtaaggcggccccgggctaccacatggccaaaatgatcatcaagctgatcacctcggtggccgatgtggtgaacaacgaccctatggtgggaagcaaacttaaggtgatctttctggagaactaccgagtgtccctggcagagaaggtgattcctgcgacggatctgtcagagcaaatctcaactgcagggactgaagcatcgggtaccggaaacatgaagtttatgcttaacggcgctctgacgataggtaccatggatggagcaaatgtggagatggcggaagaagccggggaagagaacctgttcatttttggaatgcgcatagatgacgttgccgccttggataagaagggatatgaagcaaaagaatactacgaagccctgccagaacttaagctggtgattgatcagatcgataacggctttttcagcccaaagcaacctgacttgtttaaagacatcattaacatgctgttttaccacgacaggtttaaagtgtttgcagattacgaagcatacgtcaaatgtcaggataaggtgagccagctgtacatgaatcctaaggcatggaatactatggtccttaagaacatcgcagcgtcgggcaaattctcgtctgatcgtaccatcaaagaatacgcgcagaacatctggaacgtggaaccttccgacttgaagatttcccttagcaatgaatctaacaaggtcaacggaaac

SEQ ID NO: 250811 - DNA, 2541 bp, Artificial Sequence
  Description of Artificial Sequence: Synthetic coding sequence
atggccaaaccattgactgaccaggagaagagacgtcaaatcagcatccgcggaattgtgggtgtggagaatgtggcagagctcaagaagagttttaaccggcaccttcactttaccctggtgaaggacaggaacgtagctacaacccgtgactactacttcgcgctagcccatacagttcgagaccacctggtgggccggtggatccgtacgcaacaacattattacgataagtgtccaaagcgcgtctattacctgagccttgagttctacatgggcagaacgctccagaacacaatgattaacctcggactgcaaaacgcttgtgatgaagccatctaccagttaggcctggatattgaagaactggaggagatcgaggaagatgcgggcctggggaacggcggactgggtcgcctcgcggcctgttttctagattcgatggcgactctgggactagccgcatatggttatggcatccgatatgagtacggtattttcaaccaaaaaatcagagacggatggcaggtcgaggaggcagatgattggctcaggtatggcaatccatgggagaagagccgcccagagttcatgctccctgtgcacttttatggcaaggttgagcacaccaacacaggcacgaagtggatagacactcaagtggtgttggccttgccgtatgatactccggtgccgggttacatgaataatacggtaaacacgatgcgactgtggagcgcgcgcgccccaaatgacttcaatctgcgtgatttcaacgtcggtgattatattcaagcagtcctggaccgcaatctggcggagaacatctcccgcgtgctgtacccaaatgataatttcttcgagggcaaggagttgcgcctgaagcaggagtacttcgtggtggcagctaccctgcaagatatcattagacgtttcaaggcttccaagttcggctcgacacgaggagcgggaacggtattcgacgcgttcccggatcaagtcgccatccagttgaacgatacccatcccgccctggcaatccccgagctcatgcggatattcgtagatatcgaaaagctgccgtggtcaaaggcctgggagctgacccagaaaacctttgcctataccaatcacacagttctccccgaggccctcgaacggtggccagtagatcttgtcgaaaagctgcttccccgccacctggagattatatacgaaattaatcaaaaacacctggaccggatcgtggccctgtttcccaaggatgtcgatcgtctgagacgtatgagcctgatcgaggaggagggctcgaagcgaatcaacatggcgcatctttgtatcgtcggctcccacgcggtaaacggcgtggccaagatacactccgacatcgtgaagacaaaggtgttcaaggatttctcggaattggaaccggataaattccagaataagacgaacggtattacaccgcgccgctggctgctgctctgcaacccaggactggctgaattaatcgcagagaagatcggagaggattacgtcaaagatctgtcacaactgacgaagctccactcgtttctaggcgacgatgtgtttctgcgagagctggccaaggtcaaacaggagaataagctcaaattctctcagttcttggagacagagtacaaagtgaaaattaacccctcatcaatgtttgatgttcaagtgaagcgtatacacgagtacaagcgccagctgctaaattgcctacacgtgataacgatgtacaatcggatcaagaaggatcccaagaagttgttcgtgccccgtaccgttatcatcggcggcaaggcggctcccggttaccacatggctaagatgattattaaactaattacctctgttgccgatgttgtgaacaacgacccgatggtgggaagtaagcttaaagtgattttcttggagaactacagggtgtccctggccgaaaaggtgattcccgcgacagacttgagtgagcaaataagcaccgcaggcacggaggcatcgggcaccggcaatatgaagttcatgttgaatggcgcgctgaccatcggcacgatggatggcgccaacgtagagatggccgaagaagccggcgaggagaacctgttcatctttggcatgcgtatcgacgacgtggcggcactggataaaaagggctacgaagccaaagagtactatgaggcgttgcctgaactgaagctggtcattgaccagatcgataatggtttcttctcgcccaagcagcccgacctcttcaaggatatcatcaacatgctgttctaccatgatcggtttaaagtgttcgccgattacgaagcctacgtaaagtgccaggataaggtaagccagttgtatatgaacccaaaggcatggaataccatggtcctgaagaatatagctgcaagcgggaaattcagcagtgatcgcacaatcaaggagtatgcccagaatatatggaacgtggaaccaagcgacctgaaaatcagcctttcaaatgagtccaataaggttaacggtaat

SEQ ID NO: 250812 - DNA, 2541 bp, Artificial Sequence
  Description of Artificial Sequence: Synthetic coding sequence
atggctaaacccctcactgaccaggaaaagcgccgccagatttcgatccgtgggatcgtcggcgtggagaatgtggcagaactcaagaaatcgttcaaccggcatctgcatttcactctggtgaaggaccggaacgttgcaactaccagggactactattttgcactggcgcatactgtccgcgaccacttggtgggcagatggatccggacccagcagcattactacgacaagtgtcctaagcgtgtgtactacctgtcacttgagttctatatgggacggactctgcaaaacaccatgattaaccttggccttcagaacgcatgtgatgaagctatctaccaactggggctggatatcgaagagctcgaggaaattgaggaggatgcgggacttggaaacggtgggctgggacgcctggcagcctgcttcttggactcaatggcgactctcggactggctgcttacggttacggaatcaggtacgaatacggcatcttcaaccagaagatccgggatggttggcaggtggaagaagcagatgactggcttcggtacgggaatccttgggagaagtcccggccggaattcatgctcccggtccatttctatgggaaggtcgaacacaccaataccggcactaagtggattgacacccaggtggtgcttgccctgccgtacgacaccccggtccccggatacatgaacaacactgttaataccatgaggttgtggtctgcgcgcgcgcctaacgactttaaccttcgcgacttcaacgttggggattacatccaggccgtcctggatcgcaacctggctgagaatatctcacgcgtgctgtacccgaatgacaacttcttcgaaggaaaggagctgagactcaaacaagaatactttgtggtggcggccaccctccaggatatcatcagacgcttcaaggccagcaagttcggaagcacccgaggtgccggaaccgtgtttgacgccttccctgatcaagtggccatccagctcaatgatactcaccccgcgcttgcaatcccagagctgatgagaatctttgtggatatcgaaaagctcccatggtccaaagcatgggaactgacccagaaaacttttgcttacactaaccataccgttctgccggaagcccttgagcggtggccggtagacctggtcgagaagctcctcccacggcacctcgaaatcatctacgagattaatcagaaacaccttgaccggattgtcgccctgttccctaaagatgtggacaggcttagacgcatgtcccttattgaagaggagggatcaaaacggatcaacatggcgcacctgtgcattgtgggatcacatgccgtgaatggagtggccaaaattcattccgacatcgtgaaaaccaaggtgtttaaggatttctctgaactcgagccagacaagtttcaaaacaagactaatggaattacccctcgccgctggctgctgctgtgtaatccaggattggcagaactgatagcggaaaagatcggtgaggactacgttaaggatctgagccaattgaccaagctgcactcgttcctcggagatgatgtattcttgcgggaactggctaaggtgaagcaagagaacaagctcaagttttcccagttcttggagactgaatacaaagtcaaaatcaatcccagctcgatgtttgacgtgcaggtgaagcgcatacatgaatacaaacggcaactgctcaactgcctgcacgtgatcacgatgtacaaccggatcaaaaaggaccccaagaagctcttcgtgccgcggacggtgatcatcggcggcaaggccgccccgggataccatatggcgaagatgatcatcaagttgatcacctccgtggccgacgtggtgaataacgacccaatggtcggctcgaaactgaaagttatcttcctcgaaaactatcgggtgtccctggccgagaaggtgatcccggcgactgaccttagcgagcaaataagcaccgcgggaaccgaggcgtcgggaaccggcaacatgaagtttatgctgaacggcgccctcactatcggaactatggacggagcaaatgttgaaatggcagaggaagcgggcgaagagaacctgtttatcttcggaatgcgaatcgatgacgtggcggccctcgataagaagggctacgaagcgaaggagtactacgaggccctcccagagctcaagctggtgatcgatcaaatcgacaatggattcttcagccccaagcagccagacctctttaaggatatcattaacatgctcttctatcatgaccgctttaaagtgttcgccgattacgaggcatacgtgaagtgccaagataaggtgtcccaattgtacatgaacccgaaggcctggaacaccatggtcctgaagaacatcgccgcgtcgggaaagttctcatccgatcgcaccatcaaggaatacgcccagaacatctggaacgtggaaccaagcgatctcaaaatctcgctgtccaacgaaagcaataaggtgaatggaaat

SEQ ID NO: 250813 - DNA, 2541 bp, Artificial Sequence
  Description of Artificial Sequence: Synthetic coding sequence
atggcaaagccgcttacggaccaggaaaagagacgtcagatttccattagaggtatcgtgggcgtggagaacgtggcggagctgaagaagagcttcaacagacatctccatttcactcttgtgaaagacagaaacgtggccactaccagggattactactttgcactggcacatacggtcagggatcacctggtgggccgctggattagaactcaacaacattactacgataaatgtcctaaaagagtgtactaccttagccttgagttttacatgggacgcactctgcagaacaccatgatcaatcttggtctgcagaacgcatgcgacgaggcaatttaccaattgggcctggatattgaggaactggaggaaatcgaggaggatgcaggactgggaaatggagggctgggaaggttggctgcctgttttcttgattcaatggccaccctgggacttgcagcctacggatacggaatcagatacgagtacggtatattcaaccagaaaatacgggacggctggcaagtggaggaggcagacgattggctgcgatacggcaatccctgggagaagagcagaccagagttcatgcttccagtgcacttttatgggaaagtggagcatactaacaccgggaccaagtggatcgacacccaagtggtgctcgcactcccctacgataccccagtgccaggatacatgaataacactgtgaacactatgcgtctctggtcagctcgcgcacccaatgatttcaatttgcgtgactttaacgtcggcgattacatccaagcagtccttgaccgcaatcttgcagaaaacatatcgcgagtgctgtacccaaacgataacttctttgaggggaaggaattgagactgaagcaggagtactttgtcgtcgcagccactctccaggacattattcggagattcaaggcgtctaaattcgggtccacgcggggagcaggcaccgtattcgatgccttcccagaccaggtcgcgattcaacttaacgacactcatcctgcacttgcaatacctgaacttatgcgcatttttgtggacattgaaaagctcccctggtccaaggcgtgggaactgacccagaaaacttttgcatatactaaccatactgtgttgcctgaagcactggaaaggtggcccgttgatttggttgaaaagctgctcccaagacatttggagataatctatgaaatcaaccagaagcacctggatcggattgtggctctctttccaaaggatgtggatcggctgaggcggatgagccttatcgaagaggaagggtcaaagcggattaacatggctcatttgtgtatcgtgggctcgcacgcagtcaacggtgtagctaagattcactcggatatcgtgaaaactaaggtgttcaaagatttctccgaactcgagccggataagtttcaaaacaagactaacggcattacccctagacggtggctgctcctgtgtaacccaggccttgccgaactgattgcggaaaagattggagaagattacgtgaaagacctgtcccaactgaccaagctgcattccttcctcggagatgatgttttccttagagaacttgcgaaagtgaaacaagagaacaagctgaaattctcgcaattcttggaaaccgagtataaggtgaagattaaccccagctccatgttcgacgtgcaagtgaagcggattcatgagtacaaaagacaactgctgaattgccttcatgtgattaccatgtataatcggatcaaaaaggatccaaagaaactgtttgtgccccgcactgttatcataggtggtaaggcagcacccggttaccatatggcgaagatgattatcaaactcattaccagcgttgcggacgtggtcaataatgaccctatggtcggaagcaagctgaaggtgattttcctggaaaactacagggtgtcgctcgcggagaaagtgataccagctactgatcttagcgagcaaatttcaaccgcaggaaccgaggcaagcggaactgggaatatgaagtttatgctgaacggtgcactcactattggtactatggacggtgccaacgtcgaaatggcagaggaggcaggcgaagaaaatcttttcatctttggaatgcgcattgatgatgtggcagcactggataagaagggatacgaggcaaaggaatactacgaagcactcccagaacttaaacttgtgatcgatcaaattgataatgggttcttttcccctaagcaacctgatctcttcaaggatatcataaacatgctcttttaccatgataggtttaaggtctttgcggattacgaggcctacgtcaagtgtcaggataaagtctcacaactttacatgaatccaaaagcatggaacaccatggtgctgaaaaacattgccgcatcagggaagttttcgtccgatcgaaccattaaagaatacgcacaaaacatttggaatgtggaaccctcagatctcaaaatctctcttagcaatgaatccaataaggtcaacggtaat

SEQ ID NO: 250814 - DNA, 2541 bp, Artificial Sequence
  Description of Artificial Sequence: Synthetic coding sequence
atggctaaaccactgaccgaccaggagaagagaaggcagatttccatcagaggaattgtgggcgtagaaaatgtggcagaactaaagaaatcctttaacaggcacctgcattttaccctggtcaaggacagaaatgtggctaccacccgggactattactttgccctcgcacacacggttcgcgatcatcttgtcgggagatggatccgaacccagcagcattattacgataaatgccctaaacgcgtctactatctgagtttggagttctatatgggacggacactccagaataccatgatcaatctgggactacagaacgcctgcgacgaggctatctatcagctggggcttgacatcgaagagctggaagagattgaggaggatgctggtctgggtaacggcggcttaggccgcttggccgcatgttttctggactctatggctactctggggctcgctgcatacgggtacggcatcagatatgaatatggcatttttaatcagaagatacgagatggttggcaggtggaggaggctgacgattggctgcgttacggaaacccctgggaaaagtcacgcccagagttcatgttgccagtccacttctacggcaaggtcgagcatactaatacgggaactaagtggattgatactcaggtcgtgttggccctgccctacgatacccccgtgccaggctacatgaataacactgtgaataccatgcggctttggtcagctcgtgccccgaacgatttcaatctgcgcgactttaacgtcggcgattatatccaagccgtactggatagaaacctcgcagagaacatctctcgcgtattgtatcccaacgataacttcttcgaagggaaggagctgcgtctgaagcaagaatacttcgtcgtcgccgcaactctgcaggatataatccgcagattcaaggcatctaaatttggcagcacacgtggggctgggacagtcttcgacgcctttccagaccaggttgcaattcagttaaacgacacacaccctgctcttgccatcccggagctgatgaggattttcgttgatattgaaaagcttccatggagcaaggcctgggagcttactcagaaaaccttcgcttacactaaccataccgtactcccagaggccctcgagagatggcctgtggacttggttgaaaagcttttgcccagacacctggaaattatttacgaaattaaccagaaacatctggaccgtatcgtggccctgtttcctaaggacgttgaccggttgcggcgcatgagcctcattgaggaagagggaagtaaacgcattaatatggcacacttgtgcatcgtggggagtcacgccgtgaacggcgtagccaaaattcatagtgacattgtaaagaccaaggtgtttaaagacttctctgaactggaacctgacaaattccagaataagacgaacggaatcacgccccggagatggctgcttttgtgcaacccagggctggccgagctcattgccgagaagattggtgaagattacgtgaaagatttgtctcagctcaccaagctgcactcttttcttggggacgatgtttttctgcgggaattagccaaggtcaagcaggagaacaaacttaaattttcacagttcctcgagacggaatataaggtcaagataaatcctagtagtatgttcgatgtgcaggtgaagaggattcacgagtacaaacggcagctgctcaactgcttgcacgtaattactatgtataaccggattaaaaaggatcccaagaagctattcgtgccacgaaccgtgataatcggtggtaaagcggccccgggctatcacatggccaaaatgataattaaactgataaccagcgtagccgatgttgttaacaacgaccctatggtaggcagtaagctgaaagtgattttcctggagaattatagggtgtctttggctgaaaaagtgatccccgcgaccgatctgagcgaacagatctctaccgctggcacagaggctagtgggactgggaacatgaagtttatgcttaatggcgcgcttacaataggtaccatggacggtgcgaacgttgagatggccgaagaagctggggaggagaatttgtttatttttgggatgcgaatcgacgatgtcgcagcgctagataagaagggctacgaggccaaagagtattatgaggccctaccggaactgaagctcgtgatcgaccagatcgataacggtttcttttctcctaaacagcccgatctgttcaaagacatcattaacatgctgttctatcacgaccgctttaaggtatttgcagactacgaggcttacgtcaagtgccaggacaaggtgagtcagctgtatatgaatcccaaggcctggaacacgatggtactgaagaacatagcggccagtggtaagttcagcagcgatcggaccatcaaagaatatgcccaaaatatctggaacgtggagccatcggacctgaaaatttctctgtcaaatgagtccaataaggtcaatggtaac

SEQ ID NO: 250815 - DNA, 2541 bp, Artificial Sequence
  Description of Artificial Sequence: Synthetic coding sequence
atggcgaagcctctgactgatcaggaaaaacggcgtcaaatctccatccgcggaatcgtgggagtagagaacgtggccgaactcaagaagagtttcaaccgccatcttcatttcaccctggttaaggaccgcaacgtggccaccacgcgagactactacttcgcattggcgcacaccgtgcgggaccatctggtcgggaggtggattcggacccagcaacattactacgacaaatgccccaaaagagtctactacctctcgctcgagttctacatggggagaaccctgcagaataccatgataaacttgggtctgcagaatgcatgtgacgaagctatttaccaactcggactcgacatcgaagaacttgaggagatcgaggaggatgcaggactgggaaatgggggactgggacggctggccgcctgttttctggactcaatggcgacccttggattggccgcctatggatacggaatccgttacgaatacggaattttcaatcagaaaatcagagacggttggcaggtcgaggaagccgacgattggctgcggtacggaaacccatgggagaagtcgcggccagaattcatgcttccagtccatttctacggaaaggtggaacacactaacacgggcaccaagtggatcgatacgcaagtggtgctggctctcccgtacgacaccccggtcccgggttacatgaacaacactgtcaataccatgagactttggtcagcgcgagcgccaaatgactttaacctccgcgatttcaatgtcggcgactatatccaagccgtgctcgatagaaatttggccgagaatatctcccgtgtgctctacccgaatgacaatttcttcgaaggtaaagagctgaggctgaagcaggagtactttgtggttgccgcgactctgcaggacattattcggcggtttaaggcctcgaagttcggctccactcgcggagccgggactgtgttcgatgccttcccggatcaagtggcaatccagctcaacgacactcacccggctctggccatcccagaactgatgcggatcttcgtggatatcgagaaactcccttggagcaaggcctgggaactgacgcaaaagacctttgcctacaccaaccacactgtcctcccggaagcattggagcgatggcccgtggatctggtggagaagctgctgccgagacatctggaaatcatctatgaaatcaatcaaaagcacctcgacagaatcgtcgctctgttcccaaaggatgtggatagattgcgcagaatgtcgctgattgaggaagagggctccaagcggataaacatggcccacctgtgcattgttggaagccacgcggtcaatggggtggctaagatccacagcgatatcgtcaaaaccaaggtctttaaggacttttcggagctcgagcctgataagttccagaataagaccaacggtataactccgcgccggtggctcttgctgtgcaaccccggcctggcggaactgatcgctgagaagatcggagaggactacgtcaaggacctgagtcagctcacgaagctccactcattcctcggagacgacgttttccttcgggagctggccaaggtgaaacaggaaaacaaactgaaattctcgcagttcctcgaaactgagtataaggtcaagattaacccatcctccatgtttgatgtgcaggtgaaaaggatccatgagtacaagcgccagctgctcaactgcttgcacgtcatcactatgtacaataggatcaagaaagatcctaaaaagctgttcgtgcctcggaccgtgatcattgggggaaaggccgctccgggataccatatggcaaagatgatcatcaaactgatcacgagcgtcgctgacgtcgttaacaacgacccaatggtgggttccaagctcaaggtgatcttccttgaaaactaccgcgtgtcactggcagagaaggtaatcccggcgaccgacctcagcgagcagatctcgactgctggaactgaagcctcaggcactggcaacatgaaattcatgctgaacggtgccctgaccattggaactatggatggggcgaacgtggaaatggctgaagaagccggagaagaaaacctgttcatcttcggaatgagaatcgacgatgtggcggcgttggacaaaaagggttacgaagccaaagagtactacgaggccctccctgaactcaagctggtgattgatcagatcgataatggtttcttttccccaaaacaaccggacctgttcaaggacatcattaacatgttgttttatcacgaccgctttaaagtgttcgctgactacgaggcgtacgtgaaatgccaggataaagtcagccaactgtacatgaaccctaaggcatggaataccatggtgcttaagaatatcgcggcgtccggaaagttctcgagcgaccggactataaaggagtacgcccagaacatctggaacgtggaaccctcagacttgaagatcagcctgtcaaacgaatccaacaaggtcaatggaaac

SEQ ID NO: 250816 - DNA, 2541 bp, Artificial Sequence
  Description of Artificial Sequence: Synthetic coding sequence
atggccaaacctttaaccgaccaggagaagcggcggcaaatcagcatcagaggaattgtgggggttgagaacgtggcggagctgaaaaaatcctttaacagacacctacacttcactcttgttaaagaccgaaatgtagccactacccgagactattattttgccctggcccacaccgtgcgggaccacttggtgggacggtggattagaactcagcaacattattatgataagtgtccaaagcgagtgtactatctgagcttggagttctatatggggcgtacgttacagaatacaatgatcaatctggggctgcaaaatgcctgtgatgaagcaatctatcagttgggcctagacatagaggaacttgaagaaattgaggaggatgccgggcttgggaatgggggtctgggacggctcgcagcgtgcttcttggattccatggccacactgggcctagccgcttatggctatgggatccgctacgagtatgggatttttaatcaaaagatccgcgacgggtggcaggtggaggaggctgacgactggttgagatatgggaacccctgggagaagtctcgtccagaattcatgttgcctgtacacttctacggcaaggtcgaacatactaacacaggaaccaaatggatcgacactcaggtggtgctggcactgccatacgacacccccgtaccaggctacatgaacaacaccgtgaacactatgcgcctgtggagcgctcgggccccgaatgattttaacctcagagattttaacgtgggggattatatacaggctgtccttgacaggaacctggccgaaaatatttcccgcgtgttatatcccaacgacaacttctttgagggcaaggaactaaggctcaagcaagaatattttgtcgtggcagcaacgctccaggatatcatcagacgctttaaagcaagtaagttcgggtctacccgcggcgccgggacagtgttcgacgctttcccagaccaagtggctattcaacttaacgatacccatccagcccttgcaattcctgagctcatgcggatttttgtagatattgagaagctaccttggtctaaggcttgggagctgactcagaaaacctttgcctataccaatcatacagtgctgcctgaagccctcgaaaggtggccggtcgatctcgtggagaagctcctacctcgacatctggaaattatctatgagataaatcagaagcatctggatcggatcgtggcactgtttcctaaggatgtggatcgcctcaggcggatgtcattaattgaagaagaggggagcaaaagaatcaacatggctcatctctgtattgttggcagtcatgccgttaacggtgtggcgaagatccatagcgacatcgtaaagacaaaagtgtttaaggattttagcgagctggagcccgataaattccagaataaaacaaacggcatcacccctcgtagatggctactgctttgtaatcctggcttagcagagctcatagccgaaaaaattggcgaggactacgtgaaggacttgagtcagctgacaaagctgcacagctttttgggagatgatgtcttcttgagagagttggcaaaagtgaagcaagaaaacaagctcaaattctcccaattccttgaaacagagtacaaagtaaaaatcaatccttcatctatgtttgatgtgcaggtcaagcgcattcacgagtacaagcgacagcttttgaattgtctgcatgtgattaccatgtataacagaatcaagaaggatccaaagaaattgttcgtacctcgcaccgtgattatcgggggaaaggccgctcctggataccacatggccaaaatgatcatcaagttaatcacgtcagtggcggacgtggtgaacaacgatcctatggtgggcagcaaacttaaggttattttcctcgagaactatcgagtctctttggccgagaaggttatccctgcgactgacctttctgagcagatctctacagcaggaacagaggccagcggcaccggtaatatgaaattcatgctgaatggtgctctgacaattggcacaatggacggggccaacgttgaaatggcagaggaagcaggcgaggaaaatctctttatattcggcatgagaatcgacgacgtggctgccctcgacaagaagggctatgaagcgaaagagtattacgaagctctgccagagttgaagcttgtaattgatcagatagacaacggtttcttctccccaaaacagcctgatctgtttaaggacataattaatatgctattctaccatgatcgatttaaagtttttgctgactacgaggcgtacgtcaaatgtcaggacaaagtgtcacagctatacatgaatccgaaggcctggaacaccatggtgttaaagaacattgctgcctcaggcaagttctccagcgacaggaccataaaggaatatgcacagaacatatggaatgtggagccttccgacctgaaaatttcactgtccaatgaaagtaataaggtgaacggcaac

SEQ ID NO: 250817 - DNA, 2541 bp, Artificial Sequence
  Description of Artificial Sequence: Synthetic coding sequence
atggccaagccacttactgaccaagagaaaagacgacaaatctcgattcgcggcatcgtgggtgtcgaaaacgtggcagaactgaagaaatcgtttaaccggcatcttcattttacgcttgtgaaggaccgcaatgtggcaaccacccgagattactacttcgcccttgcacacaccgtgcgggaccatcttgtgggtaggtggattcgcactcaacagcattactacgacaaatgccctaaaagagtgtactaccttagccttgaattctacatgggacgtaccctgcagaacactatgataaatctgggcctgcaaaacgcatgcgatgaagcaatttaccaactcgggctggacatcgaggaacttgaggaaatcgaagaggacgcgggcctgggaaacggcgggcttggaaggttggcagcctgttttctggacagtatggccaccctgggactggccgcctacggatacggcatccggtacgaatacggcatattcaaccagaagattcgggatggatggcaagtcgaggaagcagacgactggttgaggtacggaaacccttgggagaagtcgaggcccgagttcatgcttccagtccatttctatggcaaagtcgaacatactaacacgggaactaaatggatagatacccaagtggtgctggcacttccctacgatactcctgtgcctggttacatgaacaacaccgtcaatactatgagactttggtcggcccgggctcctaacgactttaaccttcgggactttaatgtgggagattacatccaggcagtccttgatcgcaacctcgcagaaaacatctcacgggtgctttacccaaacgataacttctttgaggggaaggaacttcggctgaagcaagaatacttcgtggtggcagcaactctgcaggacattatcagaagatttaaggcttcaaagtttggttcgactcgcggtgccggtactgtgtttgatgcatttccagatcaagtggcaatccaacttaacgatactcacccagctctggctatccctgaactcatgaggatttttgtcgatatcgaaaagctcccatggtccaaggcctgggaactgactcagaaaacctttgcatacaccaaccacactgtgcttccagaagcactggaaagatggcctgtggaccttgtggaaaagctcctcccccgacatctggagatcatctacgaaatcaaccaaaagcatctggacagaatcgtggcgctttttcctaaggatgtggataggttgaggcggatgtcccttatcgaagaagagggtagtaagagaattaacatggctcatctgtgtattgtggggtcccatgctgtgaatggagtggcgaagatccatagcgatattgtgaaaacgaaggtgttcaaggatttttccgagttggaacccgacaaattccagaataagaccaatggaattaccccccgcaggtggttgctgctgtgtaaccctggtctggccgagcttattgcagagaaaattggagaggactacgtcaaagatctgagccaactgactaagctgcattcctttcttggcgatgatgtgttccttcgcgaactggcaaaagttaagcaggagaacaaactgaagttttcacaattccttgaaactgaatacaaggtgaagattaatccatcgtcgatgtttgatgtccaagtgaagcgcatccatgaatacaagaggcaactgcttaactgtctccatgtgattaccatgtacaacagaatcaaaaaagacccgaaaaagttgtttgtgccacgtactgtgattatagggggaaaggcagcaccaggatatcatatggctaagatgattatcaaactgataactagcgtcgccgatgtcgtgaataatgatcccatggtcgggtcaaagctgaaggtgattttcttggagaactaccgtgtctcccttgcagaaaaggttatcccagcgacggatctttcggagcaaataagcaccgcgggtaccgaggcaagcggtaccggaaacatgaagtttatgcttaacggtgcgctgaccataggaaccatggatggggcaaacgtggagatggcagaggaagccggggaggaaaatcttttcattttcggaatgaggattgacgatgtcgccgctcttgacaaaaagggctacgaagcaaaggaatactacgaagctctgccagaacttaaactcgtgattgatcagatcgacaacgggttcttttcgcccaagcagcccgatctgtttaaggacataatcaacatgctgttctaccacgatcggtttaaggttttcgcagactatgaagcatacgtcaagtgtcaagacaaagtgagccaactttacatgaatcctaaggcatggaacaccatggtcttgaaaaacattgctgccagcggaaagttttcaagcgatagaactattaaggagtatgcacagaacatatggaatgtggaaccttcggaccttaagattagcctctcaaacgaatcgaacaaggtgaatgggaat

SEQ ID NO: 250818 - DNA, 2541 bp, Artificial Sequence
  Description of Artificial Sequence: Synthetic coding sequence
atggcaaagccccttacagatcaggaaaaacgaaggcagatctccattcgagggatcgtgggcgtcgagaatgtggcggaactgaagaaaagctttaataggcatctacacttcaccttggtgaaggatcgtaacgtggccacaacacgagactattacttcgcgctcgcccacaccgtgcgcgaccaccttgtggggcgttggatcagaacccagcaacactattacgataagtgtcctaaacgagtgtactacctgtctctggaattttacatgggacgaacgctccagaatactatgatcaatctgggcctgcagaacgcctgcgacgaagccatctaccagcttgggcttgacatcgaagagttagaggagattgaggaagatgccggtcttggtaatggggggctgggcagactcgctgcctgttttttggactccatggctacgctaggcctagccgcctatggatacgggataaggtatgagtatgggattttcaaccagaagatccgagatggctggcaggtcgaggaagctgatgactggttgcgatacggcaatccgtgggaaaagtctcgccccgagtttatgctgcccgtgcacttttatggtaaagttgaacatacgaacaccggaaccaagtggatcgatacccaggttgtactggccctgccctacgacaccccagttccaggctacatgaacaataccgtgaacacgatgcgactgtggagtgcaagagcccctaacgattttaatctaagagacttcaatgtcggagattacattcaggcagtgctagatcggaatctggccgaaaatattagcagagtgttgtacccaaacgataactttttcgagggcaaagaactccgactgaaacaagagtattttgttgtagcagccactctccaagacattatacgtcgatttaaagcctcaaaattcgggagcacccgaggggccggtaccgtgttcgatgcatttcctgaccaggttgccatccagcttaatgatacccatccagcactcgcgatcccagagctcatgaggatttttgttgacatcgaaaaactgccctggagtaaagcgtgggaactcacccaaaaaacatttgcatataccaaccataccgtcttgccggaggccctcgaacgatggcctgtggatctggtagaaaagctgctgccacgacacctggagattatctacgagatcaatcagaagcacctcgatcgtatcgtggctctattccctaaagacgttgaccgactgcgaaggatgtccctgatagaggaggagggaagtaaacgaattaacatggcccacctatgtatcgtggggtcacacgcggtaaatggagttgccaaaattcactccgacatcgtcaaaaccaaagtgttcaaggatttctcagagctggaacccgacaaattccaaaacaagactaatggcattacccctcggcgatggctactgctctgcaaccccggtctcgctgaactgatcgccgagaagatcggtgaagattacgtgaaggatctgagccagttgacgaagcttcattccttcctgggggacgacgtttttctacgggaactcgctaaagtgaagcaggagaacaaactgaagttctcccagttcctggagaccgagtataaggtcaaaatcaatccctcatctatgttcgacgtgcaggtgaagcgaatacatgagtacaagaggcaactgctgaattgcctccacgttatcaccatgtacaacagaattaaaaaggatcccaaaaaactgtttgtcccccgaactgtcattattggaggcaaggccgccccaggttatcatatggctaagatgataatcaagttgatcaccagcgttgcagatgtggtaaataacgatccgatggtcggcagcaaactgaaagtaatctttctggaaaactatagagtctctctggctgaaaaggttatcccagccacagatttaagcgaacagatttcaaccgctggcacggaggccagcggcaccggcaacatgaaatttatgctcaatggcgctctcaccatcgggactatggacggcgctaacgtggaaatggcagaagaggccggcgaagagaatctttttattttcgggatgcgaatagatgatgtcgctgctttggacaaaaagggctacgaggctaaggagtattatgaagcgctgcctgaactgaaacttgtaatcgatcagatcgacaatggatttttttcccctaaacagcctgacctcttcaaggacatcatcaacatgttattctaccatgatcgattcaaagtgtttgctgactacgaggcatacgtgaaatgccaagataaggtgagccaactatacatgaacccaaaggcttggaataccatggtgctaaagaacattgctgcctccgggaaattctcctcggatcgcacaattaaagaatatgcacagaatatttggaatgtagaaccgtccgatcttaagatcagcttgtccaacgaatccaataaagtcaatggaaat

SEQ ID NO: 250819 - DNA, 2541 bp, Artificial Sequence
  Description of Artificial Sequence: Synthetic coding sequence
atggccaagcctctgaccgatcaggagaaaagaaggcagatctcgatccggggcatcgttggggttgagaacgtggccgagctcaagaaaagcttcaatagacaccttcatttcaccctcgtcaaggatcgcaatgtggccacgaccagggactactatttcgcactggcacacaccgtccgcgatcatctggtgggacgctggatccggacccagcagcattactacgataaatgccccaaaagagtgtactacctctctctcgagttttatatgggccgaaccttgcagaacactatgatcaacctcggcctgcagaatgcctgcgacgaagccatctatcagcttggcctggacattgaggagctcgaagagatcgaggaggacgcagggctcggaaatggaggcttaggcagactggccgcatgcttccttgatagcatggccactttgggattagctgcatatggttatggaattcgttacgaatacggcattttcaaccaaaagatccgagatggctggcaggtcgaggaagctgatgactggcttcgatacggaaatccatgggagaagtctcgccctgagtttatgcttcccgtgcatttctatggaaaagtagagcacaccaacacaggcactaagtggatcgacacccaggtggtacttgctttgccatacgacacaccagtacctggttatatgaacaacaccgtcaatacaatgcgtctatggtccgcacgggcacccaacgactttaatcttcgggacttcaacgttggtgactacatacaagccgtgttagacaggaacctagctgaaaacatttcacgggtcctatacccgaacgacaatttttttgagggtaaagagctgcgcttgaagcaagagtatttcgttgtcgccgctacgcttcaggatatcatccgccgattcaaggcctcgaagtttggatccaccaggggtgcaggcactgtgtttgacgcctttccagaccaagtggctatccagttaaacgacacacacccagcattagccattcccgagctgatgagaatctttgtggatattgaaaaactgccctggtctaaggcctgggagttgactcaaaagaccttcgcctacactaatcataccgtgctcccagaggctcttgagcgatggccagtcgacctcgtggaaaagctattaccgagacatctcgagatcatctacgagataaaccaaaaacacctcgatcgtattgttgccctgttcccaaaggacgtggacaggctgcgccgaatgagtctgattgaggaggaaggaagcaagaggattaacatggcacatctttgtatcgtcggctctcacgcagttaacggcgtggcaaagatacatagtgatatagtgaagacaaaggtcttcaaggacttctcagaactcgagcctgacaaatttcagaataagactaacgggatcacacctagacggtggttgctactttgtaatcctggactcgcggaattaatagctgaaaaaatcggggaggactatgttaaagatctttcacagctaaccaagctgcacagtttcctcggcgacgatgtattcctgagagagctcgccaaagttaagcaggaaaataaactcaagttctcacagttcctcgagaccgagtacaaggtgaagattaatcccagtagtatgttcgacgttcaagtgaaacgcatccatgaatataaaagacagctgctgaattgtctgcacgtgattaccatgtataatcggatcaaaaaagatcccaagaaactatttgttccaaggacagtcatcatcggcggcaaagccgcaccaggttaccacatggcaaagatgattatcaagctgatcacaagtgttgccgacgttgtgaataatgacccaatggtgggtagtaagttgaaagtcatctttctggagaattatagggtgtctttagccgagaaggtgattcccgccacggacctgagcgagcagatctccactgccggcaccgaggcctctggaactgggaacatgaagttcatgctgaatggagctcttacgatcggtacaatggacggcgcaaacgtcgagatggctgaagaagcaggcgaagagaacctattcatctttggaatgagaatcgatgacgtggctgctctggataagaaaggatacgaagcaaaagaatactatgaggcccttcctgagttgaagctggtaattgatcagattgacaacgggttttttagcccgaaacagccggacctgtttaaagacataattaacatgctcttctatcacgacaggttcaaggtattcgccgattatgaggcttacgtgaagtgtcaagacaaagttagtcagctctatatgaatcctaaggcttggaacacaatggtcctgaaaaacatcgccgcttctgggaagttctcatctgatcgaactatcaaggagtacgcacagaacatctggaatgtagaacctagcgacttaaagatctcactttctaacgagtcaaacaaagtcaatggaaac

SEQ ID NO: 250820 - DNA, 2541 bp, Artificial Sequence
  Description of Artificial Sequence: Synthetic coding sequence
atggctaagccccttacagaccaggagaagagacgtcagattagcattaggggcattgttggcgtcgagaacgtggcagaactgaagaaatcgttcaaccgacacctccactttaccctggttaaggatagaaacgtggcaaccacccgcgattattacttcgccctggcacatactgttagagatcacctggtcgggaggtggattcggacccaacagcattattatgataagtgtcctaagagggtgtactatctctccctggaattctacatgggtaggacgctgcaaaacacaatgattaacttgggcctccagaatgcttgtgatgaagccatttaccagctgggcctcgatattgaggaactcgaggagatcgaggaggacgccggattgggcaatggtgggcttgggaggctcgcggcctgtttcttagacagtatggcaactttgggtctcgccgcctacggatacgggattagatatgagtacgggattttcaaccaaaagatccgcgatggatggcaggtggaggaggctgacgactggttacgctacggcaacccatgggagaaatcccgacctgaatttatgctgcctgtgcatttctatgggaaagtggaacatactaacaccggaactaaatggatcgacacccaagtggtgcttgcgttgccttatgacactcccgtgccagggtacatgaacaacaccgtgaatacgatgcgcctctggtccgcccgggcccccaatgacttcaacctgcgggacttcaacgtaggagactatatacaggcggtgctggaccgcaatctagcagaaaatatatcccgagtgctctatcctaacgataacttctttgagggcaaggagctgcggttgaagcaggaatactttgtggtggctgccactttgcaggacataattagaaggtttaaagcatcgaaattcggaagtactaggggtgccggaacagtgttcgacgccttcccagatcaggtagctattcagctgaatgatactcacccagcgttagccattcctgagcttatgcgcatcttcgtcgacatcgagaagttaccctggagcaaggcctgggagctgactcagaagacgtttgcttatactaaccatacagtgctgcccgaagctctcgagcgatggccagtagacttagtggaaaaattgctgccgcgtcatcttgagatcatttacgagatcaaccaaaagcacctcgacaggatcgttgccctctttccaaaagacgtggaccgcttgcgtcggatgtctctgatagaggaggagggctctaagaggatcaacatggcccacctgtgtattgtgggaagtcacgccgtcaacggcgtggcaaagatacacagtgatatcgtgaaaaccaaagtgtttaaggactttagtgaactggagcccgacaaatttcagaacaagacaaatggcattacccctcggcgatggctgcttctgtgcaaccccgggctggctgagctgattgctgagaaaataggcgaagattatgtgaaagacctcagccagctgacgaaactccatagtttcctgggtgacgatgtgtttctgcgggagttggctaaggtcaaacaggagaacaaacttaagttctcccagttcctggaaaccgagtataaggtaaagatcaatccaagttccatgtttgacgtacaggtcaagcgcatccacgagtataagagacagctgctgaactgtctacacgtcatcacgatgtataaccggatcaaaaaagacccgaagaagctctttgtccctaggacagtgatcatcggcggcaaagcggcccctgggtatcacatggcaaagatgatcatcaagctgatcacgagcgtggccgacgtggtgaataatgaccctatggtgggctcaaagctgaaagtgattttccttgagaactatcgtgtatcattggcggaaaaggtgatacctgccacagacctctcagaacaaatttctacggccggcacggaggcctcgggtacaggaaacatgaagttcatgttgaacggagctctcacgattgggaccatggatggcgcaaatgtcgaaatggcagaagaagctggtgaggagaacctattcatcttcgggatgaggattgacgacgtcgccgctctagacaagaaggggtatgaagctaaggaatattacgaggctctgcctgaactgaagcttgtgatcgatcaaattgacaacgggtttttttcacccaagcaaccagatttgtttaaagatatcatcaatatgctgttttaccacgacaggttcaaggtgttcgctgattatgaagcctacgtcaaatgtcaggacaaggtctcccaactgtatatgaaccccaaggcctggaatacaatggtcttgaagaatattgcagcctcaggaaaatttagctcagatcggacaatcaaggagtacgctcagaacatctggaatgttgagccaagcgacctgaaaatttccctgtctaatgagagtaataaagtaaatggaaat

SEQ ID NO: 250821 - DNA, 2541 bp, Artificial Sequence
  Description of Artificial Sequence: Synthetic coding sequence
atggctaagccacttactgaccaggagaaaaggaggcagatcagcattcggggaatagttggcgttgagaatgttgcggaactgaagaagtcatttaataggcacctgcatttcacactggtaaaggaccgcaacgttgctaccaccagggactactacttcgcgttagcccatacagtccgggatcatctggtgggacgatggatccggacacagcaacattactacgacaaatgcccaaagcgggtctattatcttagtctggagttctatatgggtagaaccctccagaatacaatgattaaccttggcctgcagaatgcatgtgatgaggctatctatcagctgggtcttgacatcgaagagctagaggagatagaagaagacgcgggactgggaaacggtggattggggagactcgcagcatgctttctcgatagcatggccaccctgggccttgcggcctacggctacggtatcagatacgaatacgggatctttaaccagaaaattcgggacgggtggcaggtcgaggaagcagatgactggttgcggtatggaaatccttgggaaaagagccgaccagagttcatgctgcccgtgcacttctatggaaaggtggagcatacaaatacaggtacaaagtggatagatactcaggttgtcttagcattgccctacgacacccctgtgcctggttacatgaacaacaccgtaaacaccatgcgactgtggagcgcccgggccccaaacgacttcaacctccgtgattttaacgtgggggactacatccaagccgtgctggatagaaacctggctgaaaacattagccgcgttctataccccaacgataactttttcgaaggcaaagagctgaggttaaaacaggagtactttgtggtggccgcgacactacaagatattatcagaaggttcaaagcctctaaatttggtagcacaaggggtgctggaactgtgtttgacgcctttcccgatcaagtggctattcagttgaacgacacccaccctgctttagcaatccccgagttaatgcgcatatttgtcgacattgaaaaacttccctggtccaaggcctgggaactgacccaaaagacatttgcgtatactaatcatactgtgttgccagaggccctagagcggtggcccgtagacttggtggagaagttgctccctaggcatctcgagatcatttacgaaataaatcaaaaacaccttgacaggattgtagcactgtttcccaaggatgtcgatcgactgcgaaggatgagcctgatcgaggaggaggggtccaagcggatcaatatggcccacctgtgtatagtgggctctcatgctgtgaacggggtggcgaaaatccattcagacatagttaaaacgaaagtcttcaaagatttctccgaactggaaccagacaagttccagaacaaaacgaacggcattactccccggcgctggctgctcctgtgcaacccgggacttgcagaactcattgctgagaagatcggggaggactatgtgaaagatctttcccaactgaccaagctccattctttcctgggggacgacgtgttcctcagagaattagccaaggtgaagcaggagaacaagctaaaattctctcagttcctggaaaccgaatacaaagttaagataaacccctcaagtatgtttgacgtacaggtgaaaaggatccacgaatataaaagacagctgcttaactgcctacacgtgattactatgtataacaggattaagaaggatcctaagaaacttttcgttccgcggactgtcattatcggaggtaaagcagcccctggctatcatatggcaaaaatgatcataaaactgatcacatctgtagccgacgtggtcaacaacgacccaatggtgggatctaaactgaaggtgatctttctggaaaactacagggtctctctcgcagagaaagtgatccccgccacagatctgagtgaacagatctctaccgccgggacagaagccagcgggacagggaacatgaaattcatgctcaatggcgcccttaccatagggacaatggatggggcgaacgtggagatggccgaagaggccggtgaggaaaacctcttcattttcggtatgaggattgacgacgtggctgccctggataagaagggttacgaagccaaggagtactatgaggcattgccggaactaaaattggtcatagatcaaattgacaacggctttttttcacctaaacagccggatctcttcaaggatatcataaacatgttgttttaccacgatagattcaaggtctttgccgattatgaagcttatgtcaagtgccaggacaaggtttcccaactatatatgaatccgaaggcatggaatacaatggtgttgaaaaacatagctgcttctggcaagttctcttctgataggaccattaaggagtatgctcagaacatttggaacgtcgaaccttcggatctgaaaatctccctgagtaacgagtccaacaaggttaacggtaac

SEQ ID NO: 250822 - DNA, 2541 bp, Artificial Sequence
  Description of Artificial Sequence: Synthetic coding sequence
atggcaaaacctctcaccgaccaagagaagcgtcggcaaattagcattcgcggtatcgtgggagtggaaaacgtcgcggagcttaagaagtcttttaacagacacctccacttcaccctggtgaaggatagaaatgtggcgactactagggactactacttcgccctggcgcataccgtgcgggatcacctcgtgggacgctggatccggacccagcaacattactacgacaaatgtccaaaaagggtttactatcttagcctcgaattctatatgggacgcacccttcagaatactatgattaatctgggtctgcagaatgcgtgcgacgaagccatctaccagctgggactggacatagaggagcttgaagaaatcgaggaggacgccggactcggaaacggtggactgggacgactcgccgcctgttttctggattccatggcaacgctgggtctggccgcttacggatacggtattagatacgaatacggaatctttaaccagaagatccgggatggatggcaggttgaggaagctgacgactggttgcgctacggaaatccctgggagaagagccgcccggaattcatgctgccggtccatttctacggaaaggtggagcacaccaatactggcactaagtggatcgatacccaagtggttctggctctgccttacgacaccccggtgccaggctacatgaataacactgtcaatactatgcgcctgtggagcgcacgggcgccgaacgacttcaacctgcgggatttcaacgtgggcgattacattcaagcagtactcgaccgcaacctggccgagaacatctccagggtgctctacccaaacgacaactttttcgagggaaaagaactccggcttaagcaggaatacttcgtggtggcggccaccctccaggacatcattagaagatttaaggcgtcgaagttcggatcgacccgcggcgccggcaccgtctttgacgctttcccggatcaggtcgcgatccagctgaacgatactcatccagcgctggcaattccggagttgatgcggatcttcgtcgatatcgaaaagttgccgtggtccaaggcttgggaattgacccaaaagacgttcgcatacactaaccacaccgtgctgcctgaagctctggagcgatggccggtagaccttgtggaaaagctcctgcctcggcacctcgagatcatctacgaaatcaatcaaaaacacctggataggatagtcgccctgttccccaaggacgtcgatcgcttgaggcgcatgtcgctgatcgaagaagaaggatcgaagcgcatcaacatggctcatttgtgtatcgtcgggtcacatgcggtcaatggggtggctaaaatccacagtgacatcgtcaaaacgaaggtgtttaaggatttctcagagctggagcccgataagttccagaataagaccaacggcatcaccccgcgccgttggctgttgctgtgcaacccaggactggcggagctcatcgcggagaaaatcggcgaagattacgtgaaagaccttagtcagctgaccaagctgcacagctttcttggcgatgacgttttcctccgggaacttgcaaaagtgaaacaagaaaacaagctgaagttttcccagttccttgaaaccgaatacaaggtgaagattaacccttcaagcatgttcgacgtgcaggtgaaacggatccacgagtacaaacgccagctcctgaactgtctccatgtcatcactatgtacaatcggatcaagaaggacccgaagaagctgtttgtcccgaggactgtgattatcggcggaaaagccgcgccgggataccacatggccaaaatgatcattaagctgatcacttccgtggccgacgtcgtgaataacgatcctatggtcggctcgaaactcaaggtcatctttctggagaactatagagtgtccctggctgaaaaggtgataccggctaccgatctctcagagcagatctctactgccgggaccgaggcttccggcactggaaatatgaaattcatgctgaatggtgcactcactatcggaacgatggatggcgcaaatgtggaaatggccgaggaggcgggtgaagaaaacctgtttatcttcggtatgcgcattgacgatgtggcagcactggacaagaaaggttacgaagcgaaggaatactacgaggccctccctgaactgaagctggtgatcgaccaaatcgataatggattcttctcgccgaaacagcctgatctgttcaaagacatcatcaacatgctgttctaccacgacagattcaaggtgttcgcagactacgaggcctatgtgaagtgccaagataaggtgtcgcagctttacatgaacccaaaagcctggaatactatggtgttgaagaatatcgccgcttcagggaaattctcttcggatagaactataaaggaatacgcccaaaacatctggaatgtggagccatcggacttgaagatctctctctccaacgagtcgaacaaggtgaatggaaac

SEQ ID NO: 250823 - DNA, 2541 bp, Artificial Sequence
  Description of Artificial Sequence: Synthetic coding sequence
atggctaaaccattgaccgatcaggaaaaacggcggcaaatttctataagaggaattgttggtgtcgaaaacgttgccgaactgaaaaagagcttcaaccgccatctccatttcacgcttgtaaaagatcgtaacgtggctaccaccagggattactattttgctctcgctcacacagtgagagatcacctagtgggacgttggattcggacgcagcagcattattatgataaatgtcccaagcgagtttactacctatctctcgagttctacatgggccggactctgcagaataccatgatcaatctgggcctccagaatgcatgtgacgaggcgatctaccagctcggtctggacatagaggagttggaagagattgaagaggacgcgggcctgggcaatggcgggctaggtagactagccgcctgttttcttgactcaatggccacactgggcctagccgcctacggctacgggatcaggtatgagtatggcatttttaaccagaagattcgcgatggctggcaggtggaagaagcggatgattggctccgctatggcaatccttgggagaagagcaggccagagtttatgcttcctgtgcacttttatggcaaggtcgagcacaccaatacaggaactaaatggatcgacactcaggtagtgcttgccctcccgtacgacaccccagttccaggttacatgaacaatactgttaacactatgagattgtggagcgcccgcgctcccaatgatttcaacctgcgggatttcaacgtcggcgactacatccaggccgtcctagataggaatttggcagaaaacatttcccgggtgctgtacccgaatgataatttctttgaaggtaaggagctgaggcttaagcaggagtatttcgtcgtggctgccaccttgcaggatatcattaggcggtttaaagctagcaagttcgggtcaaccagaggggccgggacggttttcgatgcattcccagaccaggtcgcgattcaactgaacgatactcaccctgctttggctatcccggagctgatgcggatcttcgtcgacatcgagaagctcccttggagtaaggcttgggaactgacgcagaaaacattcgcttataccaatcataccgtgctcccggaagctttggaaagatggccagtggacttagttgaaaaactactgccccggcatttggagattatctatgaaatcaaccagaagcatctggatcgcattgtcgcgctgtttccgaaggacgttgatcgtctgcgtcggatgtcccttattgaagaggagggaagtaaacgtattaatatggctcacttatgcatagtgggatcccacgccgtgaacggggtggccaagatccactcagatattgtgaagactaaggtgttcaaagatttttctgaactggagccagataagtttcaaaacaagacgaacggtattacgccccggagatggttgttgctttgcaaccctgggctcgctgagctgatcgccgagaagatcggagaagattacgtaaaagatctatcccagctcacaaagctccacagtttcctgggggatgacgtattcttgcgggaattggctaaagttaagcaggagaataagctgaagttctcccagttccttgaaaccgagtacaaggtgaaaataaacccgtcttcaatgttcgacgttcaggtcaagagaatccacgagtacaaacggcagcttctcaactgcttgcacgttatcaccatgtataaccgcatcaagaaggacccaaaaaaactgtttgtgccgagaaccgtgattatcggcggaaaggcggcccccggttaccatatggctaagatgattataaaattgatcaccagtgtcgctgatgtcgtgaataatgaccctatggtaggcagcaagctgaaggtgatattcctggagaattatcgcgtctcactggccgagaaagtcatccccgcgacggatctgtctgagcagataagcacagccggcaccgaagcctcaggtaccggcaacatgaaattcatgcttaatggtgctttgacaataggcactatggatggggcgaacgtagaaatggctgaagaagcaggagaagagaatctcttcatttttgggatgcggatcgacgacgtggccgctctggacaagaagggctatgaggccaaggagtactacgaggccttgcctgagctcaagctggtgattgaccagatcgataacgggtttttcagtccaaaacagcctgatctttttaaagacataatcaacatgctcttctatcacgaccgcttcaaagtctttgcagattacgaggcctatgtgaaatgccaggacaaggtgagccagctttatatgaaccccaaggcttggaacacaatggtcctgaaaaacatcgctgctagcgggaaattctctagcgacaggacgatcaaggagtatgcccagaacatctggaacgtggaaccaagcgatttgaagatctcattatctaatgaatccaataaagtgaacggcaac

SEQ ID NO: 250824 - DNA, 2541 bp, Artificial Sequence
  Description of Artificial Sequence: Synthetic coding sequence
atggcaaagccactcaccgatcaggaaaagcggcgccagattagcattagaggtatcgtgggagtcgaaaatgtggcagaactgaagaaaagtttcaataggcaccttcattttacgctggtgaaggatagaaatgtggcaactaccagagattactacttcgcactcgcacatactgtccgagatcatcttgtgggaaggtggatcaggacgcagcaacattactacgacaagtgccccaagcgggtgtactacctctcactggagttttacatgggcagaacccttcaaaacactatgattaacttggggctccaaaatgcctgcgatgaggcaatataccaactgggcttggacattgaagagctcgaagaaattgaagaagatgcaggactcggaaacgggggccttggtcgacttgccgcgtgttttctggattcgatggccaccttgggactggcggcttatggttacgggatccggtacgaatatgggatctttaaccaaaagatccgcgacggatggcaagtggaagaagcagacgattggctccgttacggaaatccgtgggaaaaatcacggcccgaattcatgctccctgtccacttctacggtaaagtcgaacataccaatactggaaccaagtggatagatacgcaagtggtccttgcattgccttacgacacgcctgtgccgggatacatgaacaacaccgtgaatacgatgcgactctggtcggctcgtgctccgaacgactttaatctcagggacttcaacgtgggagactacatacaggccgtgttggatagaaatcttgccgaaaacatctcgcgtgtgctttatccaaatgacaactttttcgaggggaaagagctgcgactgaaacaggaatacttcgtggtcgcggcaaccctgcaagacatcattcggaggttcaaggcgagcaaattcggttccactagaggcgcaggtaccgtttttgatgccttcccagatcaagtggcaattcaactgaacgatacccaccctgccctcgcaattcctgaacttatgaggatttttgtggatattgagaaattgccttggtccaaggcctgggaattgactcaaaagacctttgcctacactaatcacaccgtgcttccagaggcgcttgagaggtggccagtggatctcgtcgagaaactcctcccaaggcacctggagattatctacgagattaatcagaagcatctggaccgtattgtggccctctttccaaaggatgtggacagacttcggaggatgtcattgattgaagaggagggatccaagaggataaacatggcgcacctttgcatcgtcggatcgcatgcagtcaacggcgtcgctaagattcatagcgatatcgtcaaaaccaaagtctttaaggatttttcggaactcgagccggacaaatttcagaacaagaccaacggaattactcctcggaggtggctcctgctgtgtaatccgggtttggctgaactgattgccgaaaagatcggtgaagattacgttaaggatctgagccaacttaccaagctccattcatttcttggagatgacgtgtttctccgagaacttgcaaaggtgaagcaagagaacaagctgaagttttcacaattccttgagactgaatacaaagtcaagattaaccctagttcgatgtttgatgtgcaagtgaagcggatccatgagtataagcggcagctgcttaattgtctgcatgtcatcaccatgtacaaccgcatcaagaaagaccccaagaagttgtttgtgccacggactgtgattatcggagggaaagcagcgccaggttaccacatggccaagatgatcataaagctgataactagcgtggccgacgtggtgaacaatgatccgatggtgggcagcaagctgaaggtcatatttctcgagaactacagggtgtccctggcagaaaaagtcatccctgcaactgatcttagcgagcagatatctactgccggaacggaggcatcgggtaccgggaatatgaagtttatgcttaatggagcgctgacgattgggaccatggatggggcaaacgtggaaatggccgaagaagcgggtgaagaaaatctcttcatcttcggcatgagaattgatgatgtggcagccctggacaaaaagggatacgaagcaaaggaatactatgaagcattgccagaactgaaactggtgatagatcaaattgataacggctttttcagccctaagcagcctgacctgtttaaagacattatcaacatgctcttttaccatgatcgcttcaaggtgttcgcagattacgaggcgtacgtgaagtgtcaagataaggtatcgcaactgtacatgaacccaaaggcttggaacactatggtccttaagaatatcgcagcttcaggaaagttttccagcgaccgcactattaaggagtacgctcagaacatttggaacgtggagccgagcgatctcaagattagcctttccaacgagtccaataaagtcaacggtaac

SEQ ID NO: 250825 - DNA, 2541 bp, Artificial Sequence
  Description of Artificial Sequence: Synthetic coding sequence
atggcaaagccgctaacggatcaggaaaaacgccgtcaaattagcatccgtgggatagtgggcgtagagaatgtggcagagctcaaaaaatctttcaatcgacatctccacttcaccctggttaaggatcgcaatgtcgccaccacgcgggactattattttgccctggcccacactgtgcgggaccaccttgtcggccgttggatcaggacccagcagcactactacgacaaatgtccaaagagggtgtactatctctcgctggaattctatatgggcagaactctgcagaataccatgattaatttaggactgcaaaacgcctgtgatgaggctatctaccaactgggcctcgatatagaggagctggaagagattgaagaagacgctggattggggaacgggggccttggcaggcttgcagcctgttttctcgattctatggctacgctgggtctagccgcatacggctatggaataaggtacgaatatggaatcttcaaccagaagatacgcgatgggtggcaggtggaggaagcagatgattggctgcgctatggaaacccttgggagaagtcccgaccagaatttatgctgccagtgcacttttatggtaaggtggagcacacaaacacaggcacaaaatggatcgatacccaggtggtgctcgcattaccatatgatactccagttccagggtatatgaacaataccgtgaacactatgcggctctggagcgcgagggcaccgaatgactttaacttgagggatttcaacgtgggggactacatccaggcagtgcttgacagaaatctcgccgagaacatcagtcgagtactatatcctaacgataatttctttgaaggcaaggaactgagactcaaacaagaatactttgtagttgctgcgacactgcaggacatcattcgccgattcaaagcttccaaattcggttctacgcgtggagccggtaccgtgtttgacgcattccccgatcaagtggcaattcagctgaacgacacacaccccgcactggcaatccccgagctgatgcggatttttgtggacattgagaaactcccatggtcaaaagcctgggagctgacgcagaagaccttcgcttacactaaccatactgtcctgccagaagcccttgagcgctggcccgtggatctggtcgagaaattactgccacgccatctggaaattatctacgaaattaatcaaaagcacctggatcgcattgttgcgctgtttccaaaggacgtggatcgcttgcgcagaatgagcctcatcgaggaagaaggaagcaagagaataaatatggcccacctttgtatcgtaggatctcacgcggttaatggtgtagccaaaattcatagcgacatcgtgaaaactaaggtgttcaaagacttcagcgaattggaaccggataagtttcaaaacaagaccaatggaattacccctcgaaggtggttgctgctctgcaatcccgggcttgcagagcttatcgctgagaaaatcggtgaggactacgtgaaagatctgtctcagctgacaaagttgcatagttttttgggcgatgacgtcttcttacgggaactggcaaaggttaaacaggagaataagttgaaattctcacagttcctggaaacggagtacaaggtaaagatcaacccatcgtccatgtttgatgtgcaggtgaaaagaatacacgagtacaagaggcaactgttgaactgcctgcacgtgatcactatgtacaataggatcaagaaggaccctaaaaagttgttcgttccgcgaactgttatcatcggaggtaaggctgcaccagggtaccacatggctaagatgatcatcaaactaataacctccgtagccgacgtggtgaacaacgatccaatggtggggagcaaattgaaagttatctttctggaaaactatcgtgtgagcctcgcagaaaaggtgattcccgctactgatttgtctgagcagatctctaccgctggaactgaggcctctggcaccggcaacatgaagttcatgctgaatggcgccctcaccatcggcacaatggacggggcgaacgttgagatggcagaggaagcaggcgaggagaacctgtttattttcggcatgcgtatcgatgatgtggctgccctagacaaaaaaggctatgaagccaaggagtattacgaagccctgcccgagctgaaacttgtgatcgaccagattgataatggcttcttctccccgaagcaacccgatctgttcaaagacattattaatatgctgttttaccacgacagattcaaagtttttgccgactatgaggcctatgtgaagtgccaggacaaagtcagtcagctgtatatgaaccccaaggcctggaatacaatggttctgaagaacatcgccgcctcaggaaagttctctagtgatcggactataaaggaatatgcccagaatatttggaacgtggaacctagcgacctgaagatcagcctgagcaatgagtccaataaagttaatgggaac

SEQ ID NO: 250826 - DNA, 2541 bp, Artificial Sequence
  Description of Artificial Sequence: Synthetic coding sequence
atggccaagcctctgactgaccaagaaaagcgacggcaaatttccatccgcggaatcgtcggtgtggagaacgtcgccgaattgaaaaagtcgttcaaccggcacttgcacttcaccctcgtgaaggacagaaatgtggcgaccacccgcgactactacttcgctttggcccacaccgtgcgggaccatctcgttgggcggtggatccggactcagcagcattactatgacaagtgcccaaagagagtctactacctctccctggagttttacatgggcagaaccttgcaaaacacgatgatcaacctcggtctgcaaaacgcgtgtgatgaagcgatttaccagctgggccttgatattgaggagctggaggagatcgaggaggatgccgggctgggaaacgggggactgggacgtcttgccgcgtgtttcctcgactcaatggcgacgctgggattggcggcatatgggtacggaatcagatacgaatacggtatcttcaaccaaaagatacgagatggatggcaggtggaagaagcggacgattggcttagatacgggaacccgtgggagaagtctcgacctgagttcatgcttccggtgcacttttacggaaaggtcgaacataccaataccggaactaaatggattgatactcaagtggtgttggcgctcccgtacgatactccagtgccgggctacatgaacaacaccgtgaacaccatgagactgtggtccgctcgcgccccgaacgatttcaatctgagagacttcaacgtgggagactacatccaagccgtgctcgacagaaatctggcagagaatatctcaagggtcctttaccccaacgataactttttcgagggaaaggaactgaggctgaaacaggagtacttcgtggtggctgcgactctgcaagacatcatacgccgattcaaagcgagcaaatttggctccactagaggtgcgggaaccgtgttcgacgcattcccggaccaggtggctattcagctgaacgacacccaccctgcactggcaatcccggaactgatgaggatctttgtggacatcgaaaagctcccgtggagcaaggcgtgggagttgacgcagaaaacctttgcttataccaatcatactgtgctcccagaagctctggagcgctggccagtggatcttgtggaaaagctcctccctcgccacttggagatcatctacgagatcaaccagaaacaccttgatcgcatcgtggctctgttccctaaggacgtcgatcgcctccgcagaatgtcccttatcgaagaagagggatcaaaacgcatcaatatggcgcacctctgcatcgtgggttcacacgccgtcaatggcgtcgcgaagatacattcggacatcgtcaaaacgaaggtctttaaggatttttccgaattggaaccggataagttccagaacaaaaccaatggaattactcctcgccgctggctgctgctctgcaatccgggactggccgaattgatcgctgaaaagatcggggaggactacgtcaaggatcttagccaactgaccaagctccactcgttcctcggcgatgacgttttcctgcgtgaactggccaaggtgaagcaggagaataagttgaagttttcacagtttttggaaaccgaatacaaggtcaagatcaatccaagcagcatgtttgatgtccaggttaagagaattcacgagtacaagcggcaacttctgaactgtctgcatgtcattactatgtacaaccggattaagaaagacccgaagaaactgttcgtcccgcgaactgtgatcatcgggggaaaggccgctccgggttatcatatggcaaagatgatcatcaaactgatcacctccgtggcagatgtcgtgaacaatgatccaatggtgggatcaaagctgaaggtcatttttctcgagaactaccgggtgagcctggccgaaaaggtgatccctgccaccgacctctcggaacagatctcgacggccggcactgaagcctcgggaactggaaacatgaagttcatgctgaacggagctcttactatcggcactatggatggcgccaacgtcgaaatggccgaagaggccggagaggaaaatctgttcatctttggtatgagaatcgacgacgtggctgcgttggacaagaaaggatacgaggccaaagaatactacgaggctctgcccgagctgaagctcgtcatcgaccaaatcgacaacggcttcttctcgccaaaacagccagacctgttcaaagacatcatcaacatgctcttttaccacgatcggttcaaagtgttcgcagactacgaagcatacgttaagtgccaagataaagtctctcagctgtatatgaatcctaaagcctggaatactatggtgttgaaaaacatcgctgcctcagggaagttctccagcgatcggactatcaaagaatacgcgcagaatatctggaacgttgagccgtccgatctgaagatctcgctgtcgaacgaatccaacaaggtgaatgggaac

SEQ ID NO: 250827 - DNA, 2541 bp, Artificial Sequence
  Description of Artificial Sequence: Synthetic coding sequence
atggcaaagccactgactgaccaggagaagcggaggcaaatctcaatccgcggaatcgtcggagtggagaacgtcgcggagctcaagaagtccttcaatagacacctccacttcaccctcgtgaaagatcggaatgtcgccaccactcgggattactacttcgcgcttgctcacaccgttagggatcatctggtcggacggtggatcaggacccaacaacactattacgacaaatgcccgaaacgcgtgtactacctgtcactggaattctatatgggacgcactttgcagaacactatgatcaacctgggacttcagaatgcttgtgatgaagccatctatcagctgggactggacatcgaggaactggaggaaatcgaagaggacgctggcctcggtaatggaggtttgggtcggctggcggcctgcttcctggactccatggcaaccctgggactggcagcgtacggatacggaattcggtacgaatatggaatcttcaatcagaaaatccgagacggatggcaagtcgaggaggccgatgattggctccgctacggcaacccttgggagaagtcaagacctgagttcatgctcccggtgcacttctatggcaaggtggagcatacgaacaccggaactaaatggattgacacccaagtggtgttggccctcccttacgataccccggtgccggggtacatgaacaacactgtgaatactatgcgcctgtggtcggcaagggcaccgaacgacttcaacctgagagatttcaacgtcggcgactacatccaggccgtgctcgaccgcaacctggcagagaacatttcccgggtgctttacccgaacgacaatttcttcgaaggaaaggagttgcgccttaagcaggaatacttcgtggtcgcggcaactcttcaagacatcatccggagattcaaggcctcgaagttcggaagcactcggggagcgggcaccgtctttgacgcatttccggatcaggttgcaatccaacttaacgatacccacccagccttggcaatccctgaactgatgcgaatcttcgtcgacatcgaaaaactgccttggtcaaaggcttgggaactgacccagaaaaccttcgcgtacaccaatcataccgttctgccggaagccctcgaaaggtggccggtggacctggtggagaagctgctcccgcgccacctggagatcatctacgagattaatcagaagcatctggacagaatcgtggccctgtttccaaaggacgtggaccgcctgaggcggatgtcactgatcgaagaggaaggttcgaaacgcatcaacatggctcatttgtgcatcgtcggaagccacgctgtcaatggagtggctaagattcattcagacatcgtgaaaacgaaggtgtttaaggacttctccgagctggagccagacaaattccagaacaaaactaatggcatcaccccgaggagatggcttctgctctgcaatccgggcctggcggaactgattgccgagaaaatcggggaagattatgtgaaggacctgtcacagcttactaagctgcattccttcctgggcgatgatgtgttcctcagagaactcgcgaaagtcaaacaggagaataaactcaagttctcccagttcctggaaaccgaatacaaggtgaaaatcaacccgtcctccatgttcgacgtccaagtgaagcgcattcatgaatacaaacggcagctgctcaactgcctgcacgtcattaccatgtacaaccgcatcaagaaggatccgaagaagttgttcgtgccacgcaccgtcattatcggaggaaaggcggctccgggctaccatatggcaaagatgatcatcaagctcatcacctcggttgcagatgtcgtgaacaatgacccaatggtgggatccaaattgaaggtgatcttcctggaaaactacagagtgagcctggcggaaaaagtcatccctgccacggacctttcagaacagatctcgaccgctggaactgaagctagtggaacgggaaacatgaagttcatgctcaatggagctctcaccatcgggactatggatggcgccaacgtggagatggcggaggaagcgggagaagagaatctgttcatctttgggatgagaattgacgacgtggcagcgctcgacaagaagggatacgaagccaaagagtattacgaggcactcccagagctgaaactcgtcatcgatcaaattgacaacggattcttctcgccgaaacagccagacctgttcaaggacatcattaacatgctgttttaccacgaccgctttaaggtgttcgccgactacgaggcgtacgtgaagtgccaggacaaagtgtcgcaactctacatgaacccgaaggcatggaatactatggtgctgaagaacatcgctgcaagcgggaagttctcgtccgacagaactatcaaagagtatgcgcagaacatctggaatgtggagccgtccgatctgaagatcagcctgagcaatgagtccaataaggtgaacggcaac

SEQ ID NO: 250828 - DNA, 2541 bp, Artificial Sequence
  Description of Artificial Sequence: Synthetic coding sequence
atggctaagccactcaccgaccaagagaagagacgacagatcagcatccggggaatcgtcggagttgagaacgtagctgagctgaaaaagtccttcaaccgacacctgcacttcacactggtgaaagataggaacgtagctaccactagggattattacttcgctcttgcacacactgtgagggaccatctggtgggcagatggatccgcacccagcagcactattacgataagtgtcccaagagggtgtactacctgtctctcgaattttacatggggcgaacactccaaaacactatgattaatctgggtctgcagaatgcgtgcgatgaagccatttaccagctcggattggatattgaggagctggaggagattgaggaagatgctggtctggggaacgggggcctgggtcggctggccgcgtgcttcctggattcgatggcaactcttggcctcgccgcgtacgggtatggcatacgctatgaatatgggatctttaatcagaagatccgcgacggctggcaggtggaagaggcggatgattggcttaggtacggaaacccctgggaaaagagccgtccagagtttatgctacccgtacacttctacgggaaagtcgaacacactaacactggcactaagtggattgatactcaagtggttctcgccctaccttatgacacccctgtgccgggatacatgaataacaccgttaacaccatgcgcttgtggtctgcaagagcccccaatgactttaatttgcgcgactttaatgttggtgattatatccaggcggtcctcgaccgtaatctggctgaaaatattagccgcgtgctttaccccaatgacaactttttcgaaggtaaggaactgaggctgaagcaagaatatttcgtggtcgcagcaactctgcaggatatcatccgccgtttcaaagcctcgaagtttgggtcgacacggggggctggaaccgtgttcgatgcttttcctgatcaggtggccattcagcttaatgacacacatccagccttagccattccagagttgatgcggatcttcgtcgacatcgagaagctgccatggtccaaggcgtgggaactgacacaaaaaacgttcgcatacacaaaccatactgtccttcccgaggccttggagcggtggcctgtggatttagtggaaaaactgctgcccaggcatctggaaataatctatgagattaaccagaaacacctcgaccgcatcgtcgcgctgtttcccaaggatgtagaccggctccgacggatgtctctaattgaagaagagggaagcaaaagaattaacatggcacatttgtgcatagtgggaagccatgcggtaaacggagtagctaagatccattccgatatcgtcaagaccaaagtgtttaaggatttcagcgaactggagcccgataagttccaaaataagactaatggcattactccgcgacgctggctgctcttatgcaatcctgggttggctgaactgatagcagaaaagattggtgaggactacgttaaagacctgagtcaactgaccaagttgcatagtttcctgggagatgacgtttttctccgagaattggctaaagttaaacaagagaacaaactgaagttctcacagttcctggagactgagtataaggtgaaaattaatccttcttcaatgttcgacgtgcaagtcaaacggattcatgaatacaagcgccagctcttaaactgcctacatgtgatcactatgtacaataggatcaaaaaggatcctaagaaacttttcgtgccacggactgtcattattgggggcaaggcagccccggggtaccatatggctaaaatgatcattaaactcatcacaagcgtggcagatgtcgtgaacaacgatcccatggtaggctccaaactgaaagtgatcttcctcgaaaattacagagtctccttggccgaaaaagtcatccccgcgaccgatttgagtgagcagattagtactgcgggcacagaggcgtctgggacaggcaatatgaaattcatgctcaatggagccctgaccattggtaccatggatggggccaacgtagagatggcggaagaagctggcgaggagaatctgttcatttttggcatgaggatcgacgacgtggcggctctggacaagaagggatatgaggccaaggaatattatgaagccttgcctgagctgaaattagtcatcgaccagattgataacggattctttagtccgaaacagcccgacctgtttaaggacataattaacatgctcttttaccacgacaggttcaaggtgtttgcagactacgaagcgtacgttaaatgtcaggacaaggtcagccagttgtacatgaatccaaaggcttggaacaccatggtgctcaaaaacatcgccgcatccgggaaatttagctctgatcgcactattaaagagtacgctcagaatatctggaatgtggagccctctgacctaaagatctccttgagcaacgagagcaacaaggttaatgggaat

SEQ ID NO: 250829 - DNA, 2541 bp, Artificial Sequence
  Description of Artificial Sequence: Synthetic coding sequence
atggcgaagccgctgacggatcaggagaagcgacgccagatctccatccgcggaatagttggcgtggaaaacgtggcagagcttaagaagtccttcaacaggcacctgcactttacgcttgtcaaggatcggaacgttgctaccacccgggactattacttcgcgctggcgcacaccgtgcgggaccacctggttgggcgctggatcaggacccaacagcattactacgacaaatgccctaagcgcgtgtactacctgagcctcgagttctacatgggaagaacgttgcaaaacaccatgattaatctgggtctgcagaacgcgtgtgatgaggccatctaccagcttggactggacatcgaagaactcgaggaaatcgaggaagatgctgggttgggaaatggcggcctcggacgcttggcagcttgcttcctggattcgatggcaactttgggactcgccgcctacggatacggcatccggtacgagtatggaatcttcaaccagaagattcgggacggctggcaggtggaggaggctgatgattggctgcgatacggcaatccctgggaaaagagccgaccagagttcatgctgcctgtacacttttacggaaaagtggaacacacgaacaccggcaccaaatggatcgatacccaggtggtgttggctctgccatacgacactcctgtgcccggttacatgaataacaccgtgaacactatgaggctgtggagcgccagagcgccgaacgacttcaatctgagagacttcaatgtgggggattacatccaggccgtactggaccgcaacctcgcagaaaacatcagtagggtcctctacccgaatgacaacttcttcgaaggcaaggagctgagattgaagcaagaatacttcgtcgtcgccgcaaccctccaggacatcatacggagattcaaagccagcaagttcggctcgacccgcggagccggaaccgtctttgatgcattcccagaccaagtggccatccagctgaacgacacgcaccctgccctcgccatcccggaactgatgcggatatttgtcgatatcgaaaagctgccctggtcgaaggcgtgggagctgacccaaaagactttcgcttacactaaccacaccgtgctcccggaggcgctcgaaagatggccggtggatctggtggagaagctgcttccgcgccacctggaaatcatctatgaaatcaaccagaagcacctcgacagaatcgtggcactgttcccgaaagatgtggatagactccggcgtatgtcattgattgaggaggagggtagcaaacgcatcaacatggcccacctgtgcattgtgggctcacatgccgtgaacggagttgctaagatccatagcgatatcgttaagactaaggtctttaaggacttctccgagctggagccggacaaatttcagaacaagactaatgggatcactccgaggcggtggctgcttctctgtaatccaggtctggccgagctgattgccgaaaagataggcgaggactacgtgaaggatttgagccagctcaccaaactccattcgtttctgggagacgacgtctttttgcgcgaattggcgaaggtcaaacaggagaataagctgaagttttcccagttcctggaaaccgaatacaaggtcaagattaatccgtcatccatgttcgacgtgcaagtgaagcgcattcacgaatacaagcgacagcttttgaactgtctccatgtaattaccatgtacaaccgcattaagaaggaccccaaaaaactcttcgtccctcggaccgtgatcatcggaggcaaagccgccccaggctaccacatggcaaagatgatcatcaagctcatcacttcagtggcggacgtggtgaataacgatccgatggtgggatccaagctgaaagtgatctttctggagaattacagagtttctttggcggagaaggtgatccctgccactgacctcagcgaacaaatctctaccgctggaacggaggcctcgggaaccggaaatatgaagtttatgctcaatggagctctgactatcggaactatggacggagcgaacgtcgaaatggcggaagaagcaggagaagagaatctgtttatcttcggcatgagaatcgacgacgtggctgccctggacaaaaagggttacgaagccaaagagtactatgaggcgctccccgaactcaagctggtgatcgatcaaatcgacaatggattcttctccccaaagcagccggatttgttcaaggatatcatcaacatgctgttctatcatgatcggtttaaggtgttcgcagactacgaggcctacgtcaagtgtcaagataaggtgtcccaactgtacatgaatcctaaagcctggaacaccatggtgctgaagaacattgctgcgagcggaaaattctcctcggataggactatcaaagaatacgcccagaatatctggaacgtcgagccgtccgacttgaagatctcactgagcaacgaatcgaataaggtgaatgggaac

SEQ ID NO: 250830 - DNA, 2541 bp, Artificial Sequence
  Description of Artificial Sequence: Synthetic coding sequence
atggccaagcctctaactgaccaagagaagcgaagacagatctcaatcagagggatcgtgggcgtcgagaatgttgctgagctcaaaaaatccttcaatagacatctgcactttactctggtgaaggaccgcaatgttgccacaacccgcgactattattttgctctcgcacacaccgtccgcgaccacttggtgggacggtggattcgcacccaacagcactactacgacaagtgtccgaagcgtgtgtattacctctcactggaattttacatgggacgcaccctgcagaatacaatgatcaacctggggctgcagaacgcctgcgacgaagcaatatatcagctgggtctcgacattgaggaattggaggaaattgaagaggacgcagggttggggaatgggggcctggggcgtctggcagcctgtttcctggacagtatggctacgctgggattggccgcgtacggatacgggattcggtacgagtacgggatatttaatcagaaaatcagagacggatggcaagttgaagaggctgacgactggctgaggtatgggaatccctgggagaagtcgcggcctgaattcatgcttcccgtacacttctacgggaaagtcgagcacacaaataccgggaccaagtggatcgatacccaggtagtgttggccctcccgtatgacacgccggtgcccggctatatgaataacaccgtcaatacgatgcggctgtggtccgcaagggctcccaacgattttaacttgcgcgacttcaacgttggcgactatatacaagccgtgctggacagaaatctagccgaaaacatctccagagtattgtacccgaacgacaactttttcgaggggaaagaactgagactcaagcaggaatacttcgttgttgcggcgacactgcaggatattatccgacggtttaaggcgtctaaattcgggagcacccgcggagccggaactgtgtttgatgccttccccgaccaggtggctattcaactgaacgacacgcacccagctctggctatccccgagctgatgagaattttcgtagatatcgaaaagctcccatggagcaaagcctgggagctgactcaaaaaactttcgcctacacaaaccataccgttctgccagaagctctggaaaggtggccggtagatttggtggagaaattgctgcctcgccacctggagataatttatgagatcaatcaaaaacatctggatcggatagtcgcccttttccccaaggacgttgataggttgaggcgcatgagcctgatcgaggaagaggggtccaagagaataaatatggctcatttatgcatagtggggagtcatgctgtcaatggtgtggctaagattcattctgacatcgtaaagacaaaggtgtttaaggacttctctgaattggagccagacaagttccagaataagaccaacggaattacaccccgcaggtggctcctgctgtgtaatccagggttggccgaactgatcgctgaaaaaatcggtgaggattacgtgaaagatctgtcacagctcactaaactgcactcgtttttaggggacgacgtttttttgcgggagctggccaaggtgaagcaagaaaataagctaaagttctctcaattcctcgagacggagtacaaagtcaaaataaacccaagttctatgttcgacgtgcaggtcaagaggatccatgagtataaacgacagttgcttaattgccttcacgtgattaccatgtacaacagaataaaaaaggatccgaagaagctgtttgtgccacgcactgtgatcattggggggaaggccgctcccgggtaccatatggcaaaaatgatcataaaactcatcacctccgtggcggatgtggtcaacaacgaccccatggtcggtagtaaactgaaggtgatcttcctggaaaattatcgggtgtctcttgccgagaaagtgattcctgcaaccgacctcagcgagcagatatcaaccgcgggtacggaagcaagcggcacagggaatatgaaatttatgctgaatggtgctctcacaattggcaccatggacggcgcaaacgtggaaatggcagaagaagccggagaagagaacctgttcatcttcgggatgcggatcgatgacgtggcagccctcgacaagaaggggtatgaggcaaaagagtactatgaggccctcccagagctgaagcttgtcatagatcagatcgacaacggattcttcagcccaaaacagcctgacctttttaaagatataatcaatatgctgttctaccacgatagattcaaggtcttcgctgactacgaagcttacgtgaaatgtcaggataaggtatcccagctgtacatgaatccaaaggcttggaataccatggtgctgaagaatattgctgctagtggcaagttctcaagcgatcggaccatcaaagaatacgcacaaaatatttggaacgtggaacccagcgacctgaaaatttccctgtctaacgaatctaacaaggtgaacggcaac

SEQ ID NO: 250831 - DNA, 2541 bp, Artificial Sequence
  Description of Artificial Sequence: Synthetic coding sequence
atggctaagcccctgactgaccaggaaaagagaagacagatcagtattaggggcatagtcggagttgaaaacgtggcagaactcaagaagagcttcaacagacacctgcatttcaccctcgtgaaagacaggaacgtagccacaacacgtgactactacttcgcgctggcccatactgtgcgagatcatctggttgggcgttggatcaggacacagcagcactactacgataaatgtcccaaacgagtgtactacctgagcctcgaattctatatgggccgaacactccaaaacaccatgatcaatctgggtttgcagaacgcgtgtgacgaggccatctaccagttggggctggacattgaagaactggaggagatcgaagaggatgccggactcggaaacggagggctcgggagactcgcagcctgctttcttgactccatggccacactcgggctcgctgcatacgggtacgggatacggtacgagtatggcattttcaaccagaaaatcagggatggttggcaagtcgaggaagcggacgattggttgcggtacggaaatccgtgggaaaagagcaggcccgaattcatgttacctgtgcacttttacggaaaggtggagcatacgaataccgggacaaaatggattgacacacaagttgttctcgccctcccttatgacacccctgtgcctgggtacatgaataataccgttaacaccatgagactttggtccgccagagctcccaacgacttcaatcttagggatttcaacgttggagactatatccaggctgtcctggaccgcaatctggctgagaacatatcccgggtgctctacccaaacgacaacttctttgagggcaaggaactgaggctcaaacaggagtacttcgttgtggccgccaccttgcaggacatcattcgcagatttaaagcctcgaagttcggatcaacacgtggagccggtacagtgtttgacgcattcccagaccaggtggccattcaattaaacgacacacatccagcgctcgctatccctgaattgatgcggatcttcgttgacatagaaaagttaccgtggtcgaaggcctgggaacttacccagaagactttcgcgtatacaaatcacactgtcctgcctgaagccctcgaacggtggccagtggacctcgttgagaaactgctaccgaggcacctagagatcatttacgagataaaccagaagcatctcgatcgcattgttgcacttttcccaaaggatgtcgatagactgaggaggatgtcattgattgaggaggagggatcaaaaagaatcaatatggcacacctgtgcatcgtgggttcccatgccgtgaacggcgtggctaagattcattctgacatcgtgaagactaaagtgtttaaagacttttccgaactggagccagataagttccaaaacaagaccaacggcatcacccctcgcagatggctattgctctgtaatccaggattggccgaactaattgccgagaaaataggagaagattacgtcaaagacttatcccagctaacgaagctgcattctttcctgggagatgatgtgttcttgcgagagctcgcgaaggtgaaacaagagaacaagctcaaattcagtcagttcctggaaacagagtataaagtcaaaatcaaccccagctctatgttcgacgtgcaggtaaagcgaatccacgaatataaaagacagctgctgaattgcctgcacgtcataactatgtacaacagaattaaaaaggacccgaaaaaacttttcgtgcctaggacagtgattattggaggcaaagcagcccccggataccatatggccaagatgattataaaactcataactagtgtggccgacgtggttaataatgatcctatggttggatctaaactcaaggtaatctttctggaaaactatcgggtatctctggccgaaaaggtgattcccgccaccgacttgtctgaacagatcagcacggcgggcacggaggccagcggaaccgggaacatgaaattcatgctcaacggcgccctgaccattggcactatggatggagccaacgttgagatggccgaggaagcgggagaagaaaacctgtttatatttggtatgcgaatcgatgatgtggccgctttggacaagaagggctacgaggccaaggagtattatgaggctctgccggaactcaaacttgtgattgatcagatagacaacggtttcttcagcccaaaacaaccagacctgtttaaagacattatcaacatgctcttttatcatgatcgattcaaggtttttgcagactatgaagcatacgtcaagtgtcaagacaaagtttcgcagttatatatgaatcctaaagcttggaacaccatggtactgaaaaatatcgctgcctctggaaaattctcaagcgacagaaccattaaagaatacgcacagaacatatggaatgtggagccctctgatctcaagatctccctgtctaacgaatcaaacaaggtcaacggcaat

SEQ ID NO: 250832 - DNA, 2541 bp, Artificial Sequence
  Description of Artificial Sequence: Synthetic coding sequence
atggccaagccactgactgaccaggaaaagcgcagacagatctcgatccggggaatcgtcggcgtggaaaatgttgcagaactgaagaagtccttcaatcgccacttgcactttaccctggtgaaggatagaaacgtcgcgaccactcgcgattactattttgccttggctcacactgtcagggaccacctcgtcggacgctggatacgcacccagcagcactactacgacaagtgcccaaagagagtgtactacctgagcctcgagttttacatggggcgcaccctccagaacaccatgatcaatctcgggctccagaatgcgtgcgacgaggctatctaccagctgggactcgacatcgaggagctcgaggaaatcgaagaggatgccggactgggcaacggaggactgggacggttggcagcatgttttctggatagcatggctaccctgggcctcgctgcctacggctacggcatccggtacgagtacgggattttcaaccagaagatccgggacggatggcaagtggaggaagccgatgactggctgcgctatggaaacccctgggaaaagagtcgccctgagttcatgctgcccgtgcacttctacggaaaagtggagcacactaataccggcactaaatggatcgacactcaagtggtcctcgcgctgccgtacgacactcccgttccgggatacatgaataacactgtgaataccatgcggctgtggtcggcgcgcgccccgaacgatttcaacctcagagatttcaacgtcggggactatatccaagcagtgctggacaggaacctcgcggagaacatctccagagtcctgtacccgaatgacaacttctttgaaggcaaggagctgcgcctgaaacaagaatacttcgtcgtggcggctaccctccaagatatcattaggcggttcaaagccagcaaattcggatcaacccggggagccggcaccgtgtttgatgcgtttccagaccaagtcgcgatccaactgaacgatactcatccggcactggctattccggaactgatgagaattttcgtcgacatcgagaagctgccgtggtccaaggcttgggaacttacccaaaaaactttcgcctataccaatcacaccgtcctgccggaagcacttgagcgctggcctgtggacctggtcgaaaagctgctgccacggcacctggaaatcatctacgaaatcaaccagaagcacctggatcgcatcgtcgccctgtttccaaaggacgtggatcgcctgcgcagaatgtcgctcatcgaagaagagggaagcaagcgcatcaatatggcgcacctttgcatcgtgggttcgcatgcagtgaacggggtggcgaaaatccattcggacatcgtcaagactaaggtgtttaaagacttctcagaactcgagccagataagttccagaacaagaccaacggaatcactccgcgccggtggcttctcctgtgcaacccgggacttgcggaactgattgcagagaagatcggagaagattatgtgaaggacctgtctcagctgaccaaactgcactccttcctgggcgacgacgttttcctgagggaactggccaaagtgaagcaagagaacaaactgaagttcagccagttcctggaaactgaatacaaagtgaaaatcaatccctcgtcaatgttcgacgtgcaggtgaagcggatccatgaatacaaacgccaactgctgaactgcctgcatgtcatcaccatgtataaccgtatcaaaaaagatcccaagaagctgtttgtgccgagaactgtcatcatcggcggcaaagcggcgccaggataccatatggcaaaaatgatcatcaagttgatcacctcagtggcagacgtggtgaataacgacccaatggtcggttcgaagctcaaagttatcttcctggagaactaccgcgtgtcactggcggagaaagtgattcctgccactgaccttagcgagcaaatttcgactgcaggaaccgaagcatcgggcactggaaacatgaaattcatgctgaacggagccctcactatcggcacgatggatggcgcaaacgtggagatggccgaggaggccggagaggagaacctgtttatctttgggatgcggattgatgacgtggcagcactggacaagaagggatacgaagcaaaggagtactacgaggcgctgccagagttgaaactcgtgattgaccagattgacaacggtttcttttccccgaaacaaccggacctgttcaaggacatcatcaatatgctgttttaccatgacagattcaaggtgttcgcggactacgaagcatacgtgaagtgccaggacaaggtgtcccaactgtatatgaacccgaaggcgtggaacactatggtgttgaaaaacatcgcagcctcagggaagttcagctcggatcggaccattaaagagtacgcgcagaacatctggaacgtcgaaccgtcagacctcaagatctccctttcgaatgaatccaacaaagtcaatgggaac

SEQ ID NO: 250833 - DNA, 2541 bp, Artificial Sequence
  Description of Artificial Sequence: Synthetic coding sequence
atggcaaaacctttaaccgatcaagaaaagcgcagacagatcagcatccgaggcatcgtgggcgtcgaaaacgtcgcagaactgaaaaagtcatttaaccgtcatctgcacttcaccctggtgaaagatcgtaatgtcgccacgacacgggactactatttcgcgctggcacacaccgtaagggaccatcttgtaggtcggtggataaggacgcaacaacactattatgacaagtgccctaagcgtgtctactatctctccctggaattctacatggggcggacactccagaataccatgatcaacctgggactccaaaacgcttgtgacgaagctatttatcaacttgggttagacatcgaggaacttgaagagatagaggaggacgctgggctcgggaacggaggcctgggacggctagccgcatgctttctggacagtatggctacattggggctagcagcatatggttacgggatccggtatgaatatgggatctttaatcaaaagattcgggacggctggcaggtggaggaggctgatgattggctgcggtatggcaacccctgggaaaagtccaggccggagtttatgttgccggtacacttctatgggaaagttgagcacacgaatactggtaccaagtggatcgacacccaggtcgtgctagctctgccctacgacacacccgtgcctgggtatatgaataatactgtcaacactatgagattatggagcgcccgtgcccccaacgacttcaaccttagggatttcaatgtaggggattatatccaagctgttctggaccggaatctggcagagaacatttctcgcgtgctctatccaaacgataactttttcgagggcaaggaacttcggctgaagcaggaatattttgtggtggcggcaaccctgcaagatattatccgacgatttaaggcaagtaagttcggttcgactagaggcgccggcaccgtgtttgatgcctttcccgatcaggtggccattcaactgaacgacacacatcccgccttggcaattcctgagctgatgcgcatattcgttgatattgagaaactcccttggagcaaggcctgggagctgacgcagaagacattcgcctatactaatcacaccgtgctgcccgaggctctggagcggtggccagtggacttggttgagaagttactgccccgccatcttgagatcatttacgagataaaccagaaacaccttgatagaattgtcgcgttgtttcccaaggacgtggataggctgcgtaggatgagcttgattgaggaggaggggagtaaaagaatcaacatggcgcacctgtgtattgtcggctcccacgccgtgaatggcgtggccaagatccacagtgacattgtgaagaccaaagtcttcaaagatttttctgagctggagccagacaagtttcagaacaagacgaatggaattactccacggcggtggctcctcctctgtaaccctggtctggcggagctgatcgcggaaaaaatcggtgaagattatgtcaaggacttgagccagctgaccaagctccattccttcctgggagatgacgtgtttcttcgagaactcgcaaaggtgaagcaagaaaacaagttaaagttctcccaatttttggagactgagtacaaggtgaaaatcaacccctcatccatgtttgatgttcaggtcaagagaatccatgaatacaagcggcaactcctgaattgtctacatgtgatcaccatgtacaataggataaaaaaggatccgaaaaagctttttgttccacggacagtcattattgggggcaaagcggcccctggctaccatatggctaagatgatcatcaaactcattacctcagtcgctgacgttgtgaataacgatccaatggtgggcagcaaactgaaggtgatttttctggaaaactatcgcgtgagccttgcggagaaagtcatccccgcgactgacctgagcgagcaaatcagtactgctggaactgaggcaagtggcaccgggaacatgaaattcatgctaaatggagctttaaccataggaaccatggatggagctaatgtggaaatggccgaggaggctggagaggagaacctgttcatctttggaatgcgaatcgacgacgtggctgcactcgacaagaagggatacgaagccaaggagtactacgaggcactgccggagctgaagttggtcatcgaccagatagacaacggcttcttttctccaaagcaacccgacctatttaaggacattattaatatgctcttctatcacgacaggtttaaagtgtttgccgactatgaggcttatgtcaagtgtcaggataaagtgtctcagttatacatgaacccaaaggcctggaataccatggtgttgaagaacatcgctgcctccggaaaattctcgtctgatagaactatcaaggagtacgcacagaacatatggaacgttgagcccagcgatttgaagatttctttgtcgaacgaaagcaataaggtgaatggcaat

SEQ ID NO: 250834 - DNA, 2541 bp, Artificial Sequence
  Description of Artificial Sequence: Synthetic coding sequence
atggcgaagccactgaccgaccaggaaaaacgcagacaaatctccatccgcgggatcgttggagtcgagaatgtggctgagctcaagaaatccttcaaccggcacctgcacttcactctggtgaaggacagaaacgtggccaccaccagagactactacttcgcgctcgcccacactgtcagggaccatctggtgggccgatggatccggacccagcaacattactacgacaaatgtcctaagcgggtgtattacctctcgctggagttttacatgggccggaccctgcagaacaccatgatcaacctgggattgcaaaatgcatgcgatgaagcgatttaccagctgggactggatatagaggaactcgaggagatcgaagaggacgcgggactgggaaacgggggcttgggacgcctggcagcgtgcttcctcgactccatggcaaccctgggtttggccgcctacgggtacggaattagatacgaatacggcatcttcaaccagaaaatcagggatggatggcaggtggaagaagcggacgactggctccggtacggcaacccatgggaaaagtctcggcccgagttcatgctgccggttcacttctacggaaaagtggaacacactaacaccggaaccaaatggatcgacactcaagtggtcctcgcgctcccgtacgacactccggttcctggttacatgaacaatacggtgaacacgatgcgcctgtggtcggcgcgcgccccgaacgacttcaacctgcgggatttcaatgtcggagattacatccaggctgtcctcgacagaaatctggcggaaaacatctcccgcgtgctctatcctaatgacaatttcttcgaaggcaaggagctgcgcctcaaacaggagtacttcgtggtggcggccacgctgcaagacatcatccgccgctttaaggcgtccaagtttggatcgaccagaggcgccgggaccgtgtttgacgcctttccggaccaagtcgcgatccagctcaacgacacccatcccgccctggcaatcccggaactgatgcgcatcttcgtggacatcgaaaagctgccctggtccaaggcctgggagttgacccaaaagacttttgcgtacaccaaccacactgtcctgcctgaagcgctggagagatggccagtcgacctcgtagaaaagctcttgccgagacacctggaaatcatctacgagattaatcaaaagcatcttgaccgcatcgtcgctctgttcccgaaggatgttgaccggctgcgccggatgtccttgatcgaggaggagggatcgaagcggatcaacatggcccatctctgcattgtgggatcacacgcggtgaacggggtcgccaagatccactcggacatcgtgaaaaccaaggtctttaaggattttagcgagctggaacctgacaagttccagaacaagaccaacggaattaccccacgccgctggctgttgctttgtaatcctggtctggccgagctgatcgcggaaaagatcggggaagattacgtgaaggacttgtcccaactgactaagctccactcgttcctgggagatgacgtgttcctgcgggaactggccaaagtgaagcaggagaataaactgaagttcagccagttcttggaaaccgaatacaaggtgaagatcaatccatcgtcgatgtttgacgtccaagtgaagcgcatccacgagtacaagcggcagctgctgaactgcctccatgtgatcaccatgtacaatagaattaagaaggatccaaagaaactgttcgtgccgcgcactgtcattatcggaggtaaggccgccccgggataccatatggcaaagatgatcatcaaactgattacttcagtggcggatgtggtgaataacgacccgatggtcgggtctaaacttaaagtcatcttcctcgagaattaccgggtgagtctcgctgagaaggtcatccccgctactgacctgagcgaacagatctcaaccgcaggaaccgaagcctctggaaccgggaatatgaagttcatgctcaacggagccttgaccatcggaaccatggacggggccaatgtggaaatggcggaagaagcaggggaagaaaacctgttcattttcggaatgagaattgacgacgtggcggcactcgacaaaaagggatacgaggccaaggaatactacgaggccctccctgagttgaaacttgtgatcgaccagatcgataacggattcttctcaccgaagcagccggacctcttcaaggacattatcaatatgctcttctaccacgacagattcaaggtgttcgctgactacgaggcatatgtgaagtgtcaggacaaagtgtcacagctctacatgaaccccaaagcctggaacacgatggtgctgaagaatatcgccgcatccggaaaattctcaagcgatcgcaccatcaaagagtacgcccaaaacatctggaacgtggagccgtccgacctgaagatttcgctctctaacgaatcgaacaaggtgaacggaaat

SEQ ID NO: 250835 - DNA, 2541 bp, Artificial Sequence
  Description of Artificial Sequence: Synthetic coding sequence
atggctaagcccttgactgaccaggaaaagcgcagacagatttccatacggggtattgttggagtggagaacgtggctgagcttaaaaaatcattcaacagacacctccacttcaccctggtgaaagacaggaatgttgccaccacacgcgactactattttgcattggctcacacggtgagagatcacctagtgggtcggtggataaggactcagcaacactactatgacaagtgtcctaagcgcgtgtattacctgagtcttgaattctatatggggaggacccttcagaatactatgattaatttgggacttcagaacgcttgtgatgaggcaatttaccaactgggtcttgatattgaagagctggaggagatcgaagaggatgctggcctgggcaacggcggcctaggccggctggccgcctgttttctggatagtatggccactttgggcctggcagcatatggatatggcatacgatacgaatacggaatcttcaatcaaaaaataagagacggatggcaggtggaagaggcagatgactggctgcgatacggtaacccttgggagaaaagtcgccctgaattcatgctccccgtccatttctacggaaaggtggaacacaccaacactgggactaagtggatcgatacccaggtggtcctggccctcccttatgacacaccagtgcctggttacatgaacaacactgtaaatactatgagactgtggtcagcgagagcgcccaatgatttcaatttgagagacttcaatgtaggggattacatacaggctgttctggaccgcaacttggccgagaatatcagccgcgtactgtacccaaatgataacttcttcgaagggaaggagctacgcctgaagcaagagtacttcgtcgtggccgctactctgcaggatattattcgaagatttaaggcgtccaagttcggtagcacacgtggcgccggtaccgtgtttgacgcttttcctgatcaagtggccattcagctgaatgacactcatcccgcgctcgccattccagagctaatgaggatctttgttgacatcgaaaagctcccctggtccaaggcctgggaactgacccaaaaaacgtttgcatacacaaaccacaccgttctgcctgaggccttggaacgctggcccgtggacctggtagagaagctgctgccacgacacctggagatcatctatgagatcaatcagaagcatctggaccggatcgttgcactcttccctaaggacgtggatcgcctgcgccggatgtcccttatcgaagaggaaggatccaagaggattaatatggcccatctatgcatcgttgggtcacacgctgtgaacggagtggccaagattcatagtgatattgtcaaaacaaaagtgtttaaggacttctccgagctggagcccgacaaattccaaaacaaaaccaatggcattaccccacgtcggtggcttttgctgtgtaacccaggtctcgccgaactaatcgccgagaagattggcgaggactacgtcaaagacctcagtcagttgacgaagctccattccttcctgggtgacgatgtcttccttcgggagctcgccaaagtgaagcaggagaataaacttaagttttctcagtttctggagacagagtacaaagtgaagataaatccttcatcaatgttcgacgtgcaagtaaaaaggattcacgaatataagaggcagttgttgaattgtttgcatgtgattactatgtataaccggatcaaaaaggaccccaagaagttgttcgtaccacggacggtcattatcggcggaaaagcagcaccagggtaccatatggccaagatgatcatcaaacttatcacatctgtggctgacgtggtcaacaatgacccaatggtgggtagcaaattaaaggtaatctttctggaaaattatcgcgttagtcttgccgagaaagtcatcccggcaaccgatcttagcgaacagatctccacagcgggcactgaagccagcgggaccggaaatatgaagtttatgttgaatggcgccctaactatcggaaccatggatggcgcgaatgtggaaatggcagaagaagccggagaggagaacctgttcatcttcggaatgcggatcgatgacgtagcggccctagacaagaagggctacgaagccaaggaatactacgaggcgttgcctgagttgaagctcgtgatcgaccagatcgacaatggcttctttagtcccaaacagccagatctgtttaaggacatcattaacatgcttttctaccatgatcgctttaaggtattcgctgactatgaagcatacgttaaatgccaggacaaggtatcccagttgtacatgaatccaaaggcgtggaataccatggtacttaagaatattgcagcctcaggaaaattctccagcgacaggactataaaggagtatgcacagaacatctggaatgtcgaaccctcagacctgaagatcagtctctctaacgaatcaaataaagtcaatggcaac

SEQ ID NO: 250836 - DNA, 2541 bp, Artificial Sequence
  Description of Artificial Sequence: Synthetic coding sequence
atggcgaaacctctgacagatcaagagaaaagacgccagatcagcattaggggcatagtaggggtcgagaatgttgcagagctcaaaaaatctttcaaccggcatctccatttcacattagtgaaagatcgtaatgttgcaaccactcgtgactactactttgctttagcacatactgttcgggaccatctggtcggacgctggattagaacacaacagcactattatgataagtgtcccaaacgagtgtattatttatcattagaattctacatgggtagaacacttcaaaacactatgataaatttgggactccagaatgcctgcgacgaagcaatctatcagctaggacttgatatcgaagaattggaggaaatcgaggaagatgcgggattgggcaatggcggacttggccgtctggcagcctgctttctagattctatggctacgttagggctggctgcttatggctatggtatcagatatgaatatggcatctttaatcaaaagatccgcgacggctggcaagtggaagaggcggacgattggcttagatatggaaacccgtgggaaaagagtcgccctgaatttatgctgcctgtgcacttttatggcaaggtcgaacatacaaacacgggcacaaagtggatcgatacacaagtcgtgctggccttaccttacgatacgcctgtcccgggctatatgaataataccgtgaatacgatgagactgtggagcgcgcgcgctccgaatgacttcaatctgcgggatttcaatgtcggtgattatattcaggccgtgctggataggaatctggccgagaatatatctcgggtgttatacccgaatgataatttttttgaggggaaagaactgagactgaaacaagagtatttcgtcgtggcggcgacattgcaagatattatccgcagattcaaggcttcaaaatttggatctacgcgaggagctggcactgtctttgacgcttttccggatcaggtcgcgatccagctcaatgatacacatcctgctctcgctattccggaactcatgcgtatttttgtggatatcgaaaaattaccgtggtctaaggcttgggaattaacccaaaagacgtttgcatatacgaatcatacagttctcccggaggcacttgaacgttggcccgtagatctggtggaaaaattactgccgagacacctggaaattatatatgagatcaatcaaaaacatctagaccgcatagttgcgctcttcccgaaagacgtcgatcggttgagacgcatgtcactgattgaggaggagggcagtaagcgcatcaacatggctcatttgtgtatcgtcgggagccatgccgtaaacggtgttgcgaagatccattctgatatagttaaaactaaagtcttcaaggatttctctgaactagaaccagataaattccaaaataaaacgaatggcatcaccccaagacgttggctacttctatgcaatccgggacttgcagaacttattgcagaaaaaataggtgaggactatgtgaaagatcttagccaacttacaaaactgcatagcttcctgggcgatgatgttttcctcagggaactcgcgaaagtgaaacaggagaacaaactgaaatttagtcaatttctcgagacagagtacaaggtcaagatcaatccgagtagcatgtttgacgtccaggtaaagagaattcatgaatataaaagacagctattaaactgtcttcatgtaatcacgatgtacaaccgcatcaaaaaagatcctaaaaaacttttcgtgcctcgcacagtgattatcggaggaaaagcagccccgggataccatatggcgaagatgattatcaagttgataacttccgttgctgatgtagtcaacaatgatccaatggttggctcaaaacttaaggtgattttccttgagaactatagagtttcgttggcggagaaagtcatacctgccaccgatctttcggaacaaatttctaccgctggaaccgaagcgtcgggcacgggaaacatgaaatttatgctgaacggagccttgacaatcggtacgatggatggcgcaaatgttgaaatggctgaagaagctggcgaagaaaatctttttatctttgggatgagaattgacgacgttgccgcacttgataaaaagggttatgaggcgaaagagtattacgaagctctgcctgaattgaaattggtcattgatcagattgataacggcttctttagtccgaagcagcctgatttgtttaaagatatcattaacatgttattttaccatgatcggtttaaagtgttcgccgattatgaggcatatgttaaatgtcaggacaaggttagccagctttatatgaaccctaaggcttggaacacaatggttctaaagaacatcgccgcttcaggcaaattttctagtgaccggaccataaaagagtatgctcaaaacatttggaatgttgaaccatctgatcttaagatctctttaagcaatgaaagcaataaagttaatggaaac

SEQ ID NO: 250837 - DNA, 2541 bp, Artificial Sequence
  Description of Artificial Sequence: Synthetic coding sequence
atggctaaacctcttactgatcaagaaaaaagaagacaaattagtataagaggtattgtgggggtcgaaaatgttgcagaattaaaaaaatcttttaatagacatttgcattttactttagttaaagatagaaatgtcgccacaacacgtgattattattttgcattagctcatacagttcgtgatcatttagttggtaggtggattagaacacaacaacattattatgataagtgtccaaaaagagtatattatttatcattagaattctatatgggtagaactttacaaaatacaatgattaatcttggtcttcaaaatgcatgtgacgaagcaatttatcaattaggattagatattgaagaattagaagaaattgaagaggatgcaggtttgggaaatggaggattaggtagacttgctgcttgttttcttgattcaatggcaacattaggattagctgcatatggatatggtataagatatgagtacggaattttcaatcaaaaaattcgagatggttggcaagttgaagaagctgatgattggcttagatatggtaatccatgggagaaaagtagaccagaatttatgttaccagttcatttttatggaaaggttgaacataccaatactggaacaaaatggattgatactcaagtagtacttgcacttccatatgatacacctgttcctggatatatgaataatacagttaatacaatgagattatggtcagctagagcaccaaatgattttaatcttagagattttaatgttggggattatattcaagcagtattagatagaaaccttgctgaaaatatatctagagttctttatccaaatgataatttttttgaaggtaaagaacttcgtttaaaacaagaatatttcgttgtagcagctacacttcaagatataatacgaagatttaaagcatcaaaattcggatcaactagaggtgctggaacagtttttgatgcatttccagatcaagttgcaattcaattgaatgatacacatccagctttagctattccagaattaatgagaatatttgttgatattgaaaaacttccttggtctaaagcatgggaattaacacaaaaaacatttgcatatacaaatcatacagtacttccagaagcacttgaaagatggccagttgatcttgtcgaaaaattacttccaagacatctagaaataatctatgaaataaaccaaaaacatttagatcgaattgttgctctttttcctaaagatgtagatagacttagaagaatgtctttaattgaagaagagggatccaaaagaattaatatggcccatttatgcattgttggatcacatgctgttaatggagttgcaaaaattcacagtgatattgtgaaaactaaggtatttaaggattttagtgaattagaaccagataaatttcaaaataaaactaatggaataactcctagaagatggttattgttatgtaatccaggattagcagaattaatagctgaaaaaataggggaagactacgttaaagatttgtcacaattaactaagttgcattcatttttgggagatgatgtattccttagagaattagcaaaagtaaaacaagaaaataaattaaaattttcacaatttcttgaaacagaatacaaagtaaaaattaatccatcatcaatgttcgatgttcaagttaaaagaattcatgaatataaaagacagttattgaattgtcttcatgttattacaatgtataatagaattaaaaaagatccaaagaaattgttcgttccaagaacagtgataattggtggaaaagctgcaccaggatatcatatggctaaaatgataattaaacttataacttcagttgcagacgttgttaacaacgacccaatggtaggatccaaacttaaggttatttttttggaaaattatagagtttcattagcagaaaaagttattccagcaacagatttatctgagcaaattagtactgcaggaactgaagcatcgggaacaggaaatatgaaatttatgttaaatggagctttaacaattggaactatggatggagctaatgttgaaatggctgaagaagcaggagaagaaaatttatttatttttggtatgagaattgatgatgttgcagctcttgacaagaaaggttatgaagctaaggaatattatgaagcattaccagaattaaaattagtaattgatcaaattgacaatggtttttttagtccaaaacaaccagatttatttaaagatattattaacatgttattttatcatgatagatttaaggttttcgctgattacgaagcttatgttaaatgtcaagacaaagtttcacaactttatatgaatccaaaagcatggaatactatggtgttaaagaatattgcagcttctgggaaatttagtagtgatagaacaattaaggaatatgcccaaaatatctggaatgtagaaccatcagatttaaaaattagtctttcaaatgaatcaaacaaagttaacggtaat

SEQ ID NO: 250838 - DNA, 2541 bp, Artificial Sequence
  Description of Artificial Sequence: Synthetic coding sequence
atggctaagccgttgaccgaccaggagaagagacgccagatctccattcgcggaattgttggagtggagaacgtggctgaactgaaaaagagtttcaatcggcaccttcatttcaccctggtgaaagacaggaatgtagccactacacgcgactattatttcgctctcgcccacacagtgcgggatcatctcgtgggccgatggattcgcacccaacaacattactacgacaagtgccctaagcgcgtctattatctctccctggagttctatatggggagaactcttcaaaacacaatgattaatctgggcttgcaaaatgcttgtgacgaggccatctaccaacttggtctggacatcgaggaacttgaggagattgaggaggacgctgggctcggcaatggcggactgggtaggctggctgcttgttttctcgattcaatggccactctggggctggctgcgtatggatatggtatcagatacgaatatgggatattcaatcaaaagattagagatgggtggcaggttgaagaagctgacgattggctgaggtacggcaacccttgggaaaaaagccggcctgagtttatgctgcctgtacatttctatgggaaggtggagcatactaacacggggaccaaatggatcgacacacaggtggtgctggcactgccatatgacacccccgtgcctggttacatgaacaacacagttaataccatgagactctggtctgctcgagcccccaacgattttaacctccgggatttcaacgtgggcgactacatccaagcagtgctcgatcgcaatttggccgagaacatcagcagggtgctttacccaaacgataatttttttgaaggcaaagagctgcgacttaaacaggaatatttcgtggtggcagctacattgcaggacatcatccggagattcaaggccagcaaattcggatccacaagaggtgcaggaacagtgttcgacgccttcccagaccaggtggccatacagctcaacgatacccatcctgctttggccatccccgagctgatgagaatcttcgtagacatcgagaaactcccatggagcaaggcttgggaactgacccaaaaaacgtttgcttatactaaccacaccgtgttgcctgaggcactggaacgatggcctgtcgacctggtggagaagctcctgcctcgccatctcgaaatcatctacgaaattaaccagaagcacctggaccggatagtggctctgttcccaaaggatgtggatcggttgcgaagaatgtccctgatcgaagaagaaggcagcaagcgcatcaacatggcgcacctctgcatcgttgggagccacgcagtgaacggggttgctaaaatccatagcgatatagtgaaaacgaaagtctttaaagacttctctgaactcgagcccgacaagttccaaaataagacaaatggaataaccccccgcagatggctgctcctgtgcaatcccggactggcggaactgatcgctgaaaagatcggagaagattacgtgaaggatctctctcaactcacaaaattgcactcctttttgggagacgacgtgttcctgagggaactggcgaaggtgaagcaggaaaacaaactgaagttcagtcaatttctcgagacagaatacaaggtgaagattaatcccagtagtatgttcgacgtgcaggtgaaaaggattcacgaatacaagagacagcttttgaactgcctccacgtcattaccatgtacaacaggatcaaaaaggaccctaagaaactgtttgtgcctaggactgtcattatcggtggcaaggcagccccaggataccacatggcgaaaatgatcattaagctgatcacatcagtggccgacgtcgtgaataatgaccccatggtgggatccaagctcaaggtcatctttctcgagaattaccgggtgtctttggccgagaaggttattcctgccaccgatctttccgagcaaatttcaacagctggaaccgaagcctccggtactggaaacatgaagttcatgctcaatggggctcttacaattggaacaatggatggtgccaacgtggaaatggccgaggaggccggagaggagaatttgttcatcttcggaatgagaatcgatgatgtggcagcccttgataaaaaagggtatgaagcgaaggaatactatgaggcactgcctgagctgaagcttgtcatagatcagatcgacaacgggttttttagcccgaagcagccagatctgttcaaggatatcatcaatatgctgttctatcatgatcgctttaaagtcttcgccgattatgaagcctacgtgaagtgtcaagacaaggtgtctcaactgtacatgaaccccaaggcttggaacacaatggtcctcaagaatatagccgcatctggaaaattttccagcgataggactatcaaggagtacgcccaaaacatctggaatgtggaaccctccgatctgaagatctcattgtccaacgagtctaacaaggttaacgggaat

SEQ ID NO: 250839 - DNA, 2541 bp, Artificial Sequence
  Description of Artificial Sequence: Synthetic coding sequence
atggcaaagccgctcaccgatcaggagaagaggaggcagatatcaatcagagggatagtcggcgtggagaatgtggcagaacttaagaaaagctttaaccgacacctacatttcaccctggtgaaggatcgcaacgtcgcaaccacgagagattactacttcgccctagcccacaccgtgcgtgatcatttggttgggcgctggatcaggacgcagcaacactattacgacaagtgcccaaagcgagtctactacctcagtcttgagttctatatgggaagaacactgcagaacaccatgatcaatctggggctccagaatgcgtgcgatgaggctatctatcagttgggcctggatatcgaggaattggaggaaattgaggaagacgcaggtctgggcaatgggggcctgggacgcctcgccgcttgcttcttggacagcatggccacgcttggcctcgctgcttatggctatggaatccgctatgagtacgggattttcaatcagaaaattagggacggttggcaggtcgaagaagcggatgactggcttagatacggtaatccctgggaaaagtcacgaccagaattcatgctcccagtgcatttttacggcaaagtagagcacacgaacaccggtacgaagtggattgatacccaggttgtactcgcactgccgtacgatacccctgtgcctgggtatatgaacaataccgttaacacaatgcgcttatggtctgcccgcgctcctaacgatttcaacctgcgtgacttcaatgtgggggactacattcaggctgtgctggaccgcaacctcgctgaaaatattagcagggtgctctaccctaacgataattttttcgaaggaaaggaattgcggctcaaacaggagtacttcgtcgtcgcagccaccctgcaagatataattcggaggttcaaagcaagtaaatttggtagtactcgcggggcaggcactgtgttcgacgcatttccagaccaggtggccattcagctgaacgacacccacccggcacttgccataccggaattgatgcgcattttcgtcgacattgaaaaattgccatggagcaaagcctgggaacttacccaaaagacttttgcctatacgaaccatacagtactgccagaagccttggaaaggtggcctgtagaccttgtggagaagctgctgcctcgtcatctggagatcatttatgaaatcaaccaaaagcatctggacaggatcgtggccctctttcctaaggatgtggataggctccgcagaatgtcgcttattgaggaggaaggttctaaacgcatcaacatggcccatctgtgcatcgtaggcagccacgctgtaaacggcgttgctaagatacattccgacatcgttaaaactaaggttttcaaggatttctccgagctggagcccgacaagttccagaataagaccaatggcattacaccaaggcgatggctgctgttgtgtaaccctggcttagctgagctcatagctgagaagattggggaggattacgtgaaggatctttcgcagctgaccaaattgcactcattcctcggtgatgatgtatttctgagggaattggcgaaagttaagcaagagaacaaacttaaattctcccagttcttggaaacagagtacaaagtgaagattaatccgtcaagcatgtttgatgtacaagttaaacggatccacgagtacaaacgccagctcctgaattgcttgcacgtgattactatgtacaatcggatcaagaaggatccaaagaagcttttcgtgccgagaacggttatcatcggagggaaggcggcgccaggttaccatatggcaaagatgatcataaaactcatcaccagcgttgcggacgtggtgaacaacgacccaatggtgggaagtaagctgaaagtgattttcttggagaattaccgggtctcattggctgagaaggtcataccagcaaccgacctgagcgagcaaatcagtacggcaggcaccgaagcctctggaacaggcaatatgaagtttatgttaaatggagctcttacgattggaacgatggatggggccaacgtcgagatggccgaggaggccggcgaggagaatctttttattttcggaatgcgaatcgatgacgtggccgccctggataagaagggctacgaggccaaagagtattacgaggccctgcctgaactcaagttagtgattgatcagattgataacgggttcttcagtcccaaacaacctgatctgtttaaagatatcattaatatgctcttctaccatgatagattcaaggttttcgcagactatgaagcatacgttaaatgccaagataaggtcagtcagctttatatgaaccctaaggcttggaataccatggtgctaaagaatattgcggcttccgggaagttcagtagtgacagaactatcaaagagtatgcacagaatatctggaatgtggaacccagtgacctcaagatcagcctatcaaatgagtccaataaggttaacggcaat

SEQ ID NO: 250840 - DNA, 2541 bp, Artificial Sequence
  Description of Artificial Sequence: Synthetic coding sequence
atggctaagcccctcacggaccaggagaagcggagacagatatcaatcaggggcattgtgggcgtggagaatgtggcagagctcaaaaaatccttcaacagacatctgcatttcactctcgtcaaagacagaaatgtggccacaacccgagactattacttcgccctggcgcacacagttcgggaccatctggtcggcagatggatacgaactcagcagcattactatgacaaatgccccaaaagggtgtattacctctctcttgagttttatatgggaaggacattacaaaataccatgataaatttgggcctgcagaatgcttgtgacgaagccatctaccagttagggctagacatagaggaacttgaggagatcgaggaagatgctggcttggggaatggcggcctggggagattggctgcctgctttctcgattcaatggccacactgggcctggccgcatatgggtatggcatcagatacgaatacggtatcttcaatcaaaagatccgagacggatggcaggttgaggaggcagacgactggctccgctacggcaatccgtgggagaagagccgacccgaatttatgctcccagttcacttttatggcaaagtggagcatacaaatacaggaacaaagtggattgatacccaggtagtactcgctctgccttatgatacgcctgtccctgggtatatgaataacaccgtgaacacaatgcgactctggtccgcccgggcacccaatgactttaacctgcgcgactttaatgttggcgattacattcaggccgtgctggatcgcaacctcgctgaaaatatttcccgtgtactgtaccccaacgacaactttttcgaaggaaaggaactgagactaaaacaggaatacttcgtagtagccgctactcttcaggacatcattaggcggttcaaagcgtccaagtttggctctacccgaggggcaggaacggtatttgacgcctttccagaccaggtggcgatccagctgaacgacacacaccccgcattggcaattccagaactgatgagaatatttgtggatatcgagaagctcccgtggtccaaggcatgggagctcacccagaagaccttcgcatacaccaaccacaccgtattaccagaagcacttgaacggtggccagtggacctcgtggagaaactcttaccccggcaccttgagatcatctatgaaatcaaccagaaacaccttgaccggattgtggcgttgttcccgaaggacgtggaccgactacgaaggatgtctctcattgaggaagagggcagtaaaaggataaatatggcccatttatgcattgtcggctcgcacgctgtcaacggcgtggcgaagatccattccgacattgttaaaacgaaggtcttcaaagatttcagcgagttggaacccgacaaattccagaacaagactaacggcatcactcctcgcaggtggctgctgctctgcaatccagggctggcggaactcatcgctgagaagattggcgaggactacgtcaaggatctttcccagcttaccaagttgcattcattcctcggcgatgacgtatttcttagggaacttgccaaagttaagcaggaaaataagctaaagttcagccagtttctggaaaccgagtacaaggttaagattaatccctcaagcatgttcgatgtccaggtgaaaaggattcatgaatataagaggcagctgctgaactgcctgcacgtgattaccatgtacaataggataaagaaagaccccaagaagttgtttgtgcctcgcactgttatcattggcggtaaggctgccccaggctatcatatggcaaagatgatcataaagctgattactagcgtcgctgacgttgtcaataacgatcccatggtgggaagcaaactcaaggtaatcttcttggaaaattacagagtcagcctggccgagaaagtcatcccagccaccgatctgtccgaacagatttctacagccggaaccgaagcctcagggaccggcaatatgaagtttatgctcaatggcgccctgactatcgggacaatggatggtgcgaatgtggagatggcggaagaggcaggggaggagaatttgttcatctttggtatgcgtatcgatgatgttgccgctctcgacaaaaaaggctatgaggctaaagaatattatgaagctctgccagagctgaaactcgttattgatcagatcgacaatggtttcttttctcccaagcagcctgatctgttcaaggacataatcaatatgctgttctaccacgaccggtttaaggtcttcgctgattacgaggcatatgtgaagtgccaggataaggtatctcagctgtatatgaaccctaaagcttggaacactatggtgctcaagaatattgcggcttccggcaaattttcctctgatcgcaccatcaaagaatacgcacagaacatctggaatgtggagccaagtgacctgaaaatctcactgagcaatgaatcaaacaaagtcaatggcaac

SEQ ID NO: 250841 - DNA, 2541 bp, Artificial Sequence
  Description of Artificial Sequence: Synthetic coding sequence
atggcgaagccgctgacggaccaggagaagcgcagacagatatctatccgggggattgttggggtcgaaaatgtcgccgaactgaaaaaaagcttcaaccggcatctgcactttacactggtgaaagacaggaatgtggctacaacaagagactattattttgcactggcacacactgtgcgcgaccaccttgtgggtcgctggattcgcacccagcagcactattacgacaaatgtccaaaaagggtgtactacctaagcctcgagttttatatgggtaggaccctccagaatacgatgattaaccttggattgcagaatgcttgcgacgaggcaatttaccagctcgggctagacatcgaggaactggaagagattgaggaagacgcaggactgggaaacgggggcctcggtagattagccgcgtgctttctcgattccatggcaacgttaggcctggcagcttacggttacgggatacgctacgagtacggcattttcaaccaaaaaattagagatgggtggcaggtggaggaagctgatgactggctgaggtacgggaatccttgggaaaagtcgcggccggaatttatgcttcctgtgcacttctatggaaaggtcgagcataccaacaccggaactaagtggatagatacacaagtggtgctggcactgccttacgacaccccagtgcctgggtacatgaataacacagtaaacactatgaggctgtggagtgcccgggcccctaatgactttaatctgagggatttcaatgtcggggattatatccaggcggtactggaccggaaccttgcggaaaatatcagcagagtcctatacccgaacgataatttttttgaggggaaggagttacgcttaaaacaggagtacttcgtcgtggcggccacacttcaggacatcataagaaggttcaaagcatccaaattcggcagtacccgaggtgccggaacagtttttgatgcctttcccgaccaggtggctatacagttgaacgatacacacccggcgcttgcgattcccgaactgatgaggatattcgtcgatatcgagaagcttccatggagtaaagcctgggaacttacacagaagaccttcgcgtatacaaatcacaccgtgctgcccgaagcccttgaacgctggccggtggatctggttgaaaagctattacctcgccacctcgaaatcatctatgagatcaaccagaagcacttggatcggattgtggcactgtttccaaaggacgtggatcgtctgcgccggatgtccctgatcgaggaggaaggctccaagaggatcaatatggcccacctctgcattgtcggaagccatgccgtgaacggcgtggccaagatccactctgatattgtcaaaacaaaagtgtttaaagactttagcgaacttgaacccgataagttccaaaacaaaactaatggtatcactccaaggaggtggctgctgctgtgtaatcccggcctggctgaactaatcgcggagaaaattggagaagactatgtaaaggacttgtcccagctaactaaactgcattcatttcttggagatgacgttttcctgagagaactggcaaaggtgaagcaggaaaacaagctcaaatttagtcagttcctcgagacggagtacaaggtgaaaatcaaccctagcagcatgttcgacgtgcaagtgaaaaggatacacgaatacaagcgtcaactcttgaactgcctgcacgtcattacaatgtataacagaatcaagaaagacccaaaaaagctatttgtcccaagaacagttatcattggtggcaaagcggcgcctggctatcacatggctaagatgatcatcaaactgatcacgagcgtggccgatgtcgtaaataatgaccccatggtgggatctaaactgaaggtcatctttcttgaaaactatcgagtcagcctggccgagaaagtcatacctgccacagacctgagcgagcaaatcagcactgccgggacggaggcttcagggactggaaatatgaagtttatgttgaacggggcactcacaattggaactatggacggcgccaatgtggaaatggcagaggaggcaggcgaagaaaatttattcattttcggcatgcggatcgatgatgtggcggcgctcgacaaaaaaggctacgaggctaaggaatattatgaggcgctccctgagctcaaactcgtgatcgaccagatcgacaacgggttttttagcccaaagcagcccgacctgttcaaggatattattaatatgctgttttatcacgaccgcttcaaggtcttcgctgattatgaggcatatgtcaagtgtcaggataaggtgtctcagctgtatatgaaccctaaggcatggaacacaatggttttgaaaaatatagccgcttctggcaagttcagttcagatcgtaccattaaggaatatgcccagaatatatggaacgtggaaccgtccgatctgaaaatttccttgtcaaatgagagcaataaggttaacggaaac

SEQ ID NO: 250842 - DNA, 2541 bp, Artificial Sequence
  Description of Artificial Sequence: Synthetic coding sequence
atggcaaagccactgacggatcaagagaaacgtcgacagatttccattcggggaatagtgggggtggaaaacgtcgcggaacttaagaagtccttcaaccgccatttgcactttactctggtgaaggatcggaacgtcgccactacccgcgactactactttgcgcttgcacatactgtacgcgatcaccttgtgggacgctggattcggacccaacaacattactacgataaatgtccaaagagagtctactacctttctcttgagttttacatgggccgtactttgcaaaataccatgattaatctcggactgcagaatgcatgcgatgaagctatctaccaactggggctcgatatagaagaactggaggaaatcgaagaagatgcgggattgggtaatggcggactgggaaggttggccgcttgctttttggacagcatggctactctgggacttgcagcctacggttacggcattagatacgagtacggaattttcaaccagaaaattcgcgacggttggcaagtggaagaagcagatgattggcttaggtacggaaacccatgggagaagtcaagaccggaattcatgctgccagtgcacttttacggaaaggtcgagcataccaacaccggtaccaagtggattgatactcaagtggtccttgccttgccctacgacacccctgtgcctggttatatgaacaacaccgtgaacactatgaggctgtggagtgcccgtgcacctaatgacttcaatctgagggactttaacgtcggtgattacatacaggctgtgctggaccggaacttggcagaaaacatttcgcgcgtcctgtatcctaatgataacttttttgagggtaaagaacttcgactgaaacaagaatactttgtcgtggcagctaccctccaggatatcataagacgcttcaaggcatcgaaattcgggtcgactcgtggggccggaaccgtgtttgatgcgttccctgatcaggtggcaattcaactgaacgacactcatccggcgctggcgatacccgaactgatgagaatctttgtggatattgagaaactgccatggtcaaaagcatgggagcttactcaaaagacttttgcatacaccaaccacaccgtgcttcctgaagcactggaaagatggcctgtggatctggtggagaagttgcttccacgccatcttgagattatctacgaaatcaaccagaagcaccttgatagaattgtggcattgtttccaaaggacgtggatcggctccgccggatgtctttgattgaggaagagggttcaaagcgaattaacatggctcatctgtgtattgtcggctcccatgcagtgaacggagtcgccaagatccactcggacattgtgaaaaccaaggtattcaaggacttttcagaattggaacccgataagtttcagaataagactaacgggatcacgccaagaagatggctgcttctgtgtaacccaggcctggccgaacttatcgcagaaaagataggcgaggactatgtcaaggatctttctcagcttacgaagctccatagctttctgggtgatgatgtgtttctgagagaacttgcaaaagtgaagcaagagaataagctgaagtttagccaatttctcgaaactgagtataaagtcaagatcaacccttcgtcaatgttcgatgtccaggtcaagaggatccatgaatacaagagacaactcctcaactgccttcatgtcattacgatgtacaatcggatcaagaaagatcccaaaaaactttttgtgcctaggaccgtgatcatcggtggtaaggcagccccgggctaccacatggcaaagatgatcataaaacttatcaccagcgttgctgacgttgtaaacaatgatcccatggttggaagcaagctcaaggtaatcttcctggagaactacagggtgtcccttgcagaaaaggtcattccggcaaccgatctgtcggaacaaatttcaaccgccggcacggaagcatccggaacgggcaatatgaagtttatgctcaatggtgccctgaccataggaactatggatggcgcgaacgtcgaaatggcggaggaagcaggggaggaaaaccttttcattttcggtatgcggattgacgacgttgccgcacttgataagaagggatacgaggcaaaggagtactacgaagcacttcctgaactcaagctcgtgattgatcagattgacaacggattcttctccccaaaacaaccggatctgtttaaggacattatcaacatgctcttttaccatgaccggtttaaagtgtttgccgactacgaggcatacgtgaagtgtcaagacaaagtgtcccagctctacatgaatcctaaggcgtggaataccatggtgttgaagaacattgccgcgagtggtaagttctcatcggaccgcactataaaggaatacgctcagaacatctggaatgtggaaccctccgatctcaaaatctcgctctcaaacgagagcaataaagtgaacgggaat

SEQ ID NO: 250843 - DNA, 2541 bp, Artificial Sequence
  Description of Artificial Sequence: Synthetic coding sequence
atggcaaagcccctgacagaccaggagaaacggagacagatttcaataagaggaatagtaggcgtggaaaacgtcgccgaattgaaaaaaagctttaaccggcacctgcatttcaccttagtgaaagataggaacgtcgctaccactagagactattatttcgcactggcccatactgtgagagatcacctagtggggagatggatcagaactcaacagcactattatgacaaatgccccaaacgcgtgtactacctgtccctggagttttatatgggccgcacactccagaatactatgatcaatttggggctccagaatgcctgcgacgaggccatctatcagctgggcctggatattgaagagctggaagagattgaggaggatgccgggctgggtaatggcggcctgggccggctggccgcatgtttcttggatagcatggctaccctgggcctggcagcctatggatatggcatcagatatgaatatggcatttttaaccagaagattagagatggttggcaagtcgaggaggctgacgattggttgcggtatgggaatccttgggagaaatccagacccgaatttatgttacccgtccacttctatggcaaggtcgaacataccaataccggaactaaatggatagacactcaagtggtgctcgcattaccctatgacacacctgtgccaggatacatgaataacaccgttaataccatgaggctttggagtgccagagctccgaatgacttcaacctccgagacttcaacgtgggagattacattcaggcagtgctcgaccggaacttggcagaaaatatctctagggtgctctacccaaatgataatttctttgagggtaaagagcttcggctgaagcaggagtactttgtcgtggccgcgacactccaggacattattagacgttttaaagcaagcaaattcggatcaacgcggggtgccggaacagtgtttgacgcctttcctgaccaagtcgccatccagttgaacgacacacatccagcactggcaatcccagagctcatgcgaatttttgttgatattgaaaaactgccatggagtaaagcttgggagctgacacaaaagacctttgcctatactaaccacaccgtgctgcccgaggcattggaaaggtggccagtggatctcgtggaaaaactgttgccaagacacctggaaatcatttacgaaatcaaccaaaaacatctagatagaattgtggctctgtttcccaaggacgtggaccgactgaggaggatgtccctgatcgaggaggagggttccaagcggattaacatggcacacctgtgcatcgtgggatcccatgccgttaatggagtggccaaaattcatagtgacatagtcaaaacaaaggtctttaaagacttctctgaacttgaacccgataaattccaaaataaaacaaatggcatcacacccagacgctggctactcctttgcaacccgggccttgcagagctgatcgctgaaaaaatcggagaagattatgttaaggacttgagccaattgacaaaactccactccttccttggtgatgatgtgttccttagggagctggccaaagtgaaacaggaaaataaattaaagtttagtcaattcttagagacagaatataaagttaagattaatcccagttccatgttcgacgttcaggtgaaacgcatccatgagtacaagcggcagctgctgaactgtctgcacgtcattaccatgtataatcgcatcaaaaaagatcctaagaaactgttcgtgcctaggacagttattatcggaggcaaggcggcacccggctaccatatggccaagatgataatcaagttaatcacctcggtggctgacgtcgtcaacaacgaccctatggttgggtctaagctgaaggtgatctttctggaaaactatcgagtgagcttagcggaaaaggtgatccccgctacagatctgtccgagcagatcagcacggcaggtacagaagcatcgggaaccggtaacatgaaatttatgctaaacggggcactgactatcggaaccatggacggcgccaatgtcgagatggccgaggaggccggcgaggagaatctgtttatcttcggaatgaggattgatgatgtagctgcactggacaagaagggatacgaagctaaggagtactatgaggccctccccgagctgaagctagtgattgatcagattgataatgggtttttcagcccgaaacagcctgatctttttaaagatataattaacatgcttttttatcatgatcgcttcaaggtctttgcagattacgaagcctacgttaaatgccaggataaagtaagtcaattgtatatgaatcctaaggcctggaacacaatggtccttaagaatatcgccgcctcgggaaagttttcatccgaccggactattaaagaatatgcacaaaatatttggaatgtggagccctctgacctgaaaatctccctcagcaatgaatccaacaaagttaatgggaac

SEQ ID NO: 250844 - DNA, 2541 bp, Artificial Sequence
  Description of Artificial Sequence: Synthetic coding sequence
atggccaagccattgacagatcaagagaaacgacgccaaataagtatacgtgggattgtcggagtcgaaaacgttgctgagctgaaaaaatcgttcaatcggcacctccacttcaccttggttaaggacagaaacgtggccactactcgcgattactatttcgctcttgctcacacggtgagggaccacctggtgggccgctggatccgtacccagcagcactattacgataaatgccccaagcgtgtttattacctgagccttgagttctatatgggacgcacgctccagaatacaatgatcaatcttggacttcaaaacgcctgcgacgaggccatataccagctcggcctggatatcgaggagcttgaagagatcgaagaagacgctgggctcgggaatgggggtctgggccgactggccgcctgttttttggactccatggctacattaggcctggccgcatacggctacggcatccgctatgaatatgggatattcaatcagaaaattagggacggatggcaggtggaggaggcagatgattggctgcggtatggtaacccgtgggagaagtccaggcctgagtttatgcttcctgtgcacttctacggcaaagtagaacacaccaataccgggaccaaatggatcgacacacaagtcgtgctggccctcccatacgatactcctgtgccagggtacatgaataacacagtcaacaccatgcgtctctggagtgcacgagcgcccaatgacttcaacttgcgggactttaatgttggtgactacatccaggccgtgctcgaccgcaacctggccgaaaatatcagcagggtactgtatccaaacgacaacttttttgaagggaaggagctgagactcaaacaggagtattttgtggtcgctgcaactttgcaggacatcatccgccggtttaaagcatctaagtttggttctaccaggggcgccggtacggtttttgatgccttccctgatcaagttgccatacagctcaacgacacccacccggcgttggctatccctgagctgatgagaatattcgtcgatattgagaagctcccatggtcaaaggcttgggagctcacccaaaaaactttcgcttacaccaatcacaccgttctccccgaggcgctcgagaggtggcccgtcgatctggtggagaaacttctgcctcgtcatttggagatcatatatgagatcaatcagaagcacctggaccgaatcgttgcgctctttccgaaagatgtggacaggctgcgacggatgtctctgatcgaggaggaaggctccaaaaggataaatatggctcacctgtgtattgtggggagccacgcggtgaacggtgtggcgaagatacactctgatatcgttaagaccaaagtgttcaaagatttctcggaactggagcctgacaaattccagaataagaccaacgggatcactccacggcgctggctcctgctttgcaatcccgggctggcagaactcatcgccgagaagatcggtgaagattatgtgaaggatctttcccagcttaccaagctgcattctttccttggcgatgatgtgttcctacgggagctcgccaaagtaaaacaggagaacaagctgaagttttcgcagttcctggaaacggaatataaggttaagatcaacccctccagcatgtttgacgttcaggtaaagcgcattcacgaatacaagcgccaactcctcaattgtctccacgttatcaccatgtacaaccggatcaagaaggatcccaagaagttgttcgtacctcgtactgtgataatcggaggaaaagccgctccaggctatcacatggcaaagatgatcatcaagttgattaccagcgttgccgatgtggtcaataacgatcctatggttggaagtaagctgaaggtgatattcctggagaattaccgagtgtctctagctgagaaggtgatccccgcaacagacttatcagaacagatctcaaccgcaggcactgaagccagcgggaccggtaatatgaagtttatgctgaacggcgcactcaccattggtactatggatggcgctaacgttgaaatggccgaagaggccggagaagagaatctgttcatattcggaatgagaattgatgacgtggcagcgctggacaagaagggctacgaggcgaaggagtattacgaggctctgccagaactgaagctggtcattgatcaaatagataacggctttttctccccaaagcagccagatctctttaaggacatcatcaacatgttgttttatcatgaccgcttcaaagtcttcgctgactatgaggcgtacgtgaagtgccaggataaagtgtcccaactctacatgaaccccaaggcttggaacacaatggtgctcaagaacatcgcagccagtggaaagtttagctcggaccggaccattaaagaatacgcccagaacatttggaatgtggagcctagcgatctgaagatctctcttagtaatgagtctaacaaggtcaacggtaat

SEQ ID NO: 250845 - DNA, 2541 bp, Artificial Sequence
  Description of Artificial Sequence: Synthetic coding sequence
atggctaaacctctgacagaccaggaaaagcgccgccagatatctatacgtggtatcgtgggcgttgagaacgtagctgagctgaaaaagagctttaacagacacctccactttacacttgttaaggacagaaacgttgccactactagggactactattttgccttggctcataccgtccgtgatcacctcgtgggtcgctggattagaacacagcagcattattacgacaagtgcccaaaacgtgtgtactacttgtctctcgaattctatatgggtcgtacacttcaaaacacaatgataaacctgggacttcagaacgcatgtgacgaagctatctaccagctgggactggatatcgaggagcttgaggaaatagaggaggatgcaggactcggaaacggcggccttggccgtctggctgcctgcttcttggatagcatggctacactgggactggctgcttacggttacggcatccgttacgagtacggcattttcaaccaaaagatcagggatggatggcaagtcgaggaggccgatgattggctgcgctatggtaacccctgggagaaatctaggcccgagttcatgctgcctgtccacttttatggaaaggtggagcataccaacacaggcaccaagtggatcgatacccaagtggtgttggctctgccctacgacacacctgttcctggatatatgaataataccgttaatactatgaggttgtggagtgcccgtgcaccaaacgattttaacctgagagactttaatgtgggtgactacattcaggctgtcctcgacagaaatcttgctgagaacatctcaagagtcctgtaccccaatgacaattttttcgaaggcaaggaattgagactgaagcaggagtatttcgtggttgctgctacactccaggacattattcgtcgcttcaaggcctccaagtttggctctacccgcggagctggcaccgtgttcgatgcttttcctgaccaagtcgcaatacagctgaacgacacacatcccgcattggccattcccgaactgatgcgcatcttcgtagatatcgagaagctgccatggtcaaaggcttgggagcttacacagaagaccttcgcatatacaaaccacaccgtgttgcccgaggctctcgagaggtggcctgtggatctcgtcgaaaagctcctccctcgccacctcgaaatcatctacgagatcaatcaaaagcatctggataggattgtcgctttgttccctaaagacgtggatagactgaggagaatgagcctgattgaagaagaaggttccaagcgcatcaacatggctcatctttgtatcgttggatcccacgccgtcaacggagtggccaagatccactctgacatagtgaagacaaaggtatttaaagacttttccgagctggagccagataagttccagaacaaaaccaatggaataacccctagaagatggctgcttctctgtaacccaggcttggctgagcttattgccgaaaaaatcggagaggattacgttaaggacttgagccagcttaccaagttgcactccttcttgggcgatgacgtattccttagagagttggcaaaggtaaagcaggagaacaagctcaaattctcccagttcttggaaaccgaatataaggtgaagattaacccatcctccatgttcgacgtacaagtgaaaagaatccatgagtacaagaggcagttgcttaactgcctccatgtgatcactatgtataatcgcatcaaaaaagaccccaagaaactcttcgtaccccgcactgtcatcatcggaggaaaggctgccccaggctaccatatggctaaaatgatcataaagctcatcacaagcgtcgctgacgtggtaaacaacgatccaatggtgggttccaaactgaaggtaatctttctggagaattaccgcgtgtcactggcagaaaaagttatcccagccacagacctgtctgaacagatttccaccgccggaacagaagctagtggcactggaaacatgaagtttatgctcaacggagccctcactatcggtaccatggacggtgccaatgtcgagatggccgaagaggctggcgaggaaaacctctttatcttcggcatgcgtattgatgacgtggccgcccttgacaagaaaggttacgaagccaaggagtactacgaggccctgcctgagttgaaactggtcattgaccagatcgataacggcttcttctcccccaaacagccagatttgttcaaggatatcatcaacatgttgttctaccacgatagattcaaggtgttcgcagattacgaggcttatgtgaagtgccaggataaggtctcccaactgtacatgaatcccaaagcctggaacacaatggtgctcaagaacattgccgccagtggaaagttcagctcagatcgtaccattaaggaatacgctcagaacatctggaatgtggaaccttctgacctgaagatatccctctctaatgagagtaacaaggtaaacggtaac

SEQ ID NO: 250846 - DNA, 2541 bp, Artificial Sequence
  Description of Artificial Sequence: Synthetic coding sequence
atggctaagcccctgaccgaccaagagaaacgccggcaaatcagcatccgcggaatcgttggcgtggaaaatgtggcagagctgaagaagagcttcaaccggcatttgcacttcacgctcgtgaaggaccgcaacgtggccactactcgcgattactattttgcacttgcccacactgtgagggaccacttggtcggtagatggatccgcactcagcagcactactacgacaagtgccctaagcgcgtgtattatctctctctggagttctatatgggacggaccctccagaataccatgattaatctgggcctgcagaatgcctgcgatgaagccatctaccaacttggcctggatattgaagaactggaggagatcgaagaggatgcgggcctcggaaacggtggactgggcagactcgccgcctgtttcctggactcgatggcaaccctgggcctggcagcgtacggttacggaattagatacgagtacggaatcttcaatcaaaagatccgcgacggatggcaagtggaagaagcggacgactggctcaggtacgggaacccgtgggaaaaatcccgcccggaattcatgttgccggtgcacttttacggaaaagtggagcacactaacaccggtactaagtggattgatacccaagtcgtgctcgctctcccgtatgatactccagtgccgggatacatgaacaataccgtcaacaccatgcgcctctggtcggcacgcgccccaaacgatttcaatcttcgagactttaacgtgggtgattacattcaggccgtgttggacagaaacctggccgagaacatcagccgcgtgctctaccctaacgacaacttctttgagggaaaagagctgaggctgaaacaagagtacttcgtggtggcggcgaccctccaggatatcatccggcggttcaaagcgtcgaagttcggctcaactcgcggagctggaactgtgttcgacgcgtttcccgaccaggttgctatccagctgaacgatactcaccccgcgcttgccatcccggaactcatgagaatcttcgtcgacattgaaaagttgccttggtcaaaggcctgggagctgactcagaaaaccttcgcctacactaaccataccgtactgccagaagcattggagcggtggccggtggacctcgtcgaaaagttgctgccgagacacctcgaaatcatctatgaaatcaaccagaagcatctcgacaggatcgtggccctgttcccgaaggacgttgaccggctgcgccggatgagcctgatagaagaagaggggtccaagaggatcaacatggcacacctgtgcatcgtgggctcccacgccgtgaacggtgtggccaagatccattccgacatcgtcaagacgaaggtgtttaaagatttctcagagctcgagccggacaaatttcaaaacaagacgaatggcatcaccccacggaggtggctgctgctttgcaacccgggacttgccgaacttatcgctgaaaagatcggggaggattacgtgaaagacctgtcacaactgactaagctccactccttcctgggagacgacgtgttcctgagagaattggcgaaagtgaaacaggaaaacaagctgaagttctcacaattcctggaaaccgaatacaaggtgaaaatcaacccatcaagcatgtttgatgtgcaagtgaagcggatccacgaatacaaacggcagctcctcaattgcctccacgtgatcactatgtacaatcgcattaagaaggatcccaagaagctgttcgtgccccggactgtgatcatcggaggcaaggctgcccctggctaccatatggctaaaatgatcatcaagctgatcacttccgtggccgatgttgtgaataacgatccaatggtgggatctaagttgaaggtgatcttcctggagaattaccgcgtatcgctggcggagaaagtcatacctgctaccgatctgagcgagcaaatctccaccgcgggaactgaagcgtcgggcaccgggaacatgaagttcatgctgaacggcgctctgactatcggaactatggacggcgccaacgtggagatggctgaggaagcgggtgaagaaaacctctttatcttcggaatgagaattgatgacgtggcggctctggacaagaagggttacgaagcgaaggaatactacgaagccctcccagaactgaagctggtgatcgatcagatcgacaatggcttcttctcaccgaaacagcctgacctgttcaaggacatcatcaacatgctcttttaccacgaccgtttcaaagtgttcgctgactacgaggcgtacgtcaaatgccaggataaggtatcccagctgtacatgaatccgaaggcctggaataccatggtgctcaaaaacatcgccgcgtcgggaaaattctcaagcgaccgcaccatcaaggaatatgcgcagaatatctggaatgtggaaccctccgatctgaagattagtttgtcgaacgagtccaataaagtgaacggcaac

SEQ ID NO: 250847 - DNA, 2541 bp, Artificial Sequence
  Description of Artificial Sequence: Synthetic coding sequence
atggccaaaccccttacggatcaggaaaaaagacgccagatttcgataagaggaattgtgggtgtggaaaatgtggcggagcttaagaagagctttaacaggcatctgcactttactcttgtaaaggatcgtaacgtggccaccacgagggattactacttcgctctcgcacacactgtgcgggatcatttggtggggaggtggatccgcacccaacaacactactacgataaatgtcctaagcgcgtctactacctctccctcgagttttacatggggaggaccctccagaataccatgatcaacctgggtctgcagaacgcatgtgacgaagccatctaccagctcggtttggatattgaggaacttgaagaaatcgaagaggacgccggactcggtaatggtggcctgggtaggcttgcagcatgtttcctcgattcgatggcaaccctcggactcgctgcctacggttacggaatacggtacgaatacggaatattcaaccagaagattagagatggttggcaagtggaagaagcggatgactggctgcgttacggaaacccttgggaaaagtccagaccagagtttatgctgcccgtgcacttttatggtaaggtcgagcatactaacactggcactaagtggattgacacccaagtcgttctggcacttccatacgacaccccagtgccgggatacatgaacaatactgtgaacaccatgcgcctgtggagcgcacgagcccctaacgatttcaacctgagagacttcaatgtcggggattacattcaagccgtcctggatagaaaccttgcggagaacatttcacgtgtactttaccctaatgacaacttttttgagggtaaggaactccgcctgaagcaggaatacttcgtggtcgcggcgactcttcaagacataatccgccggttcaaggcctccaagtttggatccacccgcggtgcggggactgtgttcgatgcatttccagatcaagtcgcaatccagctcaatgacacccatccagccctggcgatccccgagcttatgagaattttcgtggacatcgaaaagttgccgtggtcgaaagcatgggaactgactcaaaaaacctttgcttacaccaatcatacggtcctgcctgaggcccttgaacgctggcctgtggacctcgtggagaaacttcttcctcgccatctcgagatcatatacgaaatcaaccaaaaacatctggatcgaatcgtggccctgtttcctaaggatgtcgacaggctgcgtagaatgagtctcatcgaagaagagggttcaaaacggataaacatggctcatctgtgtatagtgggatcacatgcagttaatggagtcgccaagattcattcggacatcgtgaaaactaaagttttcaaggatttctcagaactggaacctgacaagtttcagaacaaaaccaacgggattacccctcgccgatggctgctcctttgtaacccgggcctggcagaacttattgcagaaaagatcggggaagattacgtgaaggatctctcgcagttgactaaacttcactcttttttgggtgatgatgtatttcttcgagaactcgcaaaggtgaagcaagaaaacaaactgaagtttagccaatttctcgagactgaatacaaagtgaaaatcaacccatcgtcgatgtttgacgtgcaagtgaaacgtatacacgagtataagaggcagttgctgaactgcctccacgtgatcaccatgtataacagaattaagaaggaccctaagaagttgttcgtgcctagaactgtcattataggtggtaaagcagcgccaggttaccatatggcgaaaatgatcataaagctcatcacctcggtggcagacgtcgtgaataacgatcccatggtcgggtccaagctgaaggtcattttcctggagaactatcgagtgtcccttgcagaaaaggtgattcctgcgaccgacctgtccgaacagatttccaccgcaggtacggaggcatccggcacgggcaatatgaagtttatgttgaacggggcacttaccatcggaaccatggacggggcaaacgtggagatggccgaggaggcaggagaggagaatctgttcattttcggaatgagaattgatgacgtggcagcactggataagaagggctacgaggcaaaagaatactacgaagcccttccagagcttaagctggtcatcgatcaaattgataatgggttcttttcacccaagcagccagatctctttaaggatatcataaacatgttgttttaccacgaccgcttcaaggtgttcgcagattacgaagcgtacgtgaaatgtcaggataaggttagccaactgtatatgaatcctaaggcatggaatactatggtgcttaagaacatagcggcatcgggaaagttctcgtcagatcggaccattaaagaatacgctcagaacatatggaatgtggaaccaagcgaccttaagatctcactctccaacgagtccaataaagtgaacgggaat

SEQ ID NO: 250848 - DNA, 2541 bp, Artificial Sequence
  Description of Artificial Sequence: Synthetic coding sequence
atggctaagccccttactgatcaggaaaagaggcgtcagatttcgatcagaggaatcgtcggtgtggaaaatgttgcggagctgaagaaaagcttcaaccggcacctgcactttaccctagtcaaagatagaaacgtggctacaactagagactattactttgcgttggctcacaccgtcagggaccacctcgtggggagatggatccgcacacaacagcactattacgacaagtgtcccaaacgggtttattaccttagcctagagttttacatgggtaggacccttcagaacactatgatcaatctcggactgcagaatgcctgcgatgaggccatatatcagctcggcctggacatcgaggagctcgaggagatcgaagaggacgcggggcttggcaacggtggactgggccggttggcagcttgttttctggattccatggctactcttggattagccgcctacgggtacggcatccggtatgagtacggcatctttaaccagaaaatccgggacgggtggcaggtagaggaagcagatgattggcttcggtacggaaacccgtgggaaaaaagtaggccggaattcatgttacccgtacacttttacggtaaggtggagcataccaacaccggcaccaagtggatcgacacccaagtagtgctagccctaccatatgacaccccggtgccgggctatatgaacaatacggtgaacaccatgcgactctggagtgcccgcgccccaaatgacttcaacctgcgagattttaatgtcggggactacatacaggctgtcctggaccgtaatctcgcagagaacatcagcagggtcctgtaccctaacgataatttttttgaaggtaaagaactccggctgaagcaagagtactttgtggtagctgcaactctgcaggacatcattcgcagatttaaggcttctaagtttgggagtacccgcggagctggaacagtttttgatgcctttccggatcaagtggccatccaactgaacgacactcaccccgctctcgcaattcctgagctgatgcgcatctttgtcgacatcgaaaagctgccttggagcaaggcttgggaattgactcagaagacctttgcatacactaatcacactgtcctgccagaagcactagagcgctggccggtggatcttgtagagaagttgctaccacggcatttagaaatcatttatgagataaaccagaagcatttggacaggatcgtcgccctttttccaaaagatgtggatcggctacggcggatgagcttgattgaagaggaagggagcaagagaattaacatggcacacctgtgtatcgtgggcagtcacgcagtgaacggcgtagcaaagatccactctgatattgtgaagactaaggtttttaaggacttctctgaactcgaacccgataaattccagaataagacaaacgggatcacacccagacggtggttgctgctctgtaatcctggcctggcagaactgattgctgaaaaaatcggagaagattatgtgaaggacctatcccagcttaccaagctgcattcatttctgggagacgatgtgtttctccgggagctggctaaagtgaaacaggaaaacaagctgaaattctcacagttcctggaaactgagtacaaagttaagattaatccaagtagcatgtttgatgtgcaagttaagcgtatccacgagtacaagagacagctccttaactgcctgcacgtgattacaatgtacaaccggatcaaaaaggatcccaagaaactgtttgtcccaagaacagtgattattgggggcaaggcggctccaggctatcacatggcaaaaatgatcatcaagctgatcaccagcgtagccgatgtggttaacaatgatccaatggtgggaagtaagctaaaggtgatctttttggaaaactaccgggtgagtctggccgagaaagtgatacccgccactgatctttcagagcagatctctactgcgggcaccgaggcttccggcaccggcaacatgaaatttatgctgaatggcgctctgaccattggaaccatggatggggctaacgtcgaaatggctgaagaggccggcgaagagaacctttttatttttgggatgaggatcgacgacgttgcagccctggacaaaaaagggtatgaagcaaaggaatattacgaggccttgccagaattgaaactggtaattgaccaaattgataatggtttctttagccccaaacagcccgatctgttcaaagatattatcaacatgttgttttaccacgaccgtttcaaggtgttcgccgattatgaagcctacgtgaaatgccaggacaaggtatcacagttgtacatgaatcccaaagcttggaacacaatggtacttaagaatatcgcagcaagtgggaaattcagttcggatcgcacaattaaagagtacgctcagaatatttggaacgtcgagccgtctgacctgaagatctccctgagcaatgagtccaacaaggttaacggtaac

SEQ ID NO: 250849 - DNA, 2541 bp, Artificial Sequence
  Description of Artificial Sequence: Synthetic coding sequence
atggctaagcctctcaccgatcaagagaagcgtagacagatttccataaggggtattgtaggagttgaaaacgttgcggagttgaagaaaagtttcaataggcatctccatttcacgctcgttaaagatcgtaatgttgctaccacaagggattactattttgccctcgctcatactgttcgagatcatcttgtcggacgatggattaggacacagcagcattactacgataagtgcccaaagagggtttactacttgagtttggaattctatatgggcaggactttgcaaaatacgatgataaatttgggtctgcagaatgcctgcgacgaggcaatctaccaactaggccttgatatagaggaacttgaggagatcgaagaagatgcgggacttgggaacggaggtttgggtaggctcgctgcctgtttcttagatagcatggctacactgggtctggccgcttacggttacggtatcaggtacgaatatgggatttttaaccagaaaatcagagacggttggcaagttgaggaggctgatgattggctgagatacggtaatccttgggagaagtcgcggcctgagttcatgttgccagtacatttctacggtaaggttgagcataccaacactggaactaagtggatcgacacacaggttgtgttagcactaccatatgacactccagttcctgggtatatgaacaatacagtgaacactatgcgcctatggtcggctcgagccccaaatgattttaatctccgtgattttaatgttggggactatattcaagccgtgctggacaggaatttagccgaaaacattagcagggttctctacccaaatgataacttctttgagggaaaagagctaagactgaaacaggaatatttcgtcgtagctgcaactctccaggatatcattagaagatttaaagcttctaaattcgggtctacacgaggcgccggtaccgtgttcgatgccttccctgatcaggtggctatacaactcaacgacacacatccagctttggcaattcctgaacttatgaggatcttcgttgacattgagaagcttccatggagtaaggcatgggaacttacacaaaaaacattcgcttataccaatcataccgtccttcctgaagctttagagcgctggcctgtggatttggttgagaagttgttgccccgtcaccttgagattatctatgaaataaatcaaaagcaccttgatcgcatcgtcgctttatttccaaaagacgttgaccggttgcggcgtatgtctcttattgaggaggagggttcaaagaggattaacatggctcacctttgtattgtgggatcacatgcagtcaatggagtcgcaaagatccacagtgatattgttaagactaaggtgtttaaagatttctctgagcttgaaccggacaagtttcaaaataaaacaaacgggataacaccaaggcgttggctattgctttgtaatcctggacttgccgaattgatagctgaaaagattggtgaggactacgtaaaggatctttctcaacttacaaagcttcattcctttttgggagatgatgtctttctgcgggaattggctaaagtgaagcaggagaacaagcttaagttctcgcaattcttggagaccgaatacaaggtgaaaattaatccaagctccatgttcgatgttcaggtcaagaggattcatgagtacaagaggcaattgttgaattgcttacatgtaatcactatgtataaccgcataaagaaagaccccaagaaattgtttgtgccccgtaccgtaattattggcggaaaggcagcgccggggtaccatatggcaaagatgataattaaacttataacttccgttgcagatgttgttaataacgatccaatggtaggatctaagttgaaagtaattttccttgaaaattaccgcgtgtccttggctgagaaagtgatccccgctacagacttgagtgaacaaatctccactgctggaaccgaagcttcaggcacgggtaatatgaagttcatgttgaacggagctttgacgattggtaccatggatggtgctaacgttgaaatggcagaggaggccggagaggagaatctttttatcttcgggatgagaattgatgacgtagcagctcttgataagaagggatacgaggccaaagaatattatgaagcactccccgagttgaagttggtcatcgatcaaattgataatggcttcttttcgcccaagcaacccgatctttttaaggacataattaacatgctcttctaccacgatcgtttcaaagtattcgccgattatgaagcatacgttaaatgtcaggataaggtttctcagctgtacatgaatcctaaagcctggaataccatggttcttaagaatatagctgcttccggtaaattttcttctgatcgaaccattaaagagtatgcacaaaatatttggaacgtggagccttcggatcttaaaatttctctctctaatgaatcaaacaaagtcaacggcaat

SEQ ID NO: 250850 - DNA, 2541 bp, Artificial Sequence
  Description of Artificial Sequence: Synthetic coding sequence
atggccaagccgcttactgatcaggagaaacgtagacagatctccattcggggcatcgtgggcgtggagaacgtggccgagctgaaaaagtccttcaatcgtcacctgcatttcacgctcgtgaaggacaggaatgtcgctactactcgggactactacttcgcgttggcccacaccgtgcgggaccacctggtgggccggtggatcaggactcagcagcactactacgacaagtgtccgaagcgggtctattacctgtcactggagttctacatgggtaggaccctgcagaatactatgattaacttgggcttgcagaacgcgtgtgacgaagcaatctaccaattgggacttgatatcgaagagctcgaggagatcgaggaggacgccggactcggaaatgggggcctggggaggcttgcagcgtgcttcctggattccatggctactctgggcctggccgcctacggctacgggatccgctatgagtacggcatcttcaatcagaaaatacgggatgggtggcaggtggaggaagctgatgactggctgcgctacggcaacccgtgggagaaaagccgtccggagttcatgctgccagtgcatttctacggaaaggtggaacataccaacacgggtaccaagtggatcgacactcaggtcgtgctcgccctgccgtacgatacccctgttccgggttacatgaacaacaccgttaatactatgcgcttgtggagcgctagagccccaaacgatttcaatctccgcgactttaacgtgggggactatatccaggcagtgctggaccggaacctcgcagagaacatctcgcgggtgctgtacccgaacgacaatttcttcgagggaaaggagctgcgcttgaaacaggagtatttcgtggtggccgcaaccctgcaggacatcattagacgcttcaaggcctcaaagttcgggtccacccggggagccggaactgtgttcgatgcgttcccagaccaggtcgctatccaactgaacgatactcaccctgccctggcgatcccggagcttatgagaatcttcgtggatatcgaaaagctgccatggtcaaaggcatgggagctcacccagaaaaccttcgcatacaccaatcataccgtcttgcccgaggctctggaacgctggccggtggacctggtggagaaactgctgccacgccacctcgagatcatctacgaaatcaaccagaaacacctggatagaatcgtggctttgtttcctaaggacgtagatagactgagacggatgtcccttatcgaggaagaaggttcgaaaaggatcaacatggcccatctctgcatcgtgggaagccatgctgtgaatggagtcgcgaagatccattcggacatcgtcaaaactaaggtgtttaaggacttctcggaactggaacctgataagttccagaacaagactaatggaatcaccccgagacgctggctgctgctctgcaatcccggattggccgaactgattgcggaaaagatcggagaggattacgtgaaggacctgtcccaactcaccaagctgcattcgtttcttggtgatgacgtgttcttgcgcgagttggccaaggtgaagcaagagaacaagctcaagttctcacaattcctggagactgagtacaaggtcaagataaacccctcctccatgttcgacgtgcaggtgaagcggatccacgaatacaaaagacagctcctgaactgccttcacgtgattaccatgtacaacagaatcaaaaaggaccctaagaagctgttcgtcccacggacggtgattatcggaggaaaggccgccccaggataccacatggccaagatgataatcaaactgattacgtctgtggcggacgtcgtgaacaacgaccccatggtgggctcaaagctgaaggtgatcttcctggagaactaccgcgtgagcctggccgaaaaagtgatcccggccactgacttgtccgagcaaatttcgacggccggtactgaagcctcaggaactgggaatatgaagttcatgctcaatggcgctcttacgatcggcacgatggacggtgcgaatgtcgaaatggccgaggaggcaggcgaggagaacctgtttatcttcggcatgagaatcgatgacgtcgctgcactggataagaagggctacgaagcgaaggaatactacgaagcactgccggagctgaaactggtgattgatcaaatcgacaatggattcttttcgccaaagcaaccggatctgtttaaggatatcatcaatatgctgttctaccacgatcgctttaaggtctttgccgattacgaagcctacgtaaagtgccaggacaaagtgtcacaactgtatatgaatccaaaggcctggaatacgatggtgctcaaaaacatcgctgcatcgggaaaattctcttccgataggaccatcaaggaatacgcgcaaaacatctggaacgtggaaccttccgatctgaagatctcgctcagcaacgagtcgaataaagttaacgggaac

SEQ ID NO: 250851 - DNA, 2541 bp, Artificial Sequence
  Description of Artificial Sequence: Synthetic coding sequence
atggcaaaaccattaacagaccaagagaagagaagacagatcagcattagagggatcgtcggcgtcgagaatgttgccgaactgaagaagagtttcaatcggcatctccatttcaccctggtgaaggaccgaaatgtggccacgacgcgtgactactacttcgccctggcccacaccgttagagatcacctcgtgggaaggtggatccgcacccagcagcattactatgacaagtgtccaaagagagtctattatctatctctcgaattttacatggggaggacactgcagaatactatgatcaacctgggccttcagaacgcatgtgatgaggccatataccagctggggttggacatcgaggaactggaagagatcgaagaggatgcagggcttggaaacggcggactgggaagactggccgcctgcttcctggacagcatggccacactgggcctggcggcttatggttacggaatccggtatgagtatggcatcttcaatcagaagatacgggacggctggcaggtggaggaggccgatgactggctccgatacgggaatccctgggaaaagtcccgcccagagttcatgctcccggtgcatttttacggaaaggtggagcacaccaatacaggtaccaagtggatcgatactcaagttgtcctggccctcccttacgacacaccggtgcccggatatatgaataatacagttaatactatgcgcctgtggagcgcccgcgcccccaacgattttaatctgagggactttaatgttggcgactatattcaagccgtgctggacagaaacctggctgaaaacatctcccgcgtgctgtatccgaacgataactttttcgaggggaaggaactgcggctgaaacaggagtactttgtcgtggccgctaccttacaggatatcatcaggcgattcaaggcctccaaatttgggagcacgagaggcgccggaactgtcttcgatgctttccccgaccaggtggcgatccagctgaatgacacccatccggccctagcaattcccgaacttatgaggatcttcgttgatattgagaagctgccttggtccaaagcctgggagcttacacaaaagacatttgcctatacaaatcacaccgtgctcccagaggctctcgaaagatggccagtcgatctcgtcgagaagctactgccgaggcatttagagatcatttatgaaatcaaccagaagcacctcgatcggattgtggccctgttcccaaaggatgtggatcgcctcaggaggatgtcgctcatcgaggaagaagggagtaagcgcatcaacatggcccacctttgtatcgtgggctcacatgctgtgaatggggtggccaaaatccactctgacatcgtgaaaaccaaagtgttcaaggacttctctgaactggagcccgataagtttcagaacaagaccaatggcatcacacctagaagatggcttctgctgtgcaacccaggcctcgccgaactcatagccgagaaaattggcgaagactatgtcaaggacctgtcccagcttacaaaacttcactcattccttggtgacgacgtttttcttcgcgagttggcaaaggtgaagcaggaaaataagctcaagttctcccagttcctcgagacggagtacaaggtgaaaatcaatccttcctctatgttcgatgtgcaagttaagaggatccatgaatataaacgtcagctattgaactgcctccacgtgatcaccatgtataatcggatcaagaaggacccaaagaaactctttgtacctcgcactgtgatcataggagggaaagctgcgccggggtaccatatggccaagatgatcattaagcttatcacctccgtggcagatgttgttaataacgacccaatggtcggctcaaagctcaaggtgatattcctggaaaattatcgagtgagcctcgcggagaaggtgatccccgccactgacttatcagaacagatcagtaccgccggcactgaggcatcagggactgggaatatgaagttcatgctgaatggagccctgacaattggcaccatggatggagcgaacgttgaaatggccgaagaagcaggtgaggaaaacctctttatctttggtatgcgcattgatgacgtagccgctcttgataaaaagggctacgaggccaaggagtactacgaggcgctgccagaactgaaactggtcatcgatcagatagacaatggcttctttagtccgaagcaaccagacttgttcaaggatataatcaacatgctattttatcatgaccgatttaaagtattcgctgattatgaagcctacgtgaaatgtcaggataaggtgagtcagctctatatgaatcctaaagcctggaacactatggtcctgaagaacatcgcagcgtcgggaaaattctccagcgatcggaccatcaaggagtacgcccagaacatttggaatgtggagccatcagacttgaagataagcctgtccaacgaatctaacaaggtcaatggcaat

SEQ ID NO: 250852 - DNA, 2541 bp, Artificial Sequence
  Description of Artificial Sequence: Synthetic coding sequence
atggcaaagccactcacagaccaggagaagcgcagacagatttcaatacgcggcatcgtgggggtggaaaacgtggctgagctgaagaagtcattcaaccgccatctccattttaccttggtgaaggaccggaatgtcgccacgacacgggattactattttgcactcgctcatacagtgcgggatcatctggttgggcgctggatcaggacacagcagcactactacgataaatgtcctaaaagggtctattacctgagcctggaattctatatgggtagaaccctccagaacaccatgattaacttaggattgcagaatgcttgcgatgaagccatctaccagctgggcctggacatcgaagagctggaggagatcgaggaggacgcgggcctcggcaacggcgggttgggaagacttgccgcgtgcttccttgactccatggcaacccttgggttagccgcgtacggatacggcattcggtacgagtacggtatttttaatcagaagatccgcgacggatggcaagtggaagaggccgacgattggctgaggtacggaaatccatgggaaaaatcaaggcctgagttcatgctgcctgtccacttttatggaaaggtcgaacatacaaatacagggaccaagtggatagacacgcaggttgtattggccttgccatatgacactccagtccctgggtacatgaataatacagtcaacactatgcgcctctggtccgccagagcaccaaatgacttcaatttaagggacttcaatgttggcgattacatccaggccgtcctggataggaacctggctgagaatatatcacgggtactgtacccgaacgataactttttcgaaggaaaggaattgcgcctcaagcaggaatacttcgtggtggccgctacactccaggatataataagacggtttaaggcctccaaattcggttcaacgcggggagccggcaccgtgtttgacgcctttcctgatcaggtagcaatccagttgaacgacactcaccctgctttagctatccctgaactgatgcgcatttttgtggatatcgaaaagcttccttggtcaaaagcgtgggagttgacccagaaaacttttgcatacaccaatcacacagtgctgccagaggcgctagagagatggcctgtagatttagtcgagaaactactccctaggcatctagagatcatttatgaaatcaaccaaaaacatctcgacaggattgtggccctgttccctaaagatgtggatcgcctaaggcggatgtcgttaatcgaagaggaggggtcaaagaggattaacatggcacatctgtgtatcgtgggttcccacgccgtgaatggggtggccaagatccactcagatatcgttaaaaccaaagttttcaaagatttttcagagctggagccagataagttccaaaataagacaaatggtataaccccaaggcgctggctcctgctgtgtaatcccgggctggccgagctgattgccgaaaagattggtgaggactacgtgaaggatctatctcagttgacaaagctgcactcgtttctgggggacgatgtattcctgcgggagctcgcaaaagtgaagcaggaaaacaagctcaaatttagccagtttctggaaacggagtacaaagtgaaaatcaatccgtcatcaatgttcgatgtgcaggtgaagaggattcacgaatataaaaggcaactcctgaactgtctgcacgtgatcacaatgtataataggataaagaaagatcccaagaagctgttcgtaccgagaacggttattataggaggaaaagcagcgcccgggtaccatatggctaaaatgattattaagttaattacatctgtggctgatgtggtcaacaacgacccaatggtcggctccaaactcaaggtgattttcctcgaaaattatagagtaagtctggctgagaaagtgattcccgcgactgacctttctgagcaaatctctacagccgggacagaagccagcggcacgggtaacatgaaattcatgcttaacggagcgctgactataggaacaatggacggagctaatgtcgaaatggccgaggaggccggtgaggaaaacctttttatcttcggtatgagaatcgatgacgtcgccgccctggacaaaaaaggctacgaggctaaggaatattatgaagctctccccgaactcaagctcgttatagatcagattgataacggctttttcagccccaagcagcctgatttgttcaaggacatcatcaacatgcttttctatcacgaccggttcaaagtgttcgctgattatgaggcctatgttaagtgccaggacaaggtgagtcagctttacatgaacccaaaggcctggaatactatggtgctcaagaacatcgcagcgtctgggaaattttcctctgacaggacaattaaagagtacgcacaaaatatatggaatgtggaaccctccgacctgaaaatatccttaagcaatgagagtaacaaggtgaatggcaac

SEQ ID NO: 250853 - DNA, 2541 bp, Artificial Sequence
  Description of Artificial Sequence: Synthetic coding sequence
atggccaaacctcttaccgatcaagaaaagcgcagacagatctccatccgtgggattgtgggagtggagaatgtggctgaactcaagaaatcgtttaacaggcacctccattttacccttgttaaagatagaaacgtggcaactactcgtgactattacttcgcgctggcccacacggtgagagatcacctggtgggaagatggatacgaacccaacagcattactatgataagtgtccaaagagagtgtactatctgtcgttggaattctacatggggagaaccttgcaaaacaccatgattaacttgggtctgcaaaacgcatgcgacgaagcaatataccagctgggactggacatcgaagaactggaagagatagaagaagatgcagggctgggtaatggagggcttgggcggctcgcagcctgtttcctggattcgatggcgacccttggccttgccgcatatggttacggaattaggtacgaatacgggatctttaaccagaagatcagagatggatggcaagtagaagaggccgacgactggttgcggtacggaaacccttgggaaaaatctcgcccggagttcatgctgccagtgcacttttacggaaaggtggaacacaccaataccggtactaaatggatcgatacccaggtggtcctggctttgccctacgatactcctgtgccggggtacatgaacaatacggtcaataccatgcgcctctggagcgcaagagcaccaaacgatttcaacctgcgggactttaatgtcggagactacattcaggcagtgcttgaccgaaacctggccgaaaacatttccagggtcctttacccaaatgataacttctttgaaggtaaggaactgagactgaagcaagagtactttgtggttgcagcaactcttcaggacattatccgtcgctttaaggcctccaaatttgggtcaacccgcggcgccggaacggtgttcgacgcctttcctgatcaagtggcaatccaacttaacgatacccatcctgcacttgcaatacctgaactgatgcggatttttgtggacatagaaaagctcccatggtcgaaggcatgggaactgacccaaaagacttttgcttacaccaatcatactgtgcttccagaggccctggaacggtggcccgtcgatcttgtggaaaagctcctgcctcggcatctggagattatctacgagattaatcaaaagcaccttgatagaattgtggcactgtttcccaaagatgtggatagactccgccgcatgtcgcttattgaggaagaagggtcaaagcgcatcaacatggcacatctgtgtattgtgggatcccatgccgtcaatggcgtcgcaaagattcattcggatattgtcaagacgaaggtgttcaaggactttagcgaactggaaccagataagtttcaaaacaagaccaacggaattaccccacggagatggctgcttctttgtaatcctggacttgcagaactcattgccgaaaagatcggtgaggattacgtgaaggatctgagccagctgactaaacttcatagctttcttggcgatgatgtattccttagagagctggctaaggtcaagcaagagaataagctgaagttttcgcagttcctcgaaaccgaatacaaggtgaagataaacccctcgtctatgtttgatgtccaagtgaaaagaattcatgagtataaacggcagcttctgaattgtctccatgtgatcaccatgtacaaccgcatcaagaaagaccctaaaaagctgtttgtcccacgaacggtcattattggaggaaaggcagcacctggataccacatggcgaagatgattatcaagctgattacctcagtggcggatgtggtgaacaacgacccgatggttggaagcaaacttaaggtgatttttctggaaaactacagggtgagcctggccgagaaggtcatcccagctactgatctgtcagaacaaattagcaccgcgggcaccgaggcctcaggtaccggtaacatgaagtttatgctgaacggagcactcaccattggtaccatggacggagctaacgtggagatggcagaagaagcaggagaagaaaacctgttcatattcggaatgcgtattgacgatgtggcagcacttgacaaaaagggttacgaagcaaaagagtattacgaggcactgccggagttgaagctggtgatagatcaaatcgataacggctttttctcccctaaacaaccagacttgtttaaggatatcattaacatgctgttttaccatgatcgctttaaggtctttgcagattacgaggcatacgtcaagtgtcaggacaaagtctctcaactttacatgaacccaaaggcatggaacaccatggttctcaagaatattgccgcatccggcaagttttcgtccgataggactatcaaagagtacgctcaaaacatctggaacgtggaaccctccgacctgaagatttcgttgtctaacgaatctaacaaagtgaacggcaat

SEQ ID NO: 250854 - DNA, 2541 bp, Artificial Sequence
  Description of Artificial Sequence: Synthetic coding sequence
atggccaagcctctgaccgaccaggaaaaacggcgtcagatcagcatccgcggtattgtgggggtcgagaatgtcgcagaactgaagaagtcgttcaataggcacttgcatttcaccctggtgaaagatcggaacgtggccaccacccgggactactactttgcgctcgcacacaccgtgcgggaccaccttgtgggaagatggatcaggacccaacagcactactacgacaagtgtccgaagcgagtctactacctcagccttgaattctacatgggtcgcaccttgcagaacaccatgatcaatttggggcttcagaatgcctgcgacgaagcgatctaccagctggggctcgacatcgaggaattggaggaaattgaagaggatgctggactgggaaacggaggcctgggccggctcgcggcgtgcttcctggactctatggccacgctgggtttggcggcgtacggctacgggattaggtacgagtacggcatcttcaatcagaaaattcgcgacgggtggcaagtggaagaggctgacgactggctgcgatacggaaatccatgggaaaagtcgcggccagaattcatgttgccggtgcacttctacgggaaggtcgaacacactaataccggcaccaagtggatcgatacccaggtggtcctggccctgccgtacgataccccggtgcctggctacatgaacaataccgtgaacactatgcggctgtggagcgcacgcgcaccaaacgatttcaacctgcgcgatttcaacgttggagactacatccaggcagtcctggaccgcaatctggcagagaatatctcacgggtgctctacccaaatgataacttttttgaggggaaggagctgcggctgaagcaggagtatttcgtagtggcagcgactttgcaagatatcatcagacgctttaaagcatccaagttcggatcgacccggggcgcgggaactgtgttcgacgcctttccggaccaagtggccatccagctcaacgacactcaccccgctctcgccatcccggaactgatgcgcatctttgtggacatcgaaaagctgccgtggtcgaaggcctgggagctcactcaaaagacgtttgcatacactaaccacaccgtgctcccagaagcgctggaaaggtggccggtggatctggtggagaaattgttgccgagacatctggagatcatctacgagattaaccagaaacacctcgacagaatcgtggcgcttttcccgaaggacgtcgaccgtctgcgcagaatgtccctgatagaggaagaaggatccaagcggatcaatatggctcacttgtgcattgtcggatcgcacgccgtgaacggagtcgccaagattcattcagacatcgtgaaaactaaggtgttcaaggacttttcggaactcgaaccggacaagttccagaacaaaactaacggtatcaccccgcggagatggttgctcctgtgcaacccaggactggcagagctgatcgctgagaagatcggagaggattatgtgaaagaccttagccaactgaccaaactgcactcgttccttggggatgacgtgttcctgcgcgaactcgccaaggtgaagcaggaaaacaagctgaagttttcacaatttctggaaaccgaatacaaggtcaagataaatccctcgtctatgttcgacgtccaagtgaagcgaatccatgagtacaaacgccagctcctgaactgcttgcatgtgatcaccatgtacaaccgcatcaagaaggatcctaagaagctcttcgtgccgcggacggtgatcataggaggcaaggccgcacccggataccacatggcgaagatgatcatcaaactgatcacctccgtcgcggacgtcgtgaataacgatccaatggtggggtcgaagctcaaagtgatcttcctggagaactatcgcgtgtccctggcagagaaggtgattcctgccaccgacctgtccgaacaaatctccaccgcgggcactgaggcgtcaggtactgggaacatgaagttcatgcttaacggagcactcactatcggcactatggatggtgcgaacgtcgaaatggcggaggaagccggagaggaaaaccttttcatcttcggaatgcggatcgacgacgtggcagccctcgacaagaaaggctacgaagcgaaggagtactacgaagctctgccggagctgaaacttgtgatcgaccagatcgacaacggcttcttctcaccgaaacagccggaccttttcaaagacatcatcaatatgctgttctaccacgatagattcaaggttttcgcagactacgaagcgtacgtgaagtgtcaggacaaagtgtcccagttgtacatgaacccgaaagcatggaacactatggtgttgaagaatattgcggcaagcggaaaattctcatcagatagaaccatcaaggaatatgcccagaatatctggaacgtggagccttcggacctgaagatcagcctgagcaacgaatcaaacaaggtcaatgggaac

SEQ ID NO: 250855 - DNA, 2541 bp, Artificial Sequence; identical to SEQ ID NO: 250835
  Description of Artificial Sequence: Synthetic coding sequence

SEQ ID NO: 250856 - DNA, 2541 bp, Artificial Sequence
  Description of Artificial Sequence: Synthetic coding sequence
atggctaagcccctaacggaccaggaaaagcgacggcagatttctatacggggtatcgtgggagtcgaaaacgtggccgaattaaagaagtctttcaacaggcatttgcactttaccctggtgaaggatcggaacgtggcaaccacaagggactactatttcgccctggctcatacggtgagggaccacctggtcgggaggtggatcaggacacagcagcattattatgataagtgtcctaaaagagtttactacttgtctttggagttctacatgggacggaccctgcagaacacaatgataaacctagggctgcagaacgcctgtgacgaagccatttatcagctgggattagatattgaggaactggaggagatcgaagaggatgcaggcctcggtaatggggggctcggtcgactggccgcctgttttctagactcaatggctactctcggattggcagcttacgggtatggcattcggtatgagtacggtatctttaatcaaaagataagagatggatggcaggtggaggaggcagatgactggcttcgatacggcaacccttgggagaagtctagacccgagttcatgttacccgtgcatttttatggtaaggtcgagcacaccaatacaggcaccaagtggatcgacacccaagttgtgttggcgttgccgtatgatactcccgtgccaggctacatgaataatactgtaaacacaatgagactgtggtccgcccgcgctcctaatgacttcaacctgcgcgactttaacgtcggtgactacatccaggccgtcttagataggaacctagcagaaaatatctctagggtactgtacccaaacgacaactttttcgaaggcaaggagcttcggttgaaacaagagtacttcgtggtcgcggccacacttcaagacatcattcggcgatttaaggccagcaagttcggatcaacccggggggccggcactgtctttgatgcatttcccgaccaggttgcaatccagctcaatgacacccatcccgcactggccatcccggaattgatgcgcatctttgtcgacatagagaagctgccttggagcaaggcatgggaactgactcagaagaccttcgcctatactaatcatactgtgttacccgaagctctggagcggtggccggtagatcttgtggaaaagctgctgccacggcatctggagataatatacgaaatcaaccagaagcacttggaccgcatcgttgctttgtttcccaaagatgtcgatcgcttgcgccgaatgagccttatcgaagaggagggatccaagcgcataaatatggcgcacttatgcattgtgggctcccacgcagtgaacggggtggcaaaaattcactctgatattgtaaaaactaaagtgttcaaagacttttctgagttggagccagacaagtttcaaaacaagacgaatggaataacaccaagacgatggcttcttctttgcaatccaggacttgccgaactgattgccgagaagattggagaggactacgtcaaagacctctctcagctgactaaactgcattcttttctgggcgatgatgtttttctaagagagctcgcaaaggttaaacaggaaaacaaactgaagttttcccagtttctggagacagaatataaggtgaagattaacccgtcaagcatgttcgacgttcaagtgaaaagaatccatgagtataaaagacaattactgaattgcctccatgtaattactatgtataatcggattaagaaggaccctaaaaagctatttgtacctcggacagtgattatcggcgggaaagcagcccccggctaccacatggcgaagatgatcattaagctgatcacgagtgtcgcagatgtcgtgaacaatgatccgatggtcgggtctaaattgaaagtcattttcttggagaattatagggtaagtcttgcagaaaaggtcatccccgctaccgacctctctgagcaaatatccacagcagggacagaggcatcaggcactgggaatatgaagtttatgctgaacggggcactgaccattgggacaatggacggcgctaatgtcgagatggccgaagaggctggggaagaaaacttgttcatcttcgggatgagaatagacgatgtggcggctctggacaagaaggggtatgaagcaaaggaatactatgaggcattgcctgaacttaagctggtgatcgatcagatcgacaacggctttttctcgcctaagcaacccgatcttttcaaggacataatcaatatgctgttttaccacgataggttcaaggttttcgccgactacgaagcctacgtcaaatgccaggacaaggtttcgcagctctacatgaaccctaaagcttggaacactatggtattaaagaatatcgccgcaagcggtaaattttcaagcgatcgtacaattaaggagtatgctcagaacatttggaatgtcgaacccagtgatctgaagatctccctgtctaatgaatcgaacaaggtgaatggcaac

SEQ ID NO: 250857 - DNA, 2541 bp, Artificial Sequence
  Description of Artificial Sequence: Synthetic coding sequence
atggccaagcctctgaccgaccaagaaaagcggagacagatttccattcgcggcatcgttggcgtggagaacgtggccgaattgaaaaagagttttaaccgccatctgcactttacattggttaaagaccgtaatgtggcgaccacgagagactattatttcgctctggctcatacagtgagggaccatctggtcgggcgttggatccgcacgcagcagcactactatgacaaatgtcccaagcgggtatactacctctctcttgaattttacatgggacgaaccttgcagaacacaatgattaatctcggcctgcagaacgcatgcgacgaggccatttatcagctcggcctcgacatcgaagagctggaggaaatcgaggaggacgcaggtctcgggaatgggggcttgggccgtttggctgcctgcttcctcgattcaatggccaccctgggtctcgctgcctatggctatggtatccggtacgagtacggaatttttaatcagaagattcgcgacggttggcaagtcgaagaagctgacgactggctgagatacggcaatccctgggaaaagtccaggcccgaattcatgctgccggtgcacttttacggcaaggtggagcacacgaacaccggaacaaaatggatcgacactcaggtcgttttggcacttccatatgacacccctgtcccaggctacatgaacaacactgtgaatacaatgagactgtggtctgcgagagctccgaatgattttaatttgcgtgatttcaacgtgggcgactatatccaagcagtgttggacaggaatttagccgagaacataagcagagtgctatatcctaacgataactttttcgagggcaaagagctgcggcttaagcaggagtatttcgtagtcgcagctacgctgcaggatatcatccgacgctttaaagcctccaagttcggctcgactaggggtgccggaaccgtatttgacgcgtttccggaccaggtagccatccagctgaacgatacccatccagccctggctatcccggaactgatgaggatctttgtcgacatcgaaaagctcccttggagtaaagcctgggagcttacccagaagactttcgcttacaccaatcatacagtcctgcctgaggccctggaaagatggcctgtcgacctggtggagaaactactgcccaggcaccttgagatcatctacgagattaatcagaaacacttggatcgaattgtggccctgtttcctaaagacgtggatcgcttgcgaagaatgagcttgatcgaggaggaaggaagcaagcgaatcaacatggcgcatttatgtatcgtgggctcgcatgcagtcaacggcgtggccaagattcactctgatattgtaaaaacaaaagtcttcaaggactttagtgagttagagcccgataagtttcaaaacaagacgaacggtatcacgcctcgccggtggttgctgctgtgtaatcccggtctggctgaactgatagccgagaagatcggggaggattacgtgaaggatttatcccagttgaccaaactacactcatttctgggcgatgacgtctttctgcgagaactggccaaggttaaacaggagaacaagttgaaatttagtcagttcctagaaaccgagtataaagtcaagatcaaccctagttctatgtttgatgtgcaggtgaaacgaatacacgagtacaagcgccagttattaaattgcctgcacgtcatcactatgtacaatcggatcaaaaaggatcccaagaagcttttcgtgccaagaacagtcatcattggtgggaaggccgctcccggttatcatatggccaagatgatcatcaagttgatcacaagtgtcgccgatgtggtcaataacgaccctatggtgggcagtaaactgaaggtcatcttcctggagaattatagagtgagcctcgccgagaaggtcattcctgccaccgacctctctgagcaaattagcaccgctggcaccgaggcgagcgggaccggaaatatgaagttcatgcttaatggcgctcttactataggtactatggatggagccaatgtcgagatggcagaggaggccggcgaggagaacttgtttatctttggcatgcggattgacgacgtggcggcactcgataaaaagggctacgaggccaaggagtattacgaggccctgcctgagctcaagctggtcattgatcagatcgacaatggtttctttagcccaaaacagcccgacctcttcaaggacattatcaatatgcttttctatcacgaccgctttaaagtgtttgcagactacgaagcctatgtaaagtgccaagacaaggttagccaactttacatgaaccccaaagcgtggaatacgatggttttaaagaatattgcagcctctggtaagttctcatctgacagaacaatcaaggagtacgcgcagaacatttggaacgtggagccttcagatctgaagatctctctgtctaacgagagcaataaggtgaacggaaat

SEQ ID NO: 250858 - DNA, 2541 bp, Artificial Sequence
  Description of Artificial Sequence: Synthetic coding sequence
atggctaagcctctaacagaccaggagaagcgtcggcagattagtatacggggcatcgtcggagttgaaaacgttgcggagctcaaaaagtctttcaatcggcacctccatttcactctggttaaggaccgaaacgtagcaaccacacgcgattactatttcgctcttgcccataccgtccgtgaccatctcgtgggccggtggattaggacacaacaacattactatgacaagtgtcctaagcgggtttactatctgtctctggagttctacatgggccgaacattgcagaataccatgataaacctgggtttgcaaaatgcctgcgacgaagccatatatcagttgggactggacatcgaagagctcgaggaaatcgaggaagacgcaggcttaggcaacggcgggctgggacgacttgccgcctgcttccttgactcaatggccacactcggcctcgccgcttatggctatggcattcggtacgagtatgggatctttaatcagaaaatacgggacggatggcaggtcgaagaggccgacgactggcttcggtacgggaacccatgggaaaaaagcaggccagaatttatgctcccagtgcacttctatggcaaagtggagcacaccaacacgggaacgaagtggatcgatactcaggtagtccttgccctgccgtatgataccccggtgcctggctacatgaataacacagttaatacaatgaggctgtggtccgcccgcgctcctaatgacttcaacctgagggatttcaacgtcggggactacattcaggctgtgctggatcggaacctggcagaaaacatctccagagtcctatacccgaacgataacttttttgaagggaaggagctacggcttaaacaggagtattttgttgtggcagccacgttgcaggacatcatccgcaggttcaaagccagcaagttcggtagtaccaggggagcaggtacggtattcgatgctttccctgatcaagtggcaattcaactgaatgacacacatccggccctggccatccctgaattaatgcgcatcttcgtagacatcgagaaactgccctggtctaaggcctgggagctcacccagaaaacctttgcctacacgaaccatacagtgctccctgaggcgctggagagatggccagtcgaccttgtggaaaagcttcttcctaggcaccttgagataatctacgaaataaatcagaaacacctcgatcggatcgtagcactcttcccaaaggacgtggaccggctgaggcgtatgagtctcatagaagaagagggatccaagcggattaacatggcccacctgtgcattgttggatcccacgccgtgaacggtgtggccaagattcactccgatatcgtgaaaaccaaggtcttcaaggatttcagtgaactggagcctgacaagtttcaaaacaaaaccaacggtatcacacctcggcgttggctcttgttatgcaacccagggctagccgagcttatcgccgagaaaattggcgaggattacgtgaaagacctctcacagcttactaagcttcacagctttctaggagatgatgtttttttgcgagagctggcgaaagtgaagcaggaaaacaaactcaaattttcgcagttcctggagacagagtataaggtgaaaatcaacccttccagtatgttcgacgtccaggttaagcggatccatgagtataaaagacagctgctcaattgtctccatgtgattaccatgtataacagaatcaaaaaggatccaaagaaactgttcgtaccacggaccgtgatcattggagggaaggcagcacctggctatcatatggccaagatgatcatcaagcttatcaccagcgtcgcagatgtggtgaacaacgatcccatggttggctctaaactcaaggtgatcttcctggaaaattaccgagtcagcctggctgagaaggtgattcctgctaccgacctgagcgagcaaatctcaaccgccggaactgaggcctccgggacgggcaacatgaaattcatgctcaacggcgcacttactatcggtactatggacggcgccaacgtggagatggccgaggaagccggagaagaaaacctgttcatcttcgggatgcggattgacgacgtggccgccctagacaaaaagggctatgaggccaaggagtactacgaggccttgcccgaattgaaactcgtcatcgatcagatagacaatgggttcttttccccaaagcagccggatctctttaaggatatcataaatatgcttttctaccatgaccggtttaaagtctttgccgactatgaagcctatgtgaagtgccaagataaagtctcacagctgtacatgaatcccaaggcttggaatactatggtactcaagaatatcgcggctagtggaaaatttagcagtgatcggacaattaaggagtacgcccagaacatttggaacgttgagccctccgatctgaagatatccctctccaacgaatccaataaggtgaatggaaat

SEQ ID NO: 250859 - DNA, 2541 bp, Artificial Sequence
  Description of Artificial Sequence: Synthetic coding sequence
atggcaaaacccttgaccgatcaggaaaagcgccgccagatctccattaggggtatcgtgggagttgagaatgtggccgagctgaagaagtccttcaacagacacctgcatttcaccctcgtgaaggatcgcaatgtcgctactactcgagattactacttcgccttggcacacaccgtgcgggatcacttggtcgggagatggatcaggactcaacaacactactacgacaaatgcccgaaaagagtctattatctgtcgctggagttctacatgggacgcaccttgcagaataccatgataaatcttggcctccaaaacgcctgcgatgaggctatttaccagctgggactggacatcgaggagctggaggagatcgaggaagatgcagggctgggcaatggaggtctggggcgcctggctgcctgcttccttgattcaatggccaccctggggctcgctgcctacgggtacgggatccggtatgaatacggcattttcaaccagaagatccgggatggatggcaagtcgaagaagccgatgactggctccggtacggaaacccatgggaaaaaagccgcccagagtttatgcttcctgtgcatttctacgggaaagtcgaacacaccaacaccggcactaaatggatcgacacccaggtggttctggcgcttccgtacgatacgccagtgccgggatacatgaacaataccgtaaataccatgcgcctgtggtccgcaagagcccccaatgactttaacctccgcgacttcaatgtgggcgattacatccaagcagttctggaccggaacctcgcggaaaacatttcccgggtcctgtaccctaacgataactttttcgaaggtaaggaactcagactgaaacaggaatactttgtggtggcagcaactctgcaggatatcatccgccgcttcaaggcttcgaagttcggaagcactcggggagccggcaccgtgttcgacgctttccctgatcaggtcgcgatccagttgaatgacactcaccctgcgcttgccatcccggaactgatgagaatcttcgtggatatcgagaagctcccgtggtccaaggcctgggagctgacccaaaaaacctttgcctacaccaaccacaccgtgctccctgaagcgctcgaaaggtggccggtggacctcgtcgaaaagctgttgcccaggcacctggagatcatttatgagattaaccagaagcaccttgaccggatcgtcgcgctgttcccgaaggacgtggatagattgagaaggatgtcgttgattgaagaagaaggaagcaagcgcatcaacatggcccatctttgcatcgttgggagccacgccgtcaacggagtggccaaaatccattccgacatagtgaaaactaaagtgttcaaggacttctcggagcttgagccagacaagttccaaaacaagactaacgggatcaccccacggagatggctgctcctctgcaacccgggactggcagagctgatcgccgaaaagattggcgaagattacgtgaaggatttgtcacaactgactaagctccatagcttcctgggagatgacgttttcctccgggagctcgcgaaggtgaagcaagaaaacaagctgaaattctcacaattcctggaaacggaatacaaggtgaaaatcaacccgtcgtcgatgttcgatgtgcaggtgaagcggatccatgagtacaagcggcaattgctgaactgcctgcatgtgattaccatgtacaacagaatcaagaaggaccctaagaaactgttcgtgccgagaactgttatcatcggaggcaaggcagccccgggatatcatatggcgaaaatgatcattaaactgatcacttccgtggccgacgtggtgaacaacgacccaatggtgggttcaaagttgaaagtcatcttccttgagaattacagagtctccctggccgagaaggtgattcccgccacggacctgtcggaacagatcagcaccgccggaactgaagcgagcggaaccggtaacatgaagtttatgctgaatggcgcattgactatcggaacgatggacggcgctaacgttgaaatggcggaagaagctggagaggaaaacctgttcatctttggcatgcgcattgacgatgtggccgccctcgacaagaagggctacgaggccaaagagtactacgaagccctgccggagttgaagctggtgatcgaccagatcgacaatggcttctttagtccaaagcagccagaccttttcaaggacatcatcaacatgcttttctaccacgaccgctttaaggtctttgctgactacgaggcatacgttaagtgtcaagacaaagtgagccagctgtacatgaaccccaaggcatggaataccatggtgctcaagaacatcgcagccagcggtaagttttcctccgatagaaccataaaggaatacgctcagaacatctggaacgtggagccttcggatttgaagataagtttgtccaatgaatccaataaagtgaacggcaat

SEQ ID NO: 250860 - DNA, 2541 bp, Artificial Sequence
  Description of Artificial Sequence: Synthetic coding sequence
atggcaaagcctcttaccgatcaagagaagagacgtcaaatatccatccgcggtatcgtgggagtggaaaacgtggcagaactgaagaaatcattcaatcgtcatcttcactttaccctggtgaaagatcggaacgtggccaccaccagggactactactttgcacttgcacatactgtgcgggatcacctggtcggaaggtggattagaacgcaacagcattactacgataaatgtcccaagcgcgtgtactacctgtccctggaattctacatggggagaactcttcagaatactatgattaacctcggcctccaaaacgcatgtgacgaggcaatttaccagctgggtctggatatagaagaactggaagaaattgaagaagatgccgggcttgggaatggtgggctgggaaggctggcagcttgcttcctggatagcatggccaccctcggcctcgcagcatacggctacgggattagatacgaatacggcatctttaaccaaaagattcgcgacggatggcaagtggaagaagcagatgactggttgcggtacggtaatccttgggaaaagagcagaccagagtttatgctgccagtgcatttctacggaaaagtggagcacactaacaccggaaccaagtggattgatacccaggtggtcctggccctgccttacgatactcctgtgcccggttacatgaacaacactgtgaacacgatgcgcctttggtcagcacgtgcaccgaatgactttaatctcagggatttcaacgtgggagattacattcaggcggtgctggatcgcaacctcgcagaaaacatctcacgggtgctgtacccaaacgacaacttctttgaaggaaaagaactgcgactgaagcaagagtattttgttgttgccgcaaccctgcaggacataatcagacgctttaaggcctccaagttcggctccacgcggggagcaggaacggttttcgacgcatttccagatcaagttgcaatccaactgaatgacactcatcctgcattggcaatacctgaacttatgagaatctttgtggatattgagaagctgccttggtcgaaggcttgggagcttactcagaaaacctttgcatacaccaaccatactgtactgcctgaagcactggaaagatggccagtcgatctcgtggaaaagctcctgcctcgccatctggagataatctatgagattaatcaaaagcaccttgacagaatcgtggcactgttcccaaaggatgtggatagacttcgcagaatgtcccttatcgaggaggaaggttcgaagagaataaacatggcgcacctttgtattgtcggttcgcatgccgtgaacggagtggccaagatccacagcgatatcgtcaaaacgaaagtgttcaaagattttagcgagctggaacccgacaagtttcaaaacaagactaacggaataaccccacgccgttggcttttgctgtgcaatcctggccttgccgagcttatagccgagaaaattggtgaagattacgtcaaggacctctcgcaactcactaagctccactcattcctcggtgatgacgtctttctgagagaactggctaaggtgaagcaagaaaacaaactgaagttctcacagttcctggaaaccgaatacaaggtgaagataaatccttcctccatgtttgatgttcaagtgaagcgaattcatgaatacaaacgccaactgcttaactgcctgcacgtcattaccatgtacaatcgcattaagaaggatccaaagaaactgtttgtcccacgtacggtgatcattggcggtaaagcagccccaggctaccacatggcaaagatgattatcaaacttattacttcggtggcagatgtggtgaacaatgatccgatggtggggtcaaagttgaaggtgatatttctggaaaactaccgggtgtcgctggcagaaaaggtgattccagcgactgatctgtcggagcaaatttcgactgcaggtactgaggcaagcggaacgggaaacatgaagtttatgctgaatggtgcactgaccattggaaccatggatggagcaaatgtggagatggccgaagaggcaggagaggagaatctgttcatattcggtatgcgtatcgacgacgtcgcagctttggataagaaaggctacgaagcaaaagaatactacgaagcactgcctgagctgaagctcgtgatcgatcagatcgacaacgggttcttttccccgaagcaaccagacctgttcaaagacattatcaatatgctcttctaccatgacagattcaaagtgtttgctgactacgaagcatacgtgaaatgtcaagataaagtctcgcagctttacatgaaccctaaggcctggaacactatggtgctgaagaatattgctgccagcggaaagttttcctcggacagaaccatcaaggaatacgcacagaacatttggaacgtggaacctagcgaccttaagatctccctttctaatgaatcgaataaagtgaacggcaac

SEQ ID NO: 250861 - DNA, 2541 bp, Artificial Sequence
  Description of Artificial Sequence: Synthetic coding sequence
atggctaaaccactcactgaccaggaaaaaagacgccagatctctatcagaggaattgtcggcgtggagaacgtggccgaactcaaaaaatcgttcaacaggcatctccacttcacgctggtaaaggatagaaacgtggccaccactcgggattactactttgcgctcgcacacacagtgagagaccacttagttggccggtggataaggactcagcagcactactacgacaaatgtcctaaaagagtgtactacctgtcactggagttctacatgggccgaactctgcaaaataccatgattaacctgggacttcaaaatgcatgcgacgaggcgatctatcaactcggtctcgacattgaggagcttgaggaaattgaggaggatgcgggcctgggtaacggtggtcttggccgcttagcagcatgctttctggatagcatggcaacactcggattggcagcgtacggatacgggatcaggtacgagtacggcatattcaaccagaaaatccgggatggctggcaggttgaggaggccgacgactggctccgttatggtaatccatgggagaagagccggcccgagtttatgcttccagtgcatttctatggaaaagttgaacatacaaacactggcaccaagtggatagatacgcaggtggtcctcgccctcccgtacgacaccccggtccccggctacatgaacaatactgtaaacaccatgcggctctggtccgcccgagctcctaatgattttaatctgagggacttcaatgttggggactacatccaggctgtgcttgaccgaaatttggctgagaatatctctcgtgttctatatccaaatgacaactttttcgagggaaaggagctgcgcttgaagcaggagtacttcgtcgtggcagccaccctgcaggatatcatccgcaggttcaaggctagcaaattcggctccacaaggggggccggcaccgtgtttgatgcctttcctgatcaagtggccatccaactgaatgacacgcaccctgccctggccattcccgagttgatgcggattttcgtggacattgagaaactaccttggtccaaggcctgggagctgacccagaagacattcgcatatacgaaccacacagtgttgccagaagccctggaaaggtggccagtagatctagtggagaagctcctcccccgccacctggagatcatatatgagatcaaccagaagcatctagacaggatagtggccttgttccccaaagatgttgacaggctgcggaggatgtctctcatcgaggaagaaggctccaagcgaattaatatggctcacctgtgcatcgtcggatcacacgctgtaaacggcgtagctaagattcatagtgatatcgttaagaccaaggtttttaaagacttcagtgagctagagccagacaaattccagaacaaaacaaatggtataacgcccaggagatggctgttgctctgcaaccctggtctggcagaactcattgccgagaagataggtgaggattacgttaaggacctatcgcagctcacgaagctgcacagctttctgggtgacgacgtctttcttcgggaattggccaaagtcaaacaggaaaataaactcaagttctcacagtttctggagactgaatataaggtcaaaatcaatccctcctccatgttcgacgtgcaggtgaagcggattcatgaatataagcgacagttgctgaactgcctccatgtgatcaccatgtataacaggattaaaaaagacccaaaaaagctcttcgtgccgcggacggtgatcataggtggtaaggccgcaccagggtaccatatggcaaagatgataattaagctcatcacctctgtggcggacgtggtgaataacgatcccatggtgggctccaagctgaaggtgattttcctggagaattaccgtgtctctcttgcggagaaagtcatccccgccacagatctcagcgaacagatctctacagcaggaactgaggcgtcaggcacggggaatatgaagtttatgctgaatggcgcactgaccattgggacgatggacggtgccaatgtggaaatggccgaggaggctggtgaagaaaacctgtttatcttcggcatgcgcattgacgacgttgcagcgcttgacaagaaaggttatgaggctaaggagtactacgaggccctgcccgaactcaagctggtgatcgatcaaattgacaatggattcttctcccccaaacaaccggatttgttcaaggacattatcaacatgctcttctatcatgatcggtttaaggtgttcgccgattacgaggcctatgtcaagtgtcaggataaggtgagccagctctatatgaacccgaaggcctggaacacaatggtgcttaaaaatattgctgccagcgggaagttctcttctgatcgaactataaaggagtacgcacagaatatatggaatgtcgagccctctgacctcaagatcagcctatccaacgagtctaataaagtaaatgggaat

SEQ ID NO: 250862 - DNA, 2541 bp, Artificial Sequence
  Description of Artificial Sequence: Synthetic coding sequence
atggctaagccactgacagatcaggaaaaaaggcgccagattagcatcagaggaattgttggggtagagaatgttgcggagctgaaaaagagctttaataggcatctgcacttcaccctcgtaaaggataggaatgttgcaactactcgcgattattacttcgccctcgctcatacggtgagagatcatctggttggaaggtggatcagaacccagcagcattattatgataagtgcccaaagcgagtgtattacctgtccctcgagttctacatggggagaactctgcaaaacaccatgattaaccttggcctccagaatgcctgtgacgaagctatctatcaactggggctcgacatcgaggagctcgaagaaatcgaggaagatgcaggcctggggaacggcgggctcggccgcctggccgcctgctttctggactcaatggccactctggggctcgcagcctatgggtatgggattcggtatgaatacggcatattcaaccagaaaatccgggacggctggcaagttgaagaagcggacgattggctcaggtatgggaatccatgggaaaagtcacgccccgaatttatgctgcccgtgcacttttatggcaaggttgagcacaccaatacggggaccaaatggattgatactcaagtggtgctcgccttaccttatgataccccggtgcctggctatatgaacaacaccgtaaatacaatgaggctttggtcggcaagggctcccaatgacttcaatcttcgggatttcaacgtgggggattacatccaggccgtgctggaccggaatctggctgaaaacatcagtagggtgttgtatcctaacgataactttttcgagggcaaggagttgcgactgaagcaggaatactttgttgtcgctgccacattgcaggacataatccgccgatttaaggccagcaaatttggcagcacccgcggggcgggaacagtcttcgatgccttcccagatcaggtcgccattcagctgaacgatacccacccagcccttgcgattcctgagcttatgcggatatttgtcgacatcgagaagctcccttggtccaaagcttgggagttaacgcaaaagacgttcgcttacaccaatcataccgtcctgcctgaggccttggagaggtggcctgtagacctcgtggagaagcttttacctagacacttagagatcatatacgagattaaccagaaacacctggaccgaatcgtcgccctgttcccaaaagacgtggacaggctgcgtcggatgtccctcatagaggaggagggcagtaagagaattaatatggctcatctttgcatagttggcagtcacgctgttaatggagttgccaagatccattctgatattgttaagaccaaggttttcaaggattttagcgagcttgaacctgataagttccagaacaagacaaatggcattacgcccagacgatggttgctcctttgtaaccccggcctggctgaactgatagcggaaaaaataggggaagactatgtcaaggacttaagtcagcttactaagctgcattcattcctcggtgatgacgttttcctgcgtgaattggccaaggtgaaacaggaaaacaagctgaagtttagtcagtttttggaaacggagtacaaggtgaagattaacccttcaagcatgttcgatgtgcaggtcaagagaatccacgagtacaagagacaattgcttaattgcctgcatgtaatcaccatgtacaatcgtatcaaaaaggacccaaagaaactgttcgtgcctcgcacagtgatcatcgggggcaaggctgcaccaggctaccacatggcgaagatgatcatcaagctcattacatctgtggcagatgtggtcaataacgatcccatggtgggctctaagttaaaagtgatctttctagagaattaccgcgtttcactggccgagaaagttatccccgccaccgacctgtccgaacagatttcgacagccggcaccgaggctagtggcacaggaaatatgaaattcatgctaaacggtgcacttactattggcactatggatggcgccaacgtggagatggcggaggaggccggcgaagaaaatctctttatctttggaatgagaatcgacgacgtggccgcactggacaagaaggggtacgaggccaaagagtactacgaggccctgccagaactgaagctggtaattgaccagatagacaatggcttcttttcaccaaagcagcccgacctttttaaagatatcatcaatatgttgttctatcacgatcgcttcaaggtattcgctgactatgaagcatacgtgaagtgccaggataaggtctcacagctgtacatgaacccaaaggcctggaacaccatggtactgaaaaacattgcagccagcgggaaatttagtagcgaccgtacgatcaaagagtatgcccaaaatatttggaatgttgaacctagtgatctgaagatttcactctctaacgagagcaataaagtgaacggcaac

SEQ ID NO: 250863 - DNA, 2541 bp, Artificial Sequence
  Description of Artificial Sequence: Synthetic coding sequence
atggccaagccgctcaccgatcaggagaagaggcggcagattagtatcagaggaatcgtgggtgttgagaacgtagccgaactgaagaagtcctttaacaggcatcttcacttcaccttggtgaaggataggaatgttgctactacacgggactactacttcgcactggctcataccgtgcgggaccatctggttggaaggtggatcaggacgcagcagcactattacgataagtgccctaagagggtgtattatctaagcctagaattttatatgggcagaaccctccaaaatacaatgattaacctcggcttgcaaaatgcttgcgacgaggcaatctatcaactagggctggacatagaggagctggaggagattgaggaggacgccggcctgggcaatggcggcttagggcgcctggccgcttgttttctcgactccatggccacactcggcctcgcagcctacggttacggcatccgctatgagtacggcattttcaatcaaaagattagggacggctggcaagtcgaggaggccgatgattggctgcgctacggaaacccttgggagaagagccgcccagaattcatgctgcctgtccacttctatgggaaggtggagcataccaacaccggtactaaatggatagatacccaggtggtccttgctcttccctacgacacccccgtgcctggctatatgaataatacagtgaacactatgaggctgtggtctgctcgtgcaccaaacgacttcaatctcagggacttcaatgtgggggattacattcaagccgtgcttgacagaaatctagctgagaatatcagcagggtgctttatccaaacgataatttcttcgaaggtaaggaactgcgcctaaaacaggagtatttcgtcgtcgcagctacgcttcaagatatcatccgcagattcaaagctagcaaatttggatctacaagaggggcgggtacagtattcgatgctttccctgatcaggtcgctatacagctgaatgacacccaccctgcccttgctatccctgagctcatgcgaattttcgtggacatcgaaaagctcccctggagcaaggcctgggagttgactcagaagacctttgcctataccaatcatacagtcctgccagaagccctggaaagatggccagtggaccttgtagaaaagctcttgcccagacacctggagataatctacgagatcaatcaaaagcaccttgatcgcattgtggccctgtttcccaaagatgtggaccggctccgccgtatgagccttatagaggaagaaggaagtaaaagaattaatatggcacacctttgtattgttgggtcccacgcggtgaacggggttgctaaaatacattccgatatcgtgaagaccaaagtgttcaaagacttctcagaactggaaccagacaaattccaaaacaagaccaatggaattacccctaggaggtggctgctgctctgtaaccctgggctggctgagttgatcgcagagaaaatcggggaagactacgtgaaggatctatctcagctgaccaagctacatagcttcctgggtgatgacgtttttctgcgagagcttgcaaaggtgaaacaggagaacaagctgaaattcagtcagttcctggagacagagtacaaggtcaagattaacccctcgagcatgttcgatgtccaggtgaaaagaatccacgaatacaaacggcagcttctaaattgcctccacgtgatcaccatgtataataggattaagaaggacccgaagaagttgttcgtgccccggactgtcattataggaggcaaagctgcccctggataccacatggctaaaatgatcatcaagctgataacgagcgtggctgatgttgtgaataacgacccgatggtggggtcaaaactcaaggtcatttttttggagaactatcgtgtcagcctcgcagagaaggtgatcccagccacagatttgtccgaacagatttctaccgccgggactgaagcctccggaacaggcaacatgaagtttatgctgaacggcgcactcacaattggcaccatggatggggcaaacgttgaaatggccgaggaagcaggtgaagagaacctctttatattcggcatgagaatcgacgacgttgccgctcttgataagaaaggctatgaggccaaggagtactacgaagccctcccagagttgaagcttgttatcgaccagatagacaacgggtttttttcaccaaagcaaccagacctcttcaaggatatcattaacatgctgttttaccatgatagatttaaagtgtttgccgattacgaggcatacgtgaaatgtcaggataaagtctcacagctgtacatgaatccaaaagcatggaacaccatggttcttaagaatattgcagcctccggaaagttcagttccgataggaccatcaaagagtatgcacagaatatttggaatgtggagccatccgacctgaaaatctctctgtcaaacgagtcgaataaagttaatggtaat

SEQ ID NO: 250864 - DNA, 2541 bp, Artificial Sequence
  Description of Artificial Sequence: Synthetic coding sequence
atggcaaaacctttgacagatcaagaaaaacgtaggcagatttctatacgtggtatcgtcggtgtcgagaatgtggccgagctgaagaaaagctttaacaggcaccttcactttaccctggtcaaagacaggaacgttgctacaaccagggattattactttgcccttgcacatactgttagagaccacctggtgggaagatggatccgcacccagcaacactattacgacaagtgccctaagagggtgtactatctttcacttgaattttacatgggacgcactcttcaaaacactatgataaacctgggcttgcaaaatgcctgtgatgaagccatttatcagcttgggctggacatcgaagagctcgaagaaatcgaagaggatgcgggtctcggaaatggtggtttggggcgccttgcagcttgctttttggattccatggctacgcttggactggcagcttatggttacggaataaggtacgagtatggcatattcaaccagaagattagggacggctggcaggtggaggaggctgatgattggttgagatacggtaacccttgggagaaaagcagacccgaatttatgcttcctgtgcacttctacggcaaggtggagcacactaacactggaaccaagtggatcgatacacaagtagtcctggcactcccatacgacacccccgtgcctggctatatgaataatacggtcaatacaatgagactgtggtcggcacgcgctccaaatgactttaacttgagagattttaacgtcggagactatattcaagctgtgcttgataggaaccttgctgagaatatcagcagagtattataccccaacgataacttttttgagggcaaggagttgagacttaagcaggagtatttcgttgtggctgctactctgcaagatatcattaggaggtttaaagcctcaaagtttggaagcacaagaggggcgggaacagttttcgatgcattcccagatcaggtggctatccagcttaacgatacccatccagctttggctatccctgagcttatgcgaattttcgttgatatcgaaaaacttccatggagcaaagcatgggagttgacacaaaaaactttcgcgtacacaaatcacacagtacttcccgaagccctggaaagatggcccgtggacttggtcgagaaactcttaccccgacatctcgagattatctacgaaatcaaccagaagcatcttgacagaatcgttgcccttttccccaaagacgtcgatcgattgcgcagaatgagcctcattgaggaagagggcagtaaaagaatcaacatggcccacctttgcattgtcgggtcgcatgctgttaatggcgtggctaagatacactccgacatcgtcaagaccaaagtgtttaaagacttttcggagttggagccggacaaatttcaaaataaaacaaacggtattactcctcgtcgctggctcctgctctgcaaccctggactcgcagaactgatcgctgaaaaaataggtgaggactacgtgaaggacctgtcccaactcacaaagcttcatagctttctgggagacgatgtcttcctacgcgaactcgctaaggtcaaacaggagaacaagcttaagttcagccagtttttggagaccgaatacaaagtgaagattaatccaagctcgatgtttgatgtacaggtcaaaaggatccatgaatacaagagacagctcctaaactgcctgcacgttattaccatgtacaaccgcatcaaaaaggatcccaagaagctgtttgttccaaggacagtcattattgggggcaaagcagcacccggctaccacatggccaaaatgattataaaactcattacctccgtggccgatgtcgttaacaacgaccctatggtcggtagcaagctgaaagttatctttctggagaactatagggtcagccttgctgagaaagtgattcctgctacagatttgtcagagcaaatctccactgccgggaccgaggctagcggcacgggaaacatgaagtttatgcttaatggagcactgaccataggaacaatggatggagctaacgtggagatggctgaagaggccggggaggagaacttgttcatctttggaatgaggatcgatgacgttgccgcactggataaaaaaggttacgaagcgaaagagtactatgaggcactgcctgagctgaaactggtaattgaccaaattgacaacgggtttttttctccaaaacagccggatctctttaaagatattatcaacatgctcttctatcacgataggtttaaggtttttgctgactatgaagcgtatgtcaaatgccaagacaaagtgtctcaattgtatatgaatcccaaagcctggaacactatggtgctgaaaaacattgcagcaagcggcaaatttagttccgacagaaccatcaaggagtacgcccaaaatatttggaacgtcgaaccatcagacctcaagattagtttgagcaacgaaagcaataaggtcaacggcaat

SEQ ID NO: 250865 - DNA, 2541 bp, Artificial Sequence
  Description of Artificial Sequence: Synthetic coding sequence
atggccaaacccctcaccgaccaagagaagcggcgccagattagcataaggggcatcgtcggcgtggaaaacgtcgcagagttaaagaaaagcttcaaccggcaccttcactttacactggtcaaggacaggaacgtggcgaccactcgtgattactactttgccctggctcatacagtccgggatcatctggtaggtaggtggatcaggacacagcagcattactatgataaatgtccgaaaagggtttactacttatcactggaattttatatggggcggacactccagaatactatgatcaacctgggtctccagaatgcatgtgatgaggccatataccagctgggcctggacattgaggagctggaagagatagaagaagacgccgggctgggcaatggcgggctgggtcgactggccgcgtgtttcctcgatagtatggccacactgggactcgcagcctacggatacggcattcgctacgaatatggcatattcaaccagaaaatccgggacggctggcaggttgaggaggccgatgattggctacgatatggtaatccatgggagaagtcccggccggagttcatgcttcccgtgcacttctatgggaaggtggaacacacaaatacaggcactaagtggatcgatacgcaggtcgtgctggcgttaccctacgatacccccgtgcccggctatatgaataatactgtcaataccatgcggctttggagcgccagagcccccaacgattttaatctacgtgatttcaatgtgggagactacattcaggccgtgctggaccggaatctggccgaaaacatttcccgggtcctgtaccccaacgacaacttttttgagggaaaagaactccgactgaaacaggagtacttcgtggtggctgccaccctgcaagatataattaggagatttaaagcctctaaattcggttcaacacgaggcgcagggaccgtgttcgacgccttcccagaccaggtcgctatacagctcaacgatacccatcctgctctggccatcccagagcttatgagaatctttgtggatatcgagaaactgccatggtcaaaggcctgggaactgacacagaagaccttcgcctatactaatcacactgtgctccctgaagccctagaacgatggccggttgaccttgttgaaaagttgctccccagacacctcgagatcatctatgagataaatcagaagcacctcgatcgaattgtggctctgtttcccaaagatgtggaccgtctcagacgcatgtccctgatagaggaggagggctctaagaggattaatatggcacatctttgcatcgtgggtagtcacgccgtgaatggagtggccaaaatccactctgatatcgtgaaaaccaaagtcttcaaggacttttctgaactggaacctgataagttccaaaacaagacaaacggtatcacccctaggcggtggttgcttttatgcaatcccgggctcgctgagctgatagccgaaaagattggcgaggactatgtaaaggatctgtcccagctgaccaaactgcatagcttcctaggagacgacgttttcctccgcgagctggccaaagtgaaacaggaaaataagctgaagttttcccagttcctggagaccgagtataaagttaagataaatccttcgtctatgttcgacgtccaagtgaaaaggattcatgagtacaagcgccaactgctgaattgcctgcacgttatcaccatgtacaatcggatcaaaaaggacccaaagaaactgtttgtgcctcggaccgttatcattggcggcaaagcagccccaggttatcacatggccaagatgataattaagctgatcacaagcgtagcagatgtagtcaacaatgaccctatggtcggttctaagttgaaagtgatcttccttgaaaattatagagtctccctcgccgaaaaagttatcccagctactgatttatctgaacagatctcaaccgcaggcacagaggcctccggtaccggtaacatgaagttcatgctgaatggtgccttgacaatcggtacaatggacggagccaatgtcgagatggcagaagaagctggtgaagagaatttgttcatcttcgggatgcgaattgacgatgtagccgcattggataagaaaggatacgaagccaaagaatattatgaggcgctcccagagctgaagctggtgatagatcagatagataatggatttttctcacccaagcagccagacctgtttaaggatattattaacatgctgttctaccatgaccggttcaaagttttcgcggactacgaggcttatgttaaatgccaagacaaggtgagtcagctgtacatgaatcctaaagcgtggaataccatggtgctgaagaacatcgccgcttctggcaagttcagctctgatagaaccataaaggaatacgcccagaatatttggaatgtcgaaccttcggacctaaaaatctcgttgagcaatgaatccaataaggtgaacggaaat

SEQ ID NO: 250866 - DNA, 2541 bp, Artificial Sequence
  Description of Artificial Sequence: Synthetic coding sequence
atggctaagcccctgactgatcaggagaagagaaggcaaatttcaattagaggaatcgtgggcgtggagaacgtggctgagctcaagaaatccttcaataggcaccttcacttcactctggttaaggatcgcaatgtggcgactactagagactactatttcgccctcgcccacaccgtccgcgatcatttggtgggaagatggatccggacacagcagcactattacgataagtgccccaagagggtctactacctgagtctcgagttctatatgggccgaacgctccagaacaccatgattaacctcggtctgcaaaatgcctgcgatgaagcaatctatcaacttggattggacattgaagagctggaggagatcgaggaagacgctggccttggcaacgggggcctcggccggctcgccgcttgctttcttgacagtatggcaacactcgggctggcagcctatggttacggaatccgatacgagtacggaatctttaatcagaagattagagacggatggcaggtagaagaggctgacgactggctgaggtacggcaacccgtgggaaaaaagtcggcccgagttcatgctgcccgttcatttttacggaaaggttgagcacaccaacacaggcaccaagtggattgacacacaggtggttctggctctgccttatgatactcccgtgcccgggtatatgaacaacacagtcaatactatgcgactgtggagtgcacgcgctcccaacgactttaatctgagggattttaatgtcggcgactacatccaagcagtgttggacaggaacctcgctgaaaacattagcagggtgctgtatccaaacgataatttttttgagggcaaggagctgcggttgaagcaggagtacttcgtggtggccgcgacactgcaggacataatcaggcgcttcaaagcttccaaattcggcagcactaggggcgctggaaccgtgttcgatgccttccccgaccaggtggccattcagctcaacgacacccacccggcccttgctataccagagctgatgagaatattcgtggacattgaaaagctgccgtggagcaaggcttgggaactgacacagaaaactttcgcttacaccaatcatacagtccttccagaagcactggaacgctggccagtagatcttgtggaaaagctgctccccagacatcttgaaataatttatgagatcaaccaaaagcatttggacaggatagtcgctctgtttccgaaggacgtggaccgcctccgcagaatgtcactgattgaggaagagggctctaagagaatcaatatggctcatttgtgtattgtagggtcccatgcagtgaatggcgtggctaagatccattccgatatcgtcaaaacaaaggttttcaaggatttctccgagcttgagcctgacaagtttcagaataagaccaacggaataactccccggagatggcttcttctttgcaatcctgggctcgcggaactgattgcagaaaaaattggcgaggactacgtcaaagacctgtctcagttgaccaagctgcatagctttctgggcgatgacgttttccttagagagctcgcaaaagtgaagcaagaaaacaaactgaaatttagtcaattcctcgagactgagtataaagtgaagatcaacccttctagcatgttcgacgtgcaggtgaagcggattcacgaatacaagcggcagcttctgaattgcctccacgtgatcactatgtacaatcgaataaaaaaagaccccaaaaagctgtttgtcccacggactgttattattggaggaaaggcagctccgggctaccatatggccaagatgattattaagttgatcacttcagtggccgatgtagttaacaacgacccgatggttggaagcaagctgaaagtgattttcctcgagaattatagggtttctttggctgagaaggtgataccggccactgacctcagcgagcagatctctaccgctggaacagaggcttctggcacgggtaacatgaaatttatgctgaatggagcgctcaccatcggtaccatggacggcgcaaacgtggagatggcagaggaggctggggaagaaaacctgtttatctttggaatgcgcattgacgatgtggcagcactggacaagaagggttacgaagcaaaggagtactatgaggccctgcctgaactgaaacttgttatcgaccagatcgacaacggtttcttctcccctaagcaacccgacttgtttaaggatatcatcaacatgctgttttatcatgatcgattcaaggtcttcgctgactatgaggcttacgtgaaatgccaggacaaggtgagtcagttgtatatgaatcctaaagcttggaacaccatggtcctcaaaaacatcgccgcatctggcaagttttcctctgatcgaacgattaaggagtacgcacagaacatctggaacgtggagccctcagaccttaaaatcagcctctccaacgagagtaacaaggttaatggcaat

SEQ ID NO: 250867 - DNA, 2541 bp, Artificial Sequence
  Description of Artificial Sequence: Synthetic coding sequence
atggccaagccgctgacggatcaggagaagcgccgacagatctctattcgaggcatcgtaggtgtggagaacgtcgccgagctcaagaagtcgttcaaccgccatctccactttacgctcgtcaaggaccgaaacgtggcgactacgcgcgattactacttcgccttggcacatactgtgagggaccacttggtcggtcgctggatccggacccagcagcactattacgacaagtgtccgaagagggtatactacctgtcgctggaattctacatgggccgtaccctgcagaacaccatgatcaacctcggtctccagaacgcctgtgacgaagcaatctaccaattgggactcgatatcgaagaacttgaggagatcgaggaggacgctggactggggaatggtggtctgggccgtctcgctgcctgttttttggacagcatggcaacgctaggcctcgctgcctacggctacggcatccgctatgagtacggtatttttaaccagaagatccgtgacgggtggcaggttgaagaggccgatgattggttgcgctatggaaacccttgggagaagtcgcgccctgagtttatgttgccggtccacttctatggcaaggtggaacataccaatactggtaccaaatggattgatactcaagtcgtgctggccctcccgtatgatacccccgtgcctggttatatgaataacacggtcaataccatgcggctctggtccgcccgggcgcccaacgattttaacctgcgcgatttcaatgtcggtgactacatccaggcggtgctggaccgtaaccttgccgagaacatctcccgggtcttatatcccaacgacaatttcttcgagggcaaggaattgcgtctaaagcaagagtacttcgtagtggcagccactctccaggacattatccggaggttcaaggcctccaagtttggctcaactcgcggtgctggtaccgttttcgacgcgttccctgaccaggtcgccatccagctgaatgatacacaccccgccctggctatccctgagcttatgcgcatcttcgtcgacatcgaaaagctgccgtggagcaaggcgtgggaactcacccagaagaccttcgcctacactaaccatacggtgctgcccgaggcgttggagcgctggcccgtcgacctggtcgagaaacttctcccacgtcatctcgagattatctacgaaatcaatcaaaagcacctggatagaatcgtggcactattccctaaagacgtagatcgtctgcgacgcatgtctctcatcgaggaggagggctccaagcgtatcaatatggctcacctctgcattgtaggatcccacgccgtgaacggggtcgcaaagattcatagtgacatcgtcaagactaaagtattcaaggacttctccgagctggagcccgacaaattccagaacaagacgaacggtataacgccccgccgctggctgcttttatgcaaccccggcctagccgagctgatcgccgaaaagattggagaagattatgtgaaggacctgagccaattgaccaaactccattccttccttggagacgatgtttttctcagggagttggccaaagtcaagcaggagaacaagttaaagttcagccaattcttggaaaccgagtacaaggtcaaaattaacccttcttctatgttcgatgtccaggttaaacgtatacacgagtacaagaggcagctcttgaactgcctccacgtcatcacaatgtacaataggatcaagaaagacccaaagaagctctttgtgccccgtaccgttatcatcgggggcaaggccgcccccggttaccacatggccaagatgatcatcaagctgatcacctccgtggcggatgtggtcaacaacgaccccatggttggatctaagctgaaggttattttcttggaaaactaccgcgtttccctcgcagagaaggtgatccctgccaccgacctgtccgagcaaatctcgactgctggcactgaagcctctggcacaggtaatatgaagttcatgttaaacggtgcccttaccatcgggaccatggatggagccaacgttgagatggctgaggaggccggcgaggagaaccttttcatctttggcatgcgaatcgatgacgtcgccgcgctggacaagaagggatatgaggctaaggagtactacgaggcactgccggaattaaagctggtgatcgatcaaatcgataatggattcttcagtcctaagcagcccgacctctttaaggacatcataaacatgctgttctatcatgaccggtttaaggtctttgctgattacgaagcttacgtgaaatgccaggataaggtcagccaactctacatgaaccctaaggcgtggaacacgatggtgctgaaaaacattgctgcctccggcaaattttcctctgatcgcaccatcaaggagtacgctcagaacatctggaacgtcgagcctagcgatctcaagatcagtctttcaaacgaaagtaacaaggtgaatggaaac

SEQ ID NO: 250868 - DNA, 2541 bp, Artificial Sequence
  Description of Artificial Sequence: Synthetic coding sequence
atggcaaagccactaacagaccaggaaaaaaggcggcaaatttcaattcgtggaattgtcggtgttgaaaacgttgccgaactcaagaaatctttcaaccgtcatctacactttacgttggtgaaggataggaatgtcgctacaacccgcgattattacttcgctctggcgcataccgtgagggatcacctcgtcggtagatggatcagaacacaacaacactactatgataagtgtcccaagcgtgtatattatctctctctcgaattttatatgggacgtactcttcaaaatacgatgatcaacctcggactccaaaacgcttgtgacgaagcaatttatcagttagggcttgacatagaagaattggaagaaattgaagaggacgctggactaggaaatggtggacttggccgtcttgctgcttgcttccttgattccatggccactctgggattggccgcctatggatatggcatccgctatgagtatggaattttcaaccagaagatacgggatggatggcaagttgaagaggctgacgactggctgaggtatggtaacccttgggaaaagtcgaggccagagtttatgctaccagtccacttttacggaaaagtagaacacactaatactggtaccaaatggatagacactcaggttgtactcgctctcccatacgacacgccagtccctggatatatgaacaacactgttaacacaatgagactttggtcagcccgtgctcctaatgattttaatctacgtgattttaatgttggagattacattcaagcggtcctggatagaaatttggccgaaaatatatcacgggtgttgtatccaaacgacaatttcttcgaaggaaaggaattgagattgaagcaagagtactttgtcgtggcagcaacactacaagatattattagacgattcaaagcgagtaaattcggttccacacgaggagcaggaacagtctttgatgcgttcccagatcaagtcgcaatccaacttaatgatacacacccagctttggctattccagagctcatgcgtattttcgtggacattgagaaattaccttggtccaaggcatgggagttgacccagaagacgtttgcctatactaaccatacagttctcccagaggcacttgaacgttggccagttgatttggtagaaaaacttttaccacggcacttggaaattatttacgaaattaaccagaaacatctagaccgtattgtagctttgttcccaaaggacgtggaccgtttgcgtcgaatgtccttgatagaagaagagggatctaaacgaattaacatggcgcatctatgcattgttggctcccatgcagttaacggagtggctaagatccattccgatatagtcaagactaaagttttcaaggatttttcggaacttgaaccggacaagttccaaaataagaccaacggaataacaccacgtagatggttgttgttgtgtaacccaggtctcgctgagttaatcgcagagaaaattggagaagattacgttaaagatctttcgcagctgactaaacttcactccttccttggagatgatgtgtttctcagggaactagcaaaggttaagcaggaaaacaagctcaaatttagtcagtttcttgaaaccgaatataaggtcaagattaatccaagcagcatgtttgatgtccaagtaaagcgcatccacgagtataaaaggcaattactcaattgtttgcacgtcatcacgatgtataatcgtataaagaaggaccctaaaaaattgtttgtgccaaggacagtgatcatcggaggaaaagcagcacctggatatcatatggctaaaatgattatcaaacttatcacctccgttgcggatgtagtaaataatgatcctatggtgggatcaaaactaaaagttatatttttggaaaattatagagtttctttagctgaaaaggttatacccgcgactgatttgagtgagcaaatttcaacagcgggtacggaagcaagtggtacaggaaatatgaaatttatgcttaatggtgcgttaactatcggaacaatggatggagctaatgtggaaatggcagaagaagcaggtgaggagaatctgtttattttcggaatgcgaattgatgatgtcgctgctctcgataaaaaaggatatgaagcaaaggaatactatgaagccttaccagaactcaagctcgttattgatcaaatcgacaacggtttcttctctccaaaacaacctgatctgtttaaagatataatcaatatgcttttttaccatgatagattcaaggtgttcgcagattatgaagcctatgttaagtgccaagataaggtatctcaactgtacatgaacccaaaagcttggaatacaatggttctaaaaaatattgcagcctcaggaaagttctcatctgatcgcactattaaggagtacgctcagaacatttggaatgttgagccgagtgatctgaaaatctcattgtcgaatgaatcaaataaagtcaacggcaat

SEQ ID NO: 250869 - DNA, 2541 bp, Artificial Sequence
  Description of Artificial Sequence: Synthetic coding sequence
atggcaaagccgctcaccgaccaggagaagagacgccaaatcagcattcgcggtatcgtgggagtggagaacgtcgcggaactgaagaaatccttcaatagacacctccactttacgctcgtgaaggatcggaacgtggcgactacgcgggattactactttgcgctcgcccacacggtgagagatcacctcgtcggtcgctggattcgcacccaacagcactactacgacaaatgcccaaagcgcgtctactacctgagcttggaattctacatgggacggactcttcaaaacactatgatcaacctgggcctgcagaacgcgtgcgacgaggccatctatcaattgggacttgatatagaggagctggaggaaatcgaagaggacgcaggactggggaacggggggctgggtcgtctcgcagcctgtttcctcgatagcatggccactctgggtttggctgcatacggctacgggatcagatacgaatacggaatattcaatcagaagattcgcgacggatggcaggtcgaagaagcagacgactggctgcggtacggaaacccgtgggagaaatcccgccccgagttcatgctgccagtacatttctacggcaaggtggaacacactaataccggaactaagtggatcgatacccaggtcgtgctggccttgccttacgatacccctgtgccgggatacatgaacaataccgtgaacaccatgcgcctgtggtccgcccgcgccccaaatgacttcaacctccgcgacttcaatgtcggcgattacatccaggcggtgttggacagaaatctggcagagaacataagtcgggtcctgtacccgaacgacaacttcttcgaaggaaaggagctgaggctgaaacaagagtacttcgtcgtggcagctacccttcaagatatcatcaggcgctttaaggcgagcaagttcgggtcgaccaggggcgctgggaccgtgttcgatgctttcccagaccaagtcgcgatccagttgaatgacacccacccagccctggcgattccggagctgatgaggatttttgtggacattgaaaaactgccctggtcaaaggcatgggaactgactcagaaaactttcgcgtacaccaaccataccgtcctccctgaggcgcttgaaagatggcctgtggaccttgtggagaagctgctgccaagacacctcgagatcatttatgaaatcaaccagaagcacctcgatcgcatcgtagccctctttcctaaggacgtcgaccggctgagaaggatgtcactgatcgaagaagaaggatccaaacggatcaatatggcccatctgtgtatcgttggctcccacgcggtgaacggcgtggcaaagatccatagcgatatcgtgaaaaccaaggtgttcaaggatttctcggagctcgaaccggataagtttcagaataagaccaatggcatcacgccgcggcgctggcttctgctctgcaatccgggactcgctgagctgatcgcagaaaagatcggtgaggactacgtgaaggatctctcgcagctcactaaacttcatagcttcctgggagacgacgtttttctcagagagctggctaaggtgaagcaggaaaacaagctcaagttttcgcagtttctcgagactgaatacaaagtgaaaatcaacccctcctctatgttcgacgtgcaggtgaagcggatccacgagtacaaacggcagctcttgaactgcctgcatgtcatcactatgtataaccgcattaagaaggaccctaagaaactcttcgtgccccgaactgtgatcatcggcggaaaggcagccccgggctatcatatggccaagatgatcatcaagctgatcacctcggttgccgatgttgtcaacaatgatcctatggtgggctcgaaactcaaagtcatcttccttgagaactaccgagtgtccctcgccgagaaggtgatccctgcaactgacctctcggagcaaatctcgaccgctggaaccgaggcgtcaggcaccggaaatatgaagttcatgctgaatggggctcttaccattggaactatggacggagccaacgtggaaatggcggaagaagccggtgaagagaacctgttcatcttcgggatgcggatagatgatgtggccgcacttgacaaaaagggatacgaagccaaagaatactacgaagccctgccagaactcaagctcgtaatcgaccaaatcgataacggtttcttttcccctaagcaaccggacctgttcaaggacatcatcaatatgctgttctaccacgacaggttcaaagtgtttgcagattacgaagcctacgtgaaatgtcaggacaaagtttcccagctttacatgaacccgaaggcgtggaataccatggtgctcaagaacatcgccgcttccggaaaattctcgtcggataggactatcaaggaatacgcccagaacatttggaacgtggaaccaagcgacttgaagataagcctcagcaatgagagcaataaggtgaacggcaac

SEQ ID NO: 250870 - DNA, 2541 bp, Artificial Sequence
  Description of Artificial Sequence: Synthetic coding sequence
atggcaaaaccgctgacagaccaggaaaaacgaagacagatcagcattaggggtatcgtaggtgtagagaacgtggcagagctcaagaaaagctttaacaggcacttgcacttcacgctcgtcaaagatcgcaacgtcgccaccacaagagactattactttgcgctggctcacactgtccgcgaccacctagtgggtagatggatcaggacacagcagcattactacgacaagtgtcccaaaagggtgtattacttgtccctggaattctacatgggtcgaaccctccagaacaccatgatcaacctgggcctgcaaaatgcatgtgatgaagctatttaccagttggggctggatatcgaggagctcgaggaaatcgaggaagacgcaggcctggggaatgggggtttagggcgactggcagcatgctttttagatagcatggccaccctgggtttagctgcttatggatacgggattaggtacgagtacggaatatttaatcagaagatccgcgacggatggcaggttgaggaagctgacgattggctgcgctacggaaatccttgggagaagagtaggcctgaattcatgttacccgtccacttctatggaaaggtcgagcacacaaacactgggaccaaatggatagacacacaggttgttctcgctctgccctatgatacaccagtgcctggctacatgaacaacactgtgaacaccatgcgcttgtggtccgctcgggcccccaatgatttcaatctacgtgattttaatgtcggcgattatatccaggcagtcctggaccggaacctcgccgagaatatatccagggtgctctatcctaacgataacttcttcgagggtaaggagcttcgcctcaagcaagagtacttcgtcgtggctgccaccttgcaggatatcatccggaggttcaaagcctctaagtttggctccactcgtggcgcgggtacagtatttgacgccttcccagaccaggtggcgattcagctgaatgatactcaccccgcattggccataccagagcttatgcgtatatttgtggatattgagaagttgccttggagcaaggcttgggagctaacccaaaaaacctttgcctatacaaatcacacagtcctccccgaggcactagaaagatggcctgttgaccttgtcgaaaagctcctgccacggcatctggagatcatttacgaaatcaaccagaaacatcttgaccggattgtcgccctgtttcccaaggacgtggaccggctccgtaggatgtcactgattgaagaggaaggatccaaacggataaatatggcacacctgtgcattgtcggctcccacgccgtgaatggagtagctaaaattcacagcgatatcgtaaagacaaaggtttttaaagacttcagcgaactggaaccagataagttccagaacaagacaaacggtatcacccctcgccggtggctgctgctgtgcaacccaggactggcagagttgattgcagagaaaattggggaagattatgtgaaagatctgtcccagctcaccaagctacactcatttcttggggacgacgtgttcctgagagaactcgccaaggttaaacaggaaaataagctaaagttttcccagtttttggagaccgaatacaaagtcaagatcaacccatcttctatgttcgacgttcaggtcaagcgcatacacgagtataagcgacaactcctcaattgcttgcacgtgatcacgatgtacaaccggatcaagaaggaccccaaaaagctgttcgtcccaagaactgtaattatcggcggaaaagccgctcctggctaccacatggcgaagatgatcattaagcttatcacatcagtggccgacgtggtaaataacgaccccatggtggggagcaagctcaaggtaatattcttggagaactaccgggtctccttggccgagaaggtgatcccggccaccgacctaagcgagcagattagcacagctggcaccgaggcatcagggactggaaatatgaagttcatgctaaacggagctctcaccatcggcacaatggacggagccaatgtggaaatggctgaagaggcaggcgaagaaaacttattcatattcggcatgagaattgatgacgtagctgctctcgataagaaggggtatgaagctaaggagtattacgaagcgcttcccgagttgaaattagtgatcgaccagattgataacggcttcttctcgccaaaacaaccagatctattcaaagacatcatcaatatgctgttctaccatgaccgctttaaagtgttcgctgactatgaggcatacgtgaagtgccaggataaggtgtctcagctttacatgaatcccaaagcctggaatacaatggtccttaagaatattgcggcatcaggaaagttcagctcagatagaactataaaagaatatgcccagaatatttggaatgtggaacctagcgatttgaagatcagtctgagtaacgaaagtaataaggtgaacggtaat

SEQ ID NO: 250871 - DNA, 2541 bp, Artificial Sequence
  Description of Artificial Sequence: Synthetic coding sequence
atggcaaagcctctcacggaccaggagaaacggaggcaaatctcaattagaggcatcgttggagtggaaaatgtggctgaactgaagaaatccttcaataggcatctgcatttcacgctcgtgaaggatcgcaacgtcgcaactacgcgggattactatttcgcgctggcgcacaccgttcgggaccacctggtgggccgctggatcagaacccagcagcattactacgataagtgcccaaaacgcgtgtactacctctccctggagttctacatgggacgcactctgcaaaatactatgatcaatctgggactccaaaacgcctgcgacgaggccatctaccaactgggacttgacattgaggaacttgaggaaatcgaggaggacgcaggactcggcaacggcggcctgggaaggctcgcagcctgcttcctcgattcgatggctacgctcggactggctgcctacggatacggcatccgctacgagtacggaatcttcaatcagaaaatcagagacgggtggcaggtggaagaggcagacgactggctccggtacggcaacccgtgggagaagagccgcccagaattcatgctgcccgtccatttctacggcaaggtggaacacaccaataccggaactaaatggatcgatactcaggttgtcctggcgctgccatacgacaccccggttcctgggtacatgaataacaccgtgaatactatgagactctggtccgcccgcgccccaaatgacttcaacctccgggacttcaacgtcggggactacatccaagcggtcctggaccggaacctggctgagaacatctcaagagtgctgtacccaaacgataacttctttgaggggaaggaactgcgcctgaagcaggaatacttcgtggtggcggcgaccctgcaagacatcatcaggcggtttaaggcttcaaagttcggctcgacgcggggcgcggggaccgtgttcgatgcattcccagatcaagtggcaatccaactcaacgatacccacccggcgctcgcgatccccgagctcatgagaatcttcgtcgacatcgagaaactcccctggtccaaggcctgggagcttactcaaaagactttcgcatacactaatcacactgtgctgccggaagcgttggaacggtggccggtcgacctggttgagaagttgttgcctagacatctcgagatcatctacgagatcaaccaaaagcatttggatcgcatcgtggcactcttcccgaaggatgtcgacagacttcggcggatgtcgctcatcgaagaggagggctccaagcgcatcaacatggcccatctttgtattgttggatcgcacgccgtgaatggcgtggctaagattcactcggacatcgtgaaaaccaaggtgttcaaggacttcagcgaactcgaaccagacaagttccaaaacaaaactaatggaatcaccccgcgacgctggctcctgctctgcaatccaggactcgccgaactgattgcagaaaagatcggtgaagattacgtcaaggacctgtcgcaactcaccaaactccacagcttcctgggggatgacgtgttcttgcgggagttggctaaggtcaagcaggaaaacaagctgaagttttcccagttcctcgagactgaatacaaagtgaaaatcaacccgtcgagcatgtttgacgtacaggtgaagcgcatccacgaatacaagcggcagctgctgaactgcctgcatgtgatcaccatgtacaacagaatcaagaaagatcctaagaagctgttcgtccctcggacggtcataatcggagggaaggcggcccctggataccacatggcaaagatgatcatcaagctcatcacctcggttgccgacgtggtgaataatgatccgatggtcgggtccaaactcaaggtgatcttcctcgagaactaccgagtgtctctggccgagaaggtgatcccagcgaccgatttgtcggaacaaatatcgacggctggaaccgaggcttcaggtaccggcaatatgaagttcatgctgaatggggcactgaccatcggcactatggatggagcgaatgtcgagatggcggaagaagcgggtgaagaaaacctgttcatcttcggaatgaggattgacgacgtggcagctctcgacaagaagggatacgaagcaaaagaatactacgaggccctgccggaactcaaacttgtgatcgaccaaattgacaacggcttcttttcacctaaacaaccggacctgttcaaggacatcattaacatgctgttctaccatgacagattcaaagtgttcgctgactacgaagcctacgtgaagtgtcaggacaaggtgtcacaattgtacatgaacccaaaagcctggaatactatggtgctgaaaaacatcgccgcaagcggaaaattcagctccgaccgaaccataaaagagtacgcacagaacatttggaatgtggagccctccgatctgaaaatcagcctttcaaacgagtctaacaaggtgaatggaaac

SEQ ID NO: 250872 - DNA, 2541 bp, Artificial Sequence
  Description of Artificial Sequence: Synthetic coding sequence
atggcgaagcccttgactgaccaggagaagcggaggcagatctccataaggggcatagtgggggtggaaaatgttgcagagcttaagaaaagctttaatagacacctgcacttcaccctggttaaggataggaacgtggccaccacccgtgactactatttcgcgctggcacacaccgttagggatcacctggtggggaggtggatcaggacacagcaacattactacgacaaatgccctaaacgagtatactatctgagcctggagttctacatgggacgcacattgcaaaacacgatgatcaacttgggactgcagaacgcatgtgatgaagcaatttatcagcttggcctggacattgaggagttggaagagattgaggaggacgctggcctgggaaatggaggtctcgggagactggcagcttgctttctggactctatggctactttgggtttggcagcatatggctatggcattaggtacgagtacgggatttttaaccaaaagatacgggatggatggcaggtcgaggaggctgacgactggctccggtatgggaacccctgggaaaagagccgccctgaattcatgctgcctgtgcatttttacggaaaggtggagcatacaaacaccgggaccaagtggatcgatacccaggttgtcctcgccttgccatacgatacccctgttcctggatacatgaacaataccgtcaacaccatgcggctgtggagcgctcgggcccccaacgattttaacctgagggattttaacgtgggggattacattcaagccgttctcgatagaaatctagccgagaacatttcaagggtgctctatcccaacgacaacttcttcgaaggaaaagaactgaggctgaagcaggagtactttgtcgtcgcagctacacttcaggacattattcgccggtttaaagctagcaaattcggatccaccaggggagcaggcacagtgtttgacgccttccccgaccaggttgcgatccaattaaacgatacacatcctgctctggctatccctgaactcatgagaatatttgttgatatcgagaaactgccttggtcaaaggcttgggagctcacacagaaaaccttcgcttacaccaaccataccgtactcccagaggctttggaacgatggcctgtggacctcgtggagaagctccttcccaggcaccttgaaatcatatacgagatcaatcagaaacatcttgatcggattgtcgcactcttccccaaggacgtcgataggctccgcagaatgtcactgatcgaggaagagggatccaaaaggattaacatggcacacctgtgcattgtggggagccacgccgtgaacggtgtggcaaagattcatagcgacatcgttaaaaccaaagttttcaaagacttcagcgagctggaaccagacaaattccagaataaaacgaacgggataacccctcgcagatggctgttactctgtaaccctggcctggcagagcttatcgccgaaaagatcggagaggattatgtcaaggacctttctcagttgaccaagcttcactcctttctcggtgacgatgtgtttctcagggagttggcgaaggtaaaacaggaaaataagctgaaattttcacagttcctcgagactgagtacaaggttaagatcaacccctctagtatgtttgatgtccaagtgaaacgaattcacgaatacaaaagacaattgctgaactgtcttcatgttatcacaatgtacaaccggataaagaaggacccaaagaagctgtttgtccccaggactgtgatcatcggcggtaaagcggctcctgggtatcatatggccaaaatgatcatcaaattaattacgtccgtggccgacgtcgtcaataacgaccctatggtagggagcaagctgaaagtgattttcttggagaactatagagtctcacttgcagagaaggttatacccgctaccgatctcagcgagcagatttcaaccgccggaaccgaggcgtcaggtacaggtaatatgaagtttatgctgaacggtgcactgactataggaaccatggatggagcaaacgtggaaatggcagaagaagctggcgaggagaatctattcatatttggcatgaggatagacgacgtcgccgcccttgacaagaaaggctacgaagccaaagaatactatgaagctcttcctgaactcaaactcgtgattgatcagatcgacaacggattcttttctccgaaacagccggatctttttaaggatataataaacatgctgttctatcacgaccgctttaaggttttcgctgactacgaggcttatgtaaaatgccaagacaaagtcagtcagctgtacatgaaccccaaagcttggaacaccatggtcctgaagaatatagccgccagcgggaaatttagttcagacaggaccatcaaggagtatgctcaaaacatctggaacgtggagccaagcgatttgaagatctctttgagtaacgagagcaataaagttaacgggaac

SEQ ID NO: 250873 - DNA, 2541 bp, Artificial Sequence
  Description of Artificial Sequence: Synthetic coding sequence
atggccaagcctctgaccgatcaagaaaagagaaggcagatcagtatcaggggcattgtgggcgtcgagaatgtcgctgagttgaagaaatctttcaataggcacctgcacttcaccctggtgaaggatagaaatgtcgccactacacgagactattatttcgccctggcgcacactgttagggaccacctcgtggggcgctggattagaacacagcagcattactacgacaagtgcccgaaacgcgtgtattatcttagcctcgagttctacatgggccgaacacttcaaaatacgatgatcaatttgggcctccaaaacgcatgcgatgaagccatctaccagcttggcctggacatcgaggaactggaagaaatcgaagaggatgctgggctgggcaacggaggactgggtcgactggccgcttgcttcctggactctatggcgaccttgggcttggccgcttacgggtatggaatccggtacgaatacggaatattcaaccagaagattagagacggatggcaggtggaggaggctgatgattggttgagatatggtaacccctgggaaaaaagccggccagaattcatgttgcctgtccatttctacggaaaggtggagcacactaataccggtacaaagtggatcgatacccaggtcgtgctcgctctgccgtatgatacgccagtgccgggctacatgaacaacacagtcaatactatgaggctgtggagcgcaagggcccccaatgactttaatctccgagattttaatgtgggagattacatacaggctgtcctggaccgcaatctggcggaaaacattagcagagtgctgtacccgaacgacaacttcttcgaggggaaggaactgaggctcaaacaggagtacttcgtggtcgccgccacactgcaagatatcatccgccgcttcaaggcatctaaattcggatctacgagaggcgccggcacagtcttcgacgcctttcccgatcaagtggctattcagctcaacgatacccatccagccctggccatccccgaactgatgcgaattttcgtggatattgagaaactgccgtggagtaaagcttgggaactgacacagaagacatttgcatacacaaaccacaccgtgctcccagaggcactcgaacggtggcctgtggatctggtcgaaaagcttctgccccgacacttggagattatctacgaaatcaaccagaagcacctcgacagaatagtggccctcttcccaaaggatgtggacaggctccggcgcatgagtctgatcgaagaggaagggagtaaaagaatcaacatggcccatctttgtattgtcggatcccatgccgtcaacggggttgcaaagattcactccgatatcgttaagacaaaagtgttcaaagacttttcagaacttgaacccgataaatttcagaataaaaccaacggtatcacgccccgcaggtggctcctgctgtgtaaccctggcctggccgagctgatcgccgagaagattggtgaagattacgtgaaggatctttctcagcttaccaaactccattcattcctgggcgatgacgttttcctgcgcgaacttgcaaaagtcaaacaggagaataaactcaagttttctcagttcttggaaaccgaatataaggtcaagattaatccatcatccatgtttgacgtgcaagtcaaaagaatccatgaatataagagacagctgctgaactgtcttcacgtaataactatgtataacaggatcaagaaagacccaaagaagttgttcgtgcctcgaacggtcattataggaggtaaggctgcacccggctaccacatggcaaagatgatcatcaaactgatcacttctgtagccgacgttgtgaacaacgatccaatggtggggagcaagttgaaggttatctttctggaaaattacagggtgagtctcgccgagaaggtgatacctgcaaccgatctgagcgagcagatttcaaccgccggaactgaagcctctgggaccgggaacatgaaatttatgctcaatggggctctgacaatcgggaccatggacggcgccaacgtcgaaatggccgaggaagccggcgaggaaaacttgtttattttcggaatgcgcattgacgacgtagcagcacttgacaagaaaggttacgaggccaaggaatactatgaagctctgcctgaactgaaacttgtcatcgaccagattgacaatggattcttctccccaaagcagccggacctgttcaaggacatcattaatatgctgttctaccacgaccgcttcaaggtgttcgccgattatgaagcatacgttaagtgtcaggataaggtgtcacaattgtacatgaacccaaaagcctggaacacaatggtgctgaagaatatcgccgccagcggtaagtttagcagcgacaggaccataaaggagtacgcgcagaacatttggaacgtcgagccaagcgacctgaaaatttccctttccaacgaatcaaacaaagttaacggcaac

SEQ ID NO: 250874 - DNA, 2541 bp, Artificial Sequence
  Description of Artificial Sequence: Synthetic coding sequence
atggccaaacctctcacggatcaggaaaaacggcgccagatatccatccgagggatcgtaggagttgaaaacgtcgcagaactcaaaaaatccttcaataggcatctccactttactcttgtcaaagatagaaacgtagccacgactagggattactacttcgccctcgcacacacagtaagggatcatttggtcgggaggtggatccggacacagcagcattattatgataagtgtcccaaacgcgtctactacttaagtctcgaattctatatgggacgaactctccagaacacaatgatcaacctcggactccagaacgcatgcgacgaggcaatctaccaactggggctcgatattgaggaactagaggaaatagaagaagatgctggactgggaaacggggggctggggagactggccgcatgtttcttagactcaatggctactctcgggcttgccgcctatgggtatgggatcagatatgaatatgggatattcaaccagaaaatccgggatggatggcaggtggaggaagcagatgattggctaaggtatgggaacccttgggagaaaagtaggcctgaatttatgctgcccgtgcatttttacggaaaagtggaacatacaaacactgggactaaatggatcgatacacaagttgtcctcgccctaccctatgatactcctgtgcccggatatatgaataacacagtgaatactatgagattgtggtctgctcgggctcctaacgacttcaacttacgagatttcaacgtgggagattatattcaggctgtgctcgacaggaaccttgcggaaaatatttcaagagtattatatccaaacgataacttcttcgaagggaaagagctacgcttaaaacaggaatatttcgtggtggcagctactctgcaggatataattagacggttcaaagctagtaaatttggatccactaggggggccggaactgtgttcgatgccttccctgatcaggttgctatccaattaaacgatacacatcccgccctggcgattcccgaactcatgcggattttcgtggatatcgaaaagctgccctggtcaaaagcatgggagttaactcagaagacatttgcctatactaaccacacagtactccccgaagccctcgaacgatggccagttgatctggtagaaaaactgctcccccggcatcttgaaataatatatgaaatcaatcaaaaacatctggatcggatcgtagctctgtttcctaaagatgtcgatcggcttaggaggatgagtcttatcgaggaagagggatccaaacgcataaatatggcacacctgtgcatcgtgggatcacacgcagtcaacggagtggcaaaaatacattctgatatagtcaaaacaaaggtattcaaagatttctcagaactggaaccagataagtttcagaacaaaacaaatggaattacaccgcgccggtggcttctcctctgcaatcccggactggctgaactgatagccgaaaagataggggaagattatgtgaaagatctctctcagcttacaaaactgcattcattcctgggagatgatgtgtttttacgcgaactagctaaggtcaaacaggaaaataaactcaaattctctcagttcctcgaaactgaatataaagtgaaaatcaatccttccagtatgtttgatgtgcaggttaaacggatccacgaatataaaaggcagctccttaactgcctgcacgtgatcactatgtacaacaggattaagaaagatcctaagaaactgttcgtgccccgaactgtaataataggagggaaagccgctccagggtatcacatggccaaaatgatcatcaaacttattacgtcagtggcagatgtcgttaacaacgatcctatggtcgggtctaagctcaaagtgatatttctcgaaaactaccgggtcagtcttgctgaaaaagtaatacccgccacagatttatcagagcagatctccacagctggaactgaagcctccgggactggaaatatgaaattcatgctaaatggggcactaacaatagggactatggacggagctaacgtggagatggccgaagaggccggagaggaaaacctctttatttttggaatgcggattgatgatgtcgccgctcttgataaaaaaggatatgaggctaaagaatattacgaagcattgccagaactgaaactagtcatcgaccaaatcgataacggattcttctctccgaaacagcccgatctatttaaagatatcataaacatgctgttctaccatgataggttcaaagtattcgcagattatgaagcctatgtcaaatgccaggataaagtgtctcagttgtatatgaaccctaaagcttggaatactatggtcctcaaaaatattgccgcctcagggaaattttcttcagataggacaatcaaggaatatgcccagaacatctggaatgttgaacctagtgatttaaaaatctctctgtctaatgaatctaacaaagtaaacgggaac

SEQ ID NO: 250875 - DNA, 2541 bp, Artificial Sequence
  Description of Artificial Sequence: Synthetic coding sequence
atggctaagcctctgaccgatcaggaaaagagacgtcagatctcgatcaggggaatcgtcggtgtggagaacgtcgctgagctgaaaaagtccttcaaccgccacctccattttactcttgtcaaagatagaaacgtggcgactacccgggattactacttcgcactcgcccacaccgtcagggaccacctggtgggacgctggatccggactcagcaacactactacgacaagtgtccgaaacgcgtgtactacctgagcctggagttttacatgggacggactctgcagaatactatgatcaacctgggactgcaaaacgcctgtgatgaagcgatctaccagctcggacttgatatagaggaacttgaggagattgaggaggacgcgggattgggaaatggagggctgggaagattggccgcgtgctttctcgactccatggcgactctcggtcttgcagcgtacggatacggtatccggtacgagtacgggatctttaaccagaagatcagagacggctggcaggtggaagaagctgatgactggctgcgatatggaaatccgtgggagaaaagtcgcccggagtttatgctcccggttcacttctacggaaaagtggaacataccaataccgggaccaagtggattgacacgcaagtggtgcttgccctgccctacgacacgccagtcccaggctatatgaataacactgtgaataccatgcgactgtggtcggccagggcgccgaacgacttcaacctgcgggatttcaacgtgggtgattacatccaggcagtgcttgatagaaacctggcagaaaacatctcccgcgtgctctacccgaacgacaatttcttcgagggtaaagagctgagactgaagcaggaatacttcgtggtggctgcaaccctccaagacatcattcggcggttcaaggccagcaaattcggctcgacgcgcggggccggcactgtgttcgacgctttccctgaccaggtggcgatacagctgaatgacacccacccagctctggcgatcccggaattgatgcgcatattcgtagacatcgaaaagctgccatggagcaaggcttgggaactgacccaaaagaccttcgcctataccaaccataccgtgctcccagaagctctcgagcggtggccagtggatctcgttgaaaaactcttgccaaggcacctggaaatcatctacgaaatcaaccagaagcatctggacagaattgtggccctgtttcccaaagacgtcgaccgcctccgtagaatgagcttgatcgaggaggagggttccaagagaatcaatatggcccatctctgcatcgtgggaagccatgccgtgaacggagtggctaagatccactcagacatcgtgaaaactaaggtgttcaaggacttctcagaactggaaccggacaagttccaaaacaagacgaatggaatcactcctaggcggtggctcctcctgtgcaaccccggcctggctgaactgatcgcagaaaagatcggagaagattacgtgaaagacctgtcgcagttgaccaaacttcactcgtttttgggagatgacgtgtttctgcgcgaactggccaaggtgaagcaagaaaacaaactgaagttctcacaattcctcgaaaccgagtacaaggtcaagataaatccgagctccatgtttgacgtccaggtgaagcgaatccacgaatacaagaggcaactgctgaactgccttcacgtcataactatgtataaccggatcaaaaaggatcccaagaagctgttcgtccctcgcaccgtcatcatcggcggaaaggcggcacctggctaccatatggccaaaatgatcatcaagctgatcacttccgtggctgacgtcgtcaataatgatccaatggtaggatcgaaacttaaagttatcttcctcgagaattaccgcgtctccttggccgaaaaggtgatcccggccaccgatctctccgaacagatctccactgccggtactgaagcgtcaggaacggggaacatgaagttcatgttgaacggagccctgactataggaaccatggatggtgcaaacgtggaaatggcagaggaagccggggaagaaaatctgttcatctttggaatgcggattgatgacgttgcggccttggacaaaaagggttacgaggccaaggaatactacgaagctctgccagagctcaagctggtgattgaccagattgataacggcttcttcagtccgaaacagccggatctcttcaaagacattatcaacatgctgttctatcatgaccgctttaaagtgttcgcggattacgaggcgtacgtgaagtgccaagacaaagtgagccagctgtacatgaacccaaaggcctggaatacgatggtccttaagaatatcgcagcgtcggggaagttctcgtcggacaggactattaaggagtacgcgcaaaacatctggaacgtggagccttcggatttgaagatcagcctgtccaacgaatcgaataaggtcaacggaaac

SEQ ID NO: 250876 - DNA, 2541 bp, Artificial Sequence
  Description of Artificial Sequence: Synthetic coding sequence
atggctaaacctctgactgaccaggagaagcgccggcagatcagcattcgtgggatcgtcggtgttgaaaatgtggcagagttgaagaagagcttcaacagacacctgcactttacgctggtcaaggacaggaacgtggctactacccgcgactattactttgcgctcgctcatacggtgcgcgaccacctagtgggacgctggatccgcacgcaacagcactactacgacaaatgcccgaagcgcgtgtactacctgtcgctggagttttacatgggacgcaccctccagaacaccatgattaacctggggctgcagaacgcctgcgacgaggcaatctatcagctggggctggacatcgaggagttggaggaaattgaagaagacgcgggcctcggtaacggtggtctgggccgcctggctgcgtgttttctggatagcatggccactctgggattggcggcttacgggtacggtattaggtacgaatacggtatatttaatcaaaaaatcagggacggatggcaagttgaagaggcggatgactggttgcgctatggcaatccatgggaaaagagccgaccagaattcatgctgcctgtccacttctatggcaaagtggaacacaccaatacaggtactaaatggattgatacccaggtcgtcctggccttgccatacgatacgccagtgccgggttatatgaataacacggtgaacacgatgcgcctgtggtccgcgagagcgcctaatgacttcaatctgcgagactttaacgtcggtgattacattcaagcggtcctggatcgcaatctggcagaaaatatttcccgggtcctgtacccgaacgataacttctttgagggaaaggaactgcgcttgaaacaggaatacttcgtggtcgctgcaactctccaagatatcattcgtcgtttcaaggccagtaaattcgggtcgacccgcggcgcaggtaccgtgttcgacgcgttcccagaccaggtggcgatccagctgaacgatacccaccctgcgctcgccatacctgaacttatgcgtatttttgtggacatcgaaaaacttccttggtctaaagcatgggaactgacccagaagaccttcgcgtacaccaatcacacggttttgcctgaggcgctggagcggtggccagttgatttggtggagaagttactgccacgtcatctggaaattatctacgaaattaatcagaagcaccttgacagaatcgtggcgttgttccccaaagacgtggatcgcctgcgccggatgagcctgatagaagaggaaggtagcaagcggattaacatggcgcatctttgtatcgtaggttcacacgcagttaacggggtggctaagatacatagcgacattgttaagaccaaggtttttaaggattttagcgagctggaacctgataaatttcagaataagaccaacggcatcaccccgcggcgctggctactgctgtgtaacccgggcttagctgaattaattgcggagaagattggcgaggactacgtcaaagacctaagccagctgaccaaattgcactccttcctgggcgacgacgtgttcttgcgcgagcttgctaaagttaagcaggaaaacaaactgaaattctctcagtttttagaaaccgagtataaggtcaagataaacccgtcttctatgtttgacgttcaggtaaagcgcatccacgaatataagcgccagctgctgaattgcctgcacgtaatcacaatgtataatcgcataaaaaaggatccaaaaaagttgtttgtgccgcgtactgtgattatcggtggtaaagcggcaccagggtatcacatggcaaagatgattattaagcttatcacctccgtggcggatgtggtgaataatgatccaatggttgggtctaaacttaaagtcatcttcctggaaaattaccgcgtaagcctggccgagaaggttattccagctaccgacttgagcgagcaaatttccactgcgggtaccgaggcgagcggcaccggcaacatgaaatttatgctgaacggcgcgctgactattggcactatggatggtgcgaacgtcgaaatggctgaggaggctggtgaagaaaatttgttcatcttcggtatgcgaatagacgacgtggctgccctggacaagaagggttatgaggcaaaggaatactatgaggcattgcctgagctcaaactggtcattgaccagattgataacggtttcttctctccgaagcaacctgacctgtttaaagacatcattaatatgctgttctaccacgaccggtttaaggttttcgctgactatgaagcgtacgtcaaatgccaagacaaagtgtcccagctgtatatgaacccaaaggcatggaacaccatggtactgaagaacattgccgcgtcaggtaaattctcctcagaccggactatcaaagagtacgcgcagaacatctggaatgtcgagccgtccgatctgaaaatcagcctcagcaacgaatcaaataaagtaaatgggaat

SEQ ID NO: 250877 - DNA, 2541 bp, Artificial Sequence
  Description of Artificial Sequence: Synthetic coding sequence
atggcgaaacctctgaccgaccaagaaaagagacgccaaattagcattcgaggcatcgtgggcgtcgagaatgttgcggagctgaaaaagtcattcaatagacacctgcattttaccctagtcaaggatcgaaatgtggctacgacccgagactactactttgcattggcccacaccgtgagagaccacctcgtaggaagatggatcaggacacagcagcactattatgacaaatgtccaaaacgggtttattatttaagcctcgagttctatatgggtcgtaccctgcagaataccatgataaatctcggcctccagaatgcatgcgacgaagctatttatcagttgggcctggatatcgaggagctcgaggagatcgaagaagatgccggcctaggaaatggggggctgggcaggctggctgcttgctttctagattctatggccaccctcggactagcagcttatgggtatggaatccgttatgagtacggcattttcaatcagaaaatccgggacggatggcaggtggaagaagccgacgactggctgcgatacggcaacccctgggagaagtcacgaccagagtttatgttgccggtgcatttttacggaaaagtggaacatacaaatacaggtacaaagtggatcgacacacaggtggtgcttgccttaccttatgacactcccgttcccggatacatgaacaacactgttaatactatgaggttatggtccgcgcgggccccgaacgacttcaacctgagggacttcaatgttggagactatattcaggcggttttggatcggaacctcgctgagaacatctctagagtgctctaccctaatgataattttttcgagggtaaggaattgaggctaaaacaggaatattttgtcgtcgccgccacactacaggacattatccgacgtttcaaagcctctaaattcggttccaccagaggagccgggacggtgttcgacgcctttcccgatcaagtggcaatacaactgaacgacacacatcctgccctcgctatcccagagctcatgcggatttttgtagatatcgagaaactcccgtggtctaaagcctgggagctaacccagaagacctttgcttacacaaaccatacagtcctgcctgaggcactggagcgatggcctgttgatctggtggaaaaactgcttcctcgacaccttgaaataatatacgagattaatcagaagcatctggacagaattgtggcactctttccaaaagacgtagatcggttaaggcgcatgtccctgatcgaggaggagggatcaaagagaatcaatatggcccacctgtgcatagttggctctcatgcagttaacggagtggccaagatccactcagatatcgtgaagactaaagtgttcaaagatttcagcgaactcgaacccgataagttccagaataaaacaaatggcatcactccacgccgatggctcctgctgtgtaaccccgggctggctgaattgatcgccgagaaaataggggaagattatgtgaaggatttgtcgcagttaacaaagctacattctttcctaggggacgatgtcttcctccgagaactggccaaagtcaagcaggagaataagctgaagtttagccagttcctggaaacggagtacaaagtaaaaattaatcctagttcaatgttcgacgtgcaggttaaacgaatccacgagtataagcgacaactgctcaattgtctgcatgtgatcacaatgtataatcgaattaaaaaggaccccaagaagctgtttgtacctcggaccgtcatcatcggcggcaaagctgctcccggctatcatatggccaagatgattatcaaactaattacttcagtggccgacgttgtcaacaacgatccaatggtcgggtcgaagctgaaggtgattttcctggagaactaccgggtctcactggcagaaaaggtgatacctgcgactgatctgtccgagcagatctccactgcggggactgaagcaagcggcacgggtaatatgaaatttatgctgaacggcgctttgaccattggcactatggatggcgccaatgtggagatggccgaggaggcaggagaggagaacctgtttatcttcggcatgcggattgatgatgtagcagccctggacaaaaaaggttacgaagcaaaagagtattatgaggctctccctgagctgaaacttgtcatcgaccagatcgacaatgggttcttctcacccaaacagcccgacttgttcaaggacatcattaatatgcttttttatcatgacaggtttaaggtgttcgccgattacgaagcttatgtaaaatgtcaagataaagtgagccaactgtacatgaacccaaaagcctggaatacaatggtgctgaaaaacatcgccgcatccggcaagttcagctcagatagaacaatcaaggaatatgctcagaacatttggaacgttgaaccaagtgacctcaagatctcgctcagcaatgagtcaaacaaggtcaacgggaat

SEQ ID NO: 250878 - DNA, 2541 bp, Artificial Sequence
  Description of Artificial Sequence: Synthetic coding sequence
atggccaagccactgacggaccaggagaagagacgccagatcagcattcggggaatcgtgggagtcgaaaacgtggctgaactgaagaaatcgttcaaccggcatctccacttcaccctcgttaaagaccgcaatgtcgctaccactcgtgattactacttcgctctggcacataccgtgagggatcatctcgtcggccggtggatccgcactcaacaacactactacgacaagtgcccgaagcgcgtgtattacctgtcgctcgaattctacatgggaaggaccttgcagaataccatgatcaacctgggactccaaaacgcttgcgacgaagcgatctaccagctgggacttgatattgaagagcttgaggagatcgaagaggatgcaggcctcggaaacggtggacttggccgcctggccgcttgcttcttggattcaatggcaacgctcggactcgccgcatacgggtacggaattcggtatgaatacggaatcttcaatcagaagatcagggacggatggcaagtggaggaagcagatgactggcttcgctacggaaacccttgggagaaatcgcgcccggaattcatgctgccagttcacttctacggaaaagttgaacacactaacactggcactaaatggatcgatacccaagtggtgcttgccctcccgtacgacaccccggtcccaggatacatgaacaataccgttaacacgatgaggctgtggagcgccagagcccctaatgactttaatctgcgggacttcaatgtgggagactacatccaagccgtccttgacagaaacctggccgagaatatcagcagggtgctgtacccgaacgataactttttcgagggaaaggaactgaggcttaaacaggaatacttcgtggtcgccgccaccctgcaggacataatccggcggtttaaggcctccaagttcggctcgacccgcggagcgggcaccgtgtttgatgcattcccagaccaagtcgcaatccagctcaacgacacccatccagcgctggccatccccgagctgatgaggatctttgtggatatcgagaaactcccgtggtcgaaggcttgggaactgactcaaaaaacctttgcctacactaaccacactgtcctcccggaggcgcttgagcgctggccggtcgacctggtcgagaagttgctgccgcggcatctcgagatcatctacgaaatcaaccaaaagcatctggaccggatcgtggctctgttcccgaaagatgtcgatcggctgcgccggatgtcactcatcgaagaggaaggatccaaacggatcaatatggcacacctttgtatcgtgggatcacacgcggtcaacggagtggccaagatccactcagacatcgtgaaaaccaaagtgtttaaggatttctccgagctggaaccagataagtttcagaacaaaactaatggaatcaccccgcgccggtggctgctgctgtgcaaccctggcctcgccgaactgatcgcggagaagatcggtgaggactacgtgaaagacctttcccaactcacgaagctgcactccttcctgggcgacgatgtctttctccgagaactcgctaaggtgaaacaagagaacaagctgaaattctcgcaattcctcgagacggagtacaaggtgaaaatcaacccctcctctatgtttgacgtccaggtcaagagaatccacgagtacaagcgccagctgctgaactgcctccatgtgatcactatgtacaacagaattaagaaagatccgaagaaattgttcgtcccgcgcaccgtgatcatcggcggaaaggcagcaccgggataccacatggcgaagatgatcatcaagctgatcacttccgtagcggacgtggtcaataacgatcccatggtgggctcaaagctgaaagtcatcttcctggaaaactatcgggtgagcctggctgaaaaggtgatccccgcaactgatctgagcgaacagatctctaccgcagggacggaagcatcgggcactggtaacatgaaattcatgcttaacggagccttgaccatcgggactatggacggagctaatgtggagatggccgaagaagccggcgaagaaaatcttttcatcttcggtatgcgcatcgacgacgtggccgcactggataagaaggggtacgaagcaaaagagtactacgaagctctgcctgagctcaaactcgtgatcgaccagattgacaatgggttcttctcaccaaagcaacctgacctcttcaaggacatcatcaatatgctgttctaccacgaccgcttcaaagtgttcgcagactatgaagcatacgtgaagtgtcaagataaggtgtcccagctgtacatgaaccctaaagcgtggaacactatggtgcttaagaatatcgctgcgtccggtaaattctcgagcgaccgcacgatcaaggaatacgcgcagaacatctggaatgtcgagccgtcggaccttaagatctccctttccaacgaatcaaacaaggtcaacggcaac

SEQ ID NO: 250879 - DNA, 2541 bp, Artificial Sequence
  Description of Artificial Sequence: Synthetic coding sequence
atggccaagcctttgacggatcaggaaaagagacgccagataagcattagaggaatcgtcggagtcgaaaatgttgcagagctcaagaagtcctttaaccggcacctgcactttactcttgtgaaagataggaatgtagccactacgagagattactactttgcgctggcccacactgtgcgagatcaccttgtcggtcggtggattcgtacccagcagcattactacgataagtgtcccaaacgcgtatactacctgagtctggagttttacatggggagaacgcttcaaaataccatgatcaacctgggtttgcaaaacgcatgtgatgaagcaatataccaactggggctcgacattgaggagcttgaagaaatcgaagaagatgcaggactgggcaatgggggacttggacgtctcgcggcatgcttcctggattcaatggcaactcttggtcttgcagcatacggttacggcattcgatacgagtacggtatattcaaccagaagatcagggatggctggcaagtcgaagaagccgacgactggctgcgatacggaaacccctgggagaagtcgcgacccgagtttatgctgccagtccatttctacggaaaggtggaacacactaatactggaacgaaatggattgatacccaagtggtcctggctctgccatacgatacccctgttcctgggtacatgaataacaccgtcaacaccatgaggttgtggtcagcaagggcccctaacgactttaaccttcgggacttcaacgtcggtgattacattcaagcagtcctcgatcgcaatctggccgaaaacatttcaagggtgctgtaccccaacgacaactttttcgaaggcaaggaactgcggctgaagcaggagtactttgtggtggcagcaacccttcaagacatcatccgcagattcaaggcgtctaagtttggaagcactagaggagcaggtaccgtctttgacgcattccccgatcaggtggctattcaattgaacgatactcatcctgcactggcaattcctgaactgatgaggatctttgtggatatagagaaattgccttggtccaaagcatgggaacttacgcagaaaacttttgcatacacgaaccatactgttcttcctgaggctctcgagagatggcccgttgacctcgttgaaaagttgttgccgcgtcatctggaaatcatatacgagattaatcagaaacatctggatcgcattgtcgctttgtttccaaaggatgtcgaccgcctcaggaggatgtcgctgattgaggaagagggctcaaaacgtatcaatatggcccatctttgtattgtaggttcccacgccgtgaacggagtggcaaagatccattccgatatcgtgaaaaccaaggtctttaaagatttcagcgagcttgaacctgataagtttcagaacaagaccaatggaattaccccgcgccgttggcttctgctgtgcaacccagggctggcagagcttattgccgagaagattggtgaagattacgtcaaagacctgtctcagcttaccaaacttcattcatttttgggcgatgacgtgtttcttcgagaacttgctaaagtgaagcaagaaaacaaactcaagttctctcaattcctcgaaactgagtataaagtcaagatcaatccaagctccatgttcgacgtgcaggtgaagcgaatacatgagtacaagagacaactgctcaactgtctccatgtgattactatgtacaaccggatcaaaaaggatcctaagaaactcttcgttcctagaactgtgattatcggtggaaaggccgcgcccgggtaccatatggcgaagatgatcataaaactgatcacctcagtcgcagacgttgtgaataatgatccaatggtggggtcgaaactcaaggtgatttttcttgagaactatagagtcagccttgcagaaaaggtcataccagcaaccgacctttcggaacaaatttcgactgcagggaccgaggcgtcaggaaccggcaacatgaaattcatgcttaatggagccttgaccattggtaccatggatggggcaaacgtggaaatggcagaagaagccggagaggaaaacctctttatctttgggatgcggattgacgatgtcgcagcacttgataagaaaggttacgaagcaaaagagtattacgaggctctgccagagctgaagctggtcattgatcaaatagataatgggtttttctcgccgaagcagccagacctgtttaaggatatcatcaacatgctcttttaccacgatcgtttcaaagtgtttgcagactacgaagcgtacgttaagtgccaggataaggtgtcgcagctttacatgaatccaaaggcatggaacaccatggtccttaagaatatcgccgcatccggtaagttctcatcagatagaaccattaaggaatacgcgcaaaacatctggaacgtggaaccgtcggatctgaagatttcactgtcgaacgaatcaaacaaggtgaacggtaac

SEQ ID NO: 250880 - DNA, 2541 bp, Artificial Sequence
  Description of Artificial Sequence: Synthetic coding sequence
atggccaagcctctgaccgaccaagaaaagagacggcagatcagcatccgcggcatcgtgggagtggaaaatgtggccgaactgaagaagtcgttcaatcgtcatctccacttcactctggtgaaggatagaaatgtggcgactactcgcgattactactttgccctggcccacaccgtgagagatcacctcgtgggacgctggatcagaacccagcagcattactacgataagtgcccaaagagagtgtactacctgtcactcgagttctatatggggcgcaccctccagaatactatgatcaacctgggactgcagaacgcctgcgatgaggctatttaccaactgggtcttgacatcgaggaacttgaagaaatcgaagaggacgccggtctgggaaatggcggactcggccgcctcgctgcctgtttcctggacagcatggctaccctgggcctggctgcctacggctacgggatcaggtacgagtacggcatcttcaatcaaaaaattcgcgatggatggcaagtggaggaagccgatgactggcttcgctacgggaacccgtgggaaaaatccaggccggaatttatgctccccgtgcatttctacggaaaagtggagcatactaacaccggaactaagtggatcgacacccaagtcgtgctcgctcttccgtatgacactccggtccccggctacatgaacaacactgtcaacacgatgcggctctggtcagcgcgggcaccaaacgatttcaacctgagggacttcaacgtcggggattatatccaggcagtgctggaccggaacctcgccgaaaatatctctcgagtgctgtacccgaacgacaacttcttcgaaggaaaagagctgcgcctcaaacaggaatacttcgtcgtggccgccacccttcaggatatcatcaggcggtttaaagcatcaaagttcgggtcaactagaggcgccggaactgtgttcgacgccttcccggaccaagtcgccattcagctcaacgacacccaccccgctctcgcgatcccggagctgatgcgaatcttcgtggacattgagaaactgccgtggtccaaagcctgggagctgacgcaaaaaaccttcgcgtacactaatcacaccgtcttgccggaggcccttgagcgctggccagtggacttggtggagaagctgctcccacgccacctggaaatcatctacgaaatcaatcagaagcatctggatagaattgtggcgctgttccctaaagatgtggaccgcctgcgcagaatgtccctgatcgaggaggaaggatctaagcggatcaacatggcccatctgtgcatcgttggttcgcacgcagtcaatggtgtggcaaagattcactccgacatcgtcaagactaaggtgtttaaggacttcagcgaattggaaccggacaaatttcaaaataagacgaacggaatcaccccacggaggtggctgttgctgtgtaaccctggattggcagaactgatcgcagagaagatcggagaggattacgtaaaggatctctcgcagttgacgaaactccactcatttctgggggacgatgttttcctgcgggaactggcgaaggtgaaacaggaaaataaactcaagttttcgcaattcctggaaaccgagtacaaagttaagatcaatccttcgagcatgttcgatgtccaggtgaagagaatccacgaatacaagcgccagctcctcaactgccttcacgtcatcaccatgtacaaccgcatcaagaaggacccaaagaagctgtttgtgccccgcactgtcatcatcggaggaaaggcagccccagggtaccatatggcgaagatgatcattaagctgatcaccagtgtcgcagatgtggtgaataacgacccgatggtgggcagcaagttgaaggtgatcttcctggagaactaccgggtgtcgctcgcggaaaaggtgattccagctaccgatctcagcgagcaaatctccaccgcaggcaccgaagcgtccggaactggaaacatgaagttcatgctgaatggtgccctcaccattggaactatggatggagctaacgtggagatggcagaagaggcgggcgaagaaaacctgtttatcttcggcatgcggatcgacgacgtcgcggcactcgacaagaaaggatacgaggcgaaggagtactacgaggcgctgccggaattgaaactggtcatcgatcagatcgacaatggattcttttcacctaagcagccggacttgttcaaagacattatcaacatgctgttctaccatgatcggttcaaggtctttgcggactacgaagcctacgtgaagtgccaggacaaggtttcgcaactttacatgaatccgaaggcctggaacacgatggtcctgaaaaacatcgctgcctccggtaaattcagcagcgaccggactattaaggagtatgctcagaacatatggaatgtggaaccttcggacctgaagatctccttgtcgaacgaatccaataaggtgaacggaaac

SEQ ID NO: 250881 - DNA, 2541 bp, Artificial Sequence
  Description of Artificial Sequence: Synthetic coding sequence
atggcgaagccactgactgatcaggaaaaacgccggcagatctccatccgcggtatcgtgggggtggaaaatgtcgcagaactgaagaaatcattcaatcggcatcttcacttcaccttggtgaaggatcggaacgtggctaccacccgcgactactactttgcgcttgcacatactgtccgggaccaccttgtgggaagatggattagaactcaacagcattactacgataagtgcccaaagcgcgtctactacctgtcgctggaattctatatgggaagaacgctgcagaacactatgatcaacctgggtctgcaaaacgcctgcgatgaagccatctatcagcttggattggacatagaagagctcgaagagatcgaggaggacgccggactgggcaatggcggacttggtcggttggcggcctgcttcctggacagcatggccactctgggactggccgcttacgggtacggtatccggtacgaatatgggatcttcaaccagaaaatacgcgacggatggcaggtggaagaggctgatgactggctgcgatacggtaacccgtgggagaagtcacggccggaattcatgttgccggtccacttttacgggaaagtggaacataccaacaccggcaccaagtggatcgacactcaagtggtcctggcgctcccgtacgatacgcccgtgcctggatacatgaacaatactgtgaataccatgaggctgtggtccgctagagcaccgaacgactttaacctcagggatttcaacgtgggagactacatccaggctgtgctggatcggaacctcgcggagaacatttcgcgcgtgttgtaccccaacgacaactttttcgagggtaaagagctccggctgaagcaggagtacttcgtggtcgccgccaccctccaagacatcattagacgcttcaaggcctcaaagttcggatccacccggggagctggaacggtgttcgacgcctttccggaccaagtggccatccagctcaatgacacccaccccgccttggcaatcccggaactgatgcgcatcttcgtggatatcgaaaagctgccctggtcgaaggcgtgggaacttactcaaaagaccttcgcgtacaccaaccacacggtgttgccggaggccctggaacgatggccggtggaccttgtcgagaagctgctgccgagacaccttgagatcatttacgagatcaatcaaaagcacctcgacaggatcgtggcgctcttcccgaaggatgtggatcggctgagacggatgtcgctgattgaagaggaaggttccaagaggatcaacatggcacatctttgcatcgtgggaagccatgccgtgaacggtgtggcgaagatccactcagacattgtgaaaactaaggtgttcaaggatttttccgaattggagccggacaagtttcaaaacaagacgaacggcatcacgccccggcgatggttgctgctgtgtaacccaggactggctgaacttatcgctgaaaagatcggagaggattacgtcaaggatctgtcgcaattgaccaagctccactcctttttgggagatgatgtgttcctgcgcgaactcgcaaaagtcaagcaggaaaacaaactcaagttctcccagttccttgaaactgagtacaaggtgaagatcaacccttcgtccatgttcgatgtccaagttaaacgcattcacgaatacaaaagacagctgctgaactgtctccatgtgattaccatgtacaaccggatcaaaaaggatccaaagaagctcttcgtgccgcgcactgtgatcatcggcggcaaggccgcaccaggataccacatggcgaaaatgattatcaaattgattaccagcgtggcggatgtcgtgaacaatgacccaatggtcgggagcaagctcaaggtgatcttcttggagaactaccgcgtgtcgcttgctgaaaaagttatccctgcaaccgacctgagcgaacagattagcaccgccggcaccgaagcctcaggaactggcaacatgaagttcatgctgaacggtgccctcactatcggcactatggacggggcaaatgtggagatggccgaagaagcaggagaggaaaatctctttatctttggaatgaggattgatgacgtcgcagctctggataagaaggggtacgaggccaaggaatactacgaggctctgccggaattgaaactcgtgatcgatcagatcgacaacggattcttttccccgaaacagccagacctgtttaaggacattatcaacatgctgttctaccatgaccggttcaaggtgtttgctgattacgaggcttacgtgaagtgccaagacaaagtctcccagctgtacatgaatccaaaggcttggaatacgatggtccttaagaatattgccgcgtcgggaaagtttagcagcgatcgcaccatcaaggaatacgcccagaacatctggaatgtggagccgtccgacctcaaaatctcgctgagcaacgaatcaaacaaggttaacggaaac

SEQ ID NO: 250882 - DNA, 2541 bp, Artificial Sequence
  Description of Artificial Sequence: Synthetic coding sequence
atggccaaaccactgaccgatcaggaaaagcgcaggcaaatttcgattaggggaattgtgggagtggaaaatgtggcagagctgaagaagtcattcaatagacacctgcatttcactctggtgaaggataggaacgtcgcaacgactagagactactacttcgcattggcgcatactgtccgcgatcatctcgtcggacggtggatacggacccagcaacattactacgataaatgccccaagagagtctactacttgtcactggagttctatatggggcgaacgcttcagaacactatgataaacttgggacttcaaaatgcatgtgacgaagccatttaccaacttggactcgacattgaagagttggaagagattgaggaagatgcaggtcttggaaatggtggactgggtaggcttgctgcctgtttccttgattcgatggccactctgggtctggcagcttacggttacggcattcgatacgaatatggcatctttaaccaaaagatccgtgatggttggcaggtggaagaagccgatgactggctgaggtacgggaatccttgggagaaaagccgtccggaattcatgcttcctgtccatttctacggtaaggtggagcacaccaacactgggaccaagtggattgatactcaagtggtgctcgcactgccttatgacactcctgtgccaggatacatgaacaacaccgtgaacaccatgcgtctttggtccgcccgggcacccaatgacttcaacctccgggatttcaatgtgggagactacattcaggcagtgttggatcgcaaccttgcagaaaacatttcccgggtgctgtaccctaatgataacttttttgaaggaaaagaactccgccttaagcaagagtatttcgtggtggcagcaacgctccaggacatcatacgaaggtttaaagcatcgaagtttggtagcactcgcggagctggaactgtgttcgatgcatttccagatcaggtggcaatccaattgaacgacacccacccggcacttgcgatcccagaactgatgagaattttcgtggatatagagaagttgccttggtcgaaggcatgggaattgacccaaaaaacttttgcgtacaccaatcatactgtgcttcctgaggcacttgagagatggcctgtcgacctggtggagaaactcctgccgagacatctcgagattatctatgagatcaaccaaaagcatctggatagaatcgtggctctgttcccaaaggatgtcgatcggctccggcgcatgtcactgattgaggaggaaggcagcaagcgaattaacatggcacatctgtgtattgttggatctcacgcagtgaatggggtcgcgaaaatacattcggatatcgtgaaaactaaggtgtttaaagacttctcagaactggaaccagataagtttcagaacaagacgaatggaatcactccacgcaggtggctgctgctctgtaatcctggccttgcagaactgatcgcagagaagattggagaagattacgtgaaagacctttcacagctcaccaaacttcactcatttcttggcgatgatgtctttcttagggaacttgccaaggtgaagcaggaaaacaagctcaagttttcccagtttctcgaaaccgagtataaggtgaagattaatccgtcctccatgttcgatgtgcaagtcaagcgcatacatgaatacaaaagacaactgcttaactgccttcacgtgataaccatgtacaatcggatcaagaaggaccccaagaagctctttgtgcctagaactgtcattattgggggtaaagccgcacctggctaccatatggccaagatgatcattaagctgatcacttcggtcgcggatgtggtgaataatgatcctatggtgggcagcaagctgaaagtgatcttccttgaaaactaccgcgtgtccctcgcagaaaaggtgattcctgcaaccgatctgtccgaacaaatatcaactgccggtactgaagcctcgggtaccgggaacatgaagtttatgctgaacggagcactgaccatcggtacgatggacggtgcgaacgtcgaaatggctgaagaggcaggagaagagaacctgtttatctttggaatgaggatcgacgatgtggccgcacttgacaaaaaggggtacgaagccaaggagtactacgaggcactccctgaactgaaactggtcattgatcagattgacaacggatttttctcgcctaaacagcctgatcttttcaaggacatcatcaacatgctgttttatcacgatcgattcaaggtctttgcagattatgaggcatacgtgaagtgccaggataaagtgtcacaactctacatgaaccctaaggcttggaatactatggtgcttaagaacattgcagcatccggtaaattctcgtccgatcgtactattaaggagtacgcacaaaacatctggaatgtggagccctcagatttgaagatatcgctttcgaatgagagcaacaaagttaatggaaac

SEQ ID NO: 250883 - DNA, 2541 bp, Artificial Sequence
  Description of Artificial Sequence: Synthetic coding sequence
atggctaaaccactgaccgatcaggaaaagagaagacagattagtattcgaggaatcgtgggagtcgagaacgtcgccgagctcaagaagagctttaatcgccatctgcatttcaccctggtgaaggacaggaacgtggccacaacccgggactattattttgctctggcccacaccgtcagggatcaccttgtaggcagatggatacggacacagcaacactattatgataagtgtccaaagcgagtatattacctgtctttagaattctatatgggacggactctgcaaaataccatgattaaccttggcctgcagaatgcctgcgatgaggcaatataccagctgggtctggacatcgaagagctggaagaaattgaggaagacgctggtctggggaacggcgggctgggtcgattagccgcatgtttcctggactctatggctactctgggactagctgcttatggctacggcatcaggtacgaatacggcatttttaaccaaaagatcagggacggttggcaggtggaggaagctgacgattggctgagatacggcaacccttgggaaaaaagccggcctgaatttatgctgcctgtgcacttctacggaaaggtggagcacacaaatacaggaaccaagtggattgacacccaagtggtcctcgccctgccctacgacacccccgtgcccggctacatgaacaacacagtgaacaccatgcggctgtggtctgctcgcgccccaaacgattttaatttacgggacttcaatgtgggcgattacatacaggcagtcctggaccggaatctcgccgagaacatttctagagtgctatacccaaacgacaatttcttcgagggtaaggagctccgtctgaagcaagagtacttcgtggtggctgctacactccaagacatcatccgtcggttcaaggctagtaaattcgggagtacacgaggcgccggaaccgtgttcgacgcttttcctgaccaggtggctatccaactgaacgatacacatcctgctctcgccattccagagctgatgcgcattttcgtggacatagaaaagttaccatggtcaaaagcatgggagctgactcagaagacctttgcctataccaaccacaccgttctgccagaggccctggagcgatggcccgtagatctggtggaaaagttgctaccaagacacctcgaaataatatacgagatcaatcaaaagcacctagacagaattgttgccctcttcccgaaagacgtggaccggctgaggcgaatgtccctgattgaagaggaggggagtaagaggataaatatggctcatttatgtatagtgggatctcacgccgtcaatggcgtcgctaagattcatagcgatatcgttaaaaccaaagtgtttaaggatttctctgagctggaaccagacaagttccagaataaaaccaacggaatcacaccaaggcggtggttacttctatgcaaccctggcctcgcagagctaattgcagagaagattggagaggactatgtgaaggacctcagccagctgaccaagctacatagctttctgggggacgatgtgttcctgagagagcttgccaaagtgaagcaggagaacaagctgaaattctcacagttcctggagactgagtacaaggtcaagatcaatccatccagtatgttcgatgtacaggtcaagaggattcatgagtataagcggcaactgttgaactgcttacacgtgattaccatgtataacaggatcaaaaaagacccaaaaaagctgttcgtgcctcggaccgtgattataggaggcaaggccgcccctggctatcacatggccaagatgatcataaagctcatcacaagcgtggctgacgtcgttaataacgatccaatggtcggatcaaagttaaaggtgatctttctcgagaattatagggtgagcctggccgaaaaagtcatacccgctacagacctgtcagagcagatctccacagccgggactgaagccagtggtaccggaaatatgaagttcatgctgaacggagctctcactatcggcactatggatggtgcaaacgtggaaatggccgaagaagcaggggaagagaacttatttatatttggcatgcgaattgatgacgtcgccgcactggataaaaagggatacgaagctaaggaatattacgaggcactacctgagttaaagctggtcatagaccaaattgacaatggctttttcagtcccaaacagccagatttatttaaggacattatcaatatgctgttctaccacgacaggtttaaggttttcgccgactatgaagcctacgtaaagtgccaggataaggtatcccaactatatatgaaccctaaagcatggaacaccatggtcctaaaaaatatcgctgcatcaggtaagttctcctccgatcgcaccataaaggagtatgcccagaatatctggaacgtggagccaagcgacctgaagatctccctctccaacgagtcaaacaaggttaacggtaat

SEQ ID NO: 250884 - DNA, 2541 bp, Artificial Sequence
  Description of Artificial Sequence: Synthetic coding sequence
atggctaagcccctgaccgaccaagagaaaagacgtcagatatctatccgggggatagttggagtcgaaaatgtggcagagctcaagaaatcgtttaacagacacctgcactttacgctggtgaaagatcggaacgtcgcaactactcgcgactactacttcgccctggcacataccgtgcgcgaccatctcgtgggtcggtggattcgaacccagcaacattactacgataaatgtccaaagcgcgtttactacctgtcactggagttttacatgggtaggacgctgcaaaacactatgattaatctgggcctgcaaaacgcttgcgatgaagcgatttaccaattgggcttggatatagaagaactggaagaaatcgaagaagatgcagggcttggtaatggtgggctggggagactggcagcatgtttcctggattccatggcgacgctcgggcttgcagcgtacggatacggcatccgttacgagtacggaatctttaatcagaagattagagacggttggcaagtcgaagaggccgatgattggcttagatacggaaatccatgggaaaagtcaaggccagagttcatgctcccagtgcatttctacggaaaggtcgagcacaccaacactggcactaagtggatcgacacgcaagtggtgttggcgctgccctacgatactccagtccccgggtacatgaacaacaccgtgaacaccatgagactgtggagcgcacgagcgcccaatgacttcaatcttagagactttaacgtgggtgattacatacaagcagtgctggatagaaacctcgcggaaaacatctcccgagtcctctaccccaacgataacttttttgaaggaaaggaactgcggttgaagcaggagtactttgtggtggcagccaccttgcaggacattatccgccgctttaaggcgtcgaagttcgggtctacccgaggagcaggtactgtgtttgacgccttcccagatcaggtggccattcaactgaacgacacccatccagcacttgcaatcccggaactcatgagaatctttgtcgacattgagaagttgccttggtcgaaggcatgggaattgacccaaaagacctttgcatacaccaaccatactgtccttcctgaagcactggaaagatggcctgtggatctggttgaaaagctccttccccggcatcttgagatcatttacgagataaaccagaaacatctggatcggattgtggccctttttcctaaagatgtggatcggctcagaagaatgtccctcatcgaagaagaaggatcaaagcgaattaacatggcccatctttgcattgtcggcagccacgcagtgaatggagtcgcaaagatacattcagacatcgtgaaaacgaaggtgtttaaggatttctcagagcttgagccagacaagttccaaaacaagaccaacggaattacgcccagacgatggctgctgctttgtaaccctggactcgcagaactcatcgcagagaagataggcgaagattacgtcaaagacctttcgcagctgactaagctccattcgtttcttggtgacgatgttttccttcgggaactggccaaggtgaagcaagaaaacaagctgaagttttcgcagtttctcgagactgagtacaaagtcaagatcaacccatcgtccatgtttgatgtccaagtgaaaaggattcatgagtacaagagacagcttctgaattgtctccatgtcattacgatgtacaatcgtattaagaaagatccaaagaagctgttcgtcccacgcaccgtgatcataggaggaaaggccgcacctgggtaccacatggcaaagatgatcatcaagctcataacttccgtcgcagatgttgtgaataacgatcctatggtgggcagcaaattgaaggtgatcttcctcgaaaactaccgggtgtcacttgcagaaaaggtgattccggctactgatctctcggagcagattagcactgcaggtacggaagcgagcggcaccggcaacatgaagtttatgctgaatggagcactgaccattgggacgatggacggagccaatgttgaaatggccgaagaagcaggtgaggagaacctgttcatattcggtatgagaatagatgatgtcgcagcgcttgacaaaaagggttatgaggcgaaggaatactacgaagctctgcctgaactgaaacttgtcatcgatcagatcgataatggtttctttagccctaagcaaccagacttgtttaaagacattatcaatatgctcttttaccatgaccgatttaaggtctttgcagactacgaggcgtacgtaaagtgtcaggacaaggtgtcacagttgtacatgaacccaaaagcatggaacactatggtgctgaaaaacattgcagcctcgggcaaattctcctcggacaggactattaaggagtacgcacagaatatctggaatgtcgaaccatcggacctcaaaatctccctgtccaacgagagcaataaggtgaatggtaat

SEQ ID NO: 250885 - DNA, 2541 bp, Artificial Sequence
  Description of Artificial Sequence: Synthetic coding sequence
atggcaaagccattgacggaccaggaaaaaaggcgacaaataagcattagggggattgttggcgtggaaaatgtggcagagctgaagaagtccttcaatcggcatcttcactttactctggtgaaggatcgcaacgtggcaaccacgagagattactactttgcactggcacatactgtccgggaccatttggtggggagatggattcgaacccaacagcactactacgacaagtgccctaaaagggtctactatctctcgctggagttctatatgggaagaactcttcaaaacacgatgatcaacctggggctgcaaaacgcatgtgatgaggccatttaccagctcggactcgacattgaagaacttgaagaaatcgaggaagatgcagggctcggtaatggggggctgggaaggctggcagcctgctttcttgatagcatggcgaccctgggacttgcggcatacgggtacgggattcggtacgaatacgggatcttcaaccagaaaatccgtgacggatggcaggtggaagaagccgacgattggctccggtacggaaacccttgggagaagagcagacccgaattcatgctccctgtgcacttttacggaaaagtcgaacataccaacaccggaactaagtggattgatacccaggtggtgcttgctctcccctacgacactccagtgccaggttatatgaataacacggtgaacaccatgagactctggtcggcacgcgcaccaaatgatttcaacctgcgtgactttaacgtgggtgattacatccaggccgtgcttgaccgaaacctcgcagagaacatatcacgggtcctgtatccaaacgataacttttttgaaggtaaggaactccgactcaaacaagaatacttcgtggtcgcagcaacgctccaggatatcatccggagattcaaggcatcgaagtttggtagcactcgcggcgccggtactgtgtttgacgccttccctgatcaagtggctatacagctcaacgatacccatcccgcccttgcaatccccgaactcatgagaatctttgtcgatatcgaaaagctgccttggtcaaaggcgtgggagcttacgcagaaaaccttcgcctacacgaatcacaccgtgcttccagaagccttggaacgctggcctgtcgatctcgtggagaaactgctgccccggcatcttgagatcatctacgagattaatcaaaagcatctggacagaattgtggccctgtttcccaaagatgttgatcggcttcgacgcatgtctctgatcgaagaagaaggatcgaagaggattaacatggcacacctgtgtatcgtgggctcgcatgccgtgaacggcgtggctaagattcactcagatattgttaaaaccaaggtgtttaaagatttttcggaacttgagccagacaagtttcagaataagaccaatggcattactccaagacggtggctgcttctttgcaaccccggtctggccgaacttatagcggagaaaattggcgaagattacgtcaaggatcttagccaacttactaagctccactcttttcttggcgatgatgtgtttctgagggaacttgcaaaggtgaagcaagagaacaaacttaagttcagccagtttctcgaaactgagtacaaagtgaagattaacccgagctcgatgttcgacgtgcaagtgaaaagaattcatgagtacaaacgccaacttctgaactgcctccacgtgattactatgtacaacagaatcaaaaaggacccaaagaaactcttcgtgcctcggactgttatcataggaggtaaggccgcccctggataccatatggccaagatgatcatcaagttgattaccagcgtggcagatgtcgtgaacaacgatccgatggttgggtccaagctcaaggtgatcttcttggagaattaccgcgtctcgcttgcagagaaggtgattccagccaccgacctgtcagaacaaatttcgaccgctggcactgaagcgtccggcactggtaacatgaaattcatgctcaacggtgccctgaccatcggaactatggatggagcgaacgtcgaaatggcagaggaagcgggggaggagaatctgtttatctttggcatgcgtatagatgacgtcgctgcgctggataagaaaggttacgaagcaaaagaatactacgaggcactgccagagcttaagctggtgatagatcagattgataatgggttcttttcgcctaagcagcctgacctgtttaaagacataatcaacatgctcttttaccatgaccggtttaaagtgtttgccgattacgaagcctatgtgaagtgtcaagacaaagtgtcccaactgtacatgaatcccaaggcatggaatactatggtgcttaagaacattgcggcatcaggaaagttttcctcggaccgcacgattaaagagtacgctcagaacatttggaacgtggaaccaagcgatctgaagatttccctctcaaacgaatccaacaaggtcaacgggaat

SEQ ID NO: 250886 - DNA, 2541 bp, Artificial Sequence
  Description of Artificial Sequence: Synthetic coding sequence
atggccaaacccctcacagatcaggaaaaaagacgacagatctctattcggggaatcgtcggagtagaaaatgtcgcggaactcaaaaaaagtttcaacagacatctgcatttcacacttgtgaaggatcgcaatgtggctactactagggattactattttgccctggcccacacagtccgggatcatctcgtgggacgctggatccgcacacagcagcactattacgacaaatgcccaaaacgggtgtattacctctccctcgagttttatatggggcgaacactccaaaatactatgattaatctagggttgcagaacgcctgcgatgaagcaatataccagctcggattagatatagaagaattggaagagattgaagaagacgctgggttgggaaacgggggactaggacgcctcgcagcatgcttcctcgattccatggcaacactcggattagccgcctacgggtatggaatacgatatgaatacggaatttttaatcagaagattcgtgatgggtggcaggttgaagaggctgatgattggctccgatacggaaatccatgggaaaaatctagaccagagtttatgctgcccgtacacttttatgggaaagtggaacacactaatacaggaactaaatggatcgatacacaagttgtgctcgcccttccatatgacacacccgtccccggatacatgaacaatacagtcaatacaatgcggctttggtctgcacgggcaccaaatgattttaacctcagggatttcaacgtgggagattatatacaagcagtcctcgatcgcaatctcgcagaaaatataagtcgggtcctttatcctaatgataactttttcgagggaaaagaactccgattgaagcaagaatatttcgtcgtcgcagccacattacaggatattattcgaagattcaaagcctctaaatttggatctacacgaggagccggaacagtattcgatgcgttcccagaccaggtagccatccagctgaatgatactcaccccgctctagcgatccccgaactgatgcggattttcgtcgatattgaaaagctcccatggtccaaagcttgggaactgacacagaaaacattcgcctatactaatcatacagttcttccagaagccctcgagaggtggcctgtggatctggtggaaaaactcctccctagacacctcgaaatcatatacgaaattaaccagaaacatctggatagaatcgttgcgttattcccaaaagatgtcgatagactgagacggatgtctctcatagaagaagaagggtctaaaagaataaatatggctcacctgtgcatcgtgggatcccacgctgtgaacggagtagccaaaatacattccgatatagtgaaaacaaaagtatttaaagatttttctgaattagagcccgataaattccagaacaaaactaacggaataactcctagacgatggctcctgctgtgcaaccccgggctggcagaattaatagccgaaaaaattggggaggattatgtaaaggatctctcacagttaacaaaacttcactctttcctgggggacgatgtattccttagagaactggccaaggtcaaacaggaaaataaactgaagttttctcagttcctcgaaacagaatataaagttaaaatcaacccttcatctatgtttgacgtgcaggtgaaacgaattcacgagtataaacgccagctgctgaactgcctccatgttataactatgtataatcgaatcaaaaaggatccaaagaaactatttgtccctagaactgtgatcattggagggaaagcagctccagggtaccacatggcaaagatgatcatcaaacttattacttctgtggcagatgtggttaataatgatccaatggtgggatctaaattaaaagtcatctttctagagaactatagggtctcgttagcagaaaaggtgatacctgctactgatctcagtgaacagataagtactgctgggacagaggcatccgggacagggaacatgaagttcatgcttaatggagcccttacaatcggaacaatggatggggcgaacgtggaaatggcagaagaagctggagaagaaaatctttttatatttgggatgagaatagacgacgttgctgccctggataaaaaaggatatgaagctaaggaatactacgaagcccttcctgaactcaaactggtgatcgatcagatcgataatgggttttttagtcccaaacagcccgacctgttcaaggacatcatcaacatgctgttttatcatgataggtttaaagtgttcgctgactacgaagcttatgtgaaatgtcaggataaagtgtctcagctgtacatgaaccccaaagcctggaatacaatggttctaaaaaatatcgccgcatctgggaagttctcctcagatagaacaatcaaagaatatgcccagaatatttggaacgtggaaccttccgacctcaagatctcactctccaatgaatctaacaaagttaatggaaac

SEQ ID NO: 250887 - DNA, 2541 bp, Artificial Sequence
  Description of Artificial Sequence: Synthetic coding sequence
atggccaagccgctgaccgatcaggaaaagcgcagacagatttccatcagaggtattgtgggcgtcgaaaacgtggcagaactcaagaagtcgtttaacagacatctccatttcacgctcgtgaaggatcggaatgtggcaaccactagagactactactttgcacttgcacatacggtgagagatcacctggttggtaggtggattcgaactcaacaacattactacgacaagtgtccaaaacgcgtgtactatctctcacttgaattctacatgggcaggactctccagaacactatgattaaccttggactgcagaacgcatgcgacgaggcaatctaccagctggggctggacattgaagaactggaggagattgaagaagatgcggggctcggaaacggaggactggggagacttgccgcatgcttccttgattccatggcaaccctgggactcgcggcttacggatacggtatccgttacgaatacggtatctttaatcaaaagatccgcgatggctggcaagtcgaagaagcagacgactggcttagatacggaaatccatgggagaagtctaggccggagtttatgctgcctgtgcatttctacggaaaggttgaacacactaatactggaaccaagtggattgatacccaggtggtgcttgccctcccttacgatactccagtgccaggttacatgaacaatacggtgaacactatgagactgtggtccgcaagagctccaaacgatttcaaccttcgcgatttcaacgtcggagattacattcaggctgtccttgatagaaaccttgcagagaacattagccgagtgctgtacccgaacgacaatttcttcgaggggaaggaactgcgccttaaacaagaatactttgtggtagcggcaacccttcaagatatcatcagaagattcaaagcgagcaagtttggaagcacccggggagccggcactgtgtttgatgctttcccagatcaggtcgcaattcagcttaatgatacccatcctgcacttgcgattccagaacttatgcggattttcgtggacattgaaaagctgccttggtcgaaggcatgggagttgacccaaaagacttttgcctacactaaccataccgtcctgcctgaagcactggagcggtggccagtggatcttgtcgaaaagttgctgccaaggcacttggaaatcatttacgaaatcaaccaaaagcatcttgaccggattgtggcattgttcccaaaagatgtcgatagactgaggaggatgtctctcatagaggaggaaggaagcaaaagaattaacatggcccacctgtgcatcgtgggctcccatgcagtcaatggtgtcgccaagattcattcagatattgtgaaaactaaggttttcaaagatttttcggagctcgagccagataagtttcagaacaaaaccaacggaatcacccctcggaggtggctgctcctctgtaaccctggactggcggaactgatcgcggaaaagatcggcgaggattacgtcaaggatctttcacagcttaccaagctgcattcctttcttggagacgatgtgttcctgagagaactggcaaaagtgaagcaggagaataaacttaagttctcacagttcctggagactgaatacaaggtcaagataaacccttcgtcaatgttcgatgtccaagttaaacgcatccacgagtacaagagacagcttcttaactgtctgcacgtcattaccatgtacaaccgaatcaagaaggatcccaagaagctgtttgtgcctcgcaccgtgatcatcgggggaaaggcagcgccaggatatcacatggcaaagatgatcataaaactgatcacgagcgtggcagatgtcgtgaacaacgaccccatggtgggatccaaacttaaggtcatctttctggagaattaccgtgtgtcccttgcagaaaaagtgattcctgccacggacctttcagaacagatttccaccgcaggaaccgaagcatcaggtactggaaatatgaagtttatgcttaatggagccctgactatcggcaccatggatggtgcaaacgtggaaatggcggaggaagcaggggaagaaaacctgttcatttttggaatgcgcatcgatgatgttgcagcactggacaagaaaggttacgaagcaaaggaatactatgaagcactgcccgagctgaagctcgtgattgatcaaatagataacggctttttctccccgaaacagccagatctgttcaaagacatcatcaatatgcttttctaccatgatcgattcaaggtgtttgcagactacgaggcatacgtgaagtgccaggacaaggtgtcccagctgtacatgaatccaaaggcatggaatactatggtcctgaagaacattgcagctagcgggaagttttcgagcgacaggaccattaaagagtacgcacaaaacatatggaatgtcgaaccaagcgaccttaagatctcgctcagcaatgaatcgaacaaggttaacgggaac

SEQ ID NO: 250888 - DNA, 2541 bp, Artificial Sequence
  Description of Artificial Sequence: Synthetic coding sequence
atggctaagccgctcaccgatcaagaaaaaaggagacaaatctcgattagagggatcgtcggagtggaaaatgtggcagagctcaagaaatcctttaaccggcaccttcatttcactctggtgaaggatcggaatgtcgcaaccactagagattactactttgctctcgcacacaccgtgcgtgatcaccttgtgggccgatggattagaactcagcagcactattacgataagtgtccaaagcgagtgtactacctttccctggagttttacatgggccggactttgcaaaataccatgatcaatcttgggcttcaaaacgcatgcgatgaagccatttaccagctgggactggacatcgaagaactggaggaaatcgaggaagatgcgggactgggtaacggcggccttggacgcctcgcagcgtgttttctggattcaatggcaacgctgggacttgcagcatacggctacggaatccgctacgaatacggaattttcaaccaaaagatccgcgatggctggcaggtcgaagaagccgatgattggttgcgctacgggaacccttgggagaagtcgcgcccggaattcatgcttcccgtgcacttttacggaaaggtcgaacatactaacactggtactaaatggatagatacccaggttgtgcttgcgctgccttacgatacgcctgtgccaggttacatgaacaataccgtcaacaccatgagactctggtcagcacgcgcgcctaacgactttaatctcagggatttcaatgttggagattacatacaggcagtgttggaccgcaatcttgcagagaatatctcccgggtgctttaccccaatgacaatttctttgaaggtaaggaactgagactcaaacaagagtactttgtggtggcagccacccttcaagacatcattagaaggtttaaggcatccaagtttggttcgaccagaggggcaggcaccgtgtttgatgcctttccagatcaagttgcgattcaactgaacgatactcaccccgccttggcgataccagaactgatgcgcattttcgtcgatattgaaaagctcccttggtcgaaggcatgggagctcacgcaaaagacctttgcatacaccaaccacaccgtgctgcccgaagcacttgaaagatggcctgtggaccttgtggaaaagctgctgccaagacatctcgagattatctacgagattaatcaaaagcatttggatcgaattgtggccctttttcctaaagatgtcgatcgtctgcgccgaatgtcgctgattgaagaagaaggcagcaagcgcatcaatatggcacatttgtgtattgtgggatcacacgcagtgaacggagtggcaaagatccattccgatatcgtgaaaaccaaggtgtttaaggatttttctgaattggaacctgataagtttcagaataagaccaatggaattactccacgaagatggctgcttctttgtaatccagggctcgcagaactgattgcagagaagatcggcgaggattacgtgaaggacctgagccagcttactaagctgcatagctttctcggggacgatgtgttcttgagagagcttgcaaaagtgaagcaggagaacaaactgaaattctcccaatttctggagacggaatacaaggtgaagatcaacccttccagcatgtttgatgtgcaggtgaagcggattcacgagtacaagcgacagctgctgaattgtttgcacgtcatcaccatgtacaacagaataaagaaagacccaaagaagttgttcgttccacgcaccgtgatcataggcggaaaggcagcaccaggttaccacatggcaaaaatgatcattaaacttattacctcggtggccgatgtcgtgaacaatgatcctatggtcggttcgaagctcaaggtgatttttctggagaattaccgggtcagcttggcagaaaaggtcatacctgcgaccgatctttccgaacagatctcgactgcaggaactgaggcgagcgggaccggtaatatgaagtttatgctgaatggagcgcttactattggtaccatggatggcgccaacgtcgaaatggctgaagaagcaggtgaagagaaccttttcatattcggcatgaggatcgacgatgtggcagcacttgacaaaaagggatacgaagcaaaagagtactacgaggccctcccagaactcaagctggtgatcgaccagatcgacaacggattctttagccctaagcaacctgatctgttcaaggacattatcaatatgctcttttaccatgacaggtttaaggtctttgcagattatgaagcatacgtcaagtgccaggacaaggtgtcgcagctgtacatgaacccaaaggcatggaatactatggtcttgaagaatatcgcagcgagcgggaagttttcgtccgatagaactatcaaggagtacgctcaaaacatttggaatgtcgaaccttcggacttgaaaatctcgctttctaacgagagcaacaaggtgaacgggaac

SEQ ID NO: 250889 - DNA, 2541 bp, Artificial Sequence
  Description of Artificial Sequence: Synthetic coding sequence
atggcaaagccgctgactgatcaggagaagcgtcgacaaatcagtatccgcggcatcgtgggagtcgaaaacgttgcggaactcaagaaatcgtttaatagacacctgcacttcaccctcgtcaaagatcgcaatgtggcgaccacccgcgactactacttcgccctcgctcacaccgtgcgcgaccatttggtcggacggtggatcagaacccaacagcattactacgacaagtgtccaaagcgggtgtactacctgtcactggagttctacatgggacgcaccttgcagaataccatgatcaacctgggactgcagaacgcctgcgacgaggcgatctaccaacttggtttggatatcgaagaattggaagagatcgaagaagatgccggactcggaaatggaggcttgggaagactggccgcctgtttccttgattcaatggcgaccttgggactggcagcctacggctacggcatcagatacgagtacggaatcttcaaccagaaaattcgcgacggttggcaggtggaagaggctgacgattggctcagatacggtaacccgtgggagaagtcccggcccgagttcatgctcccagtgcacttctatggtaaggtcgaacacaccaacaccggcactaagtggatcgatactcaggtggtgctggcccttccttacgacaccccggtcccgggatacatgaacaacactgtcaacactatgagactctggtcagcgcgcgccccaaacgacttcaatctgcgcgactttaacgtgggagactacattcaagccgtgttggaccgcaatctggccgagaacatcagccgcgtcctctacccaaacgacaacttcttcgagggcaaggaactcagattgaagcaggaatacttcgtcgtggcagcaaccctgcaggacataattcgccgctttaaggcctcaaagttcgggtccacccgcggagcgggaactgtgttcgatgccttcccggaccaggtggccatacagctcaacgatactcatcccgcgctcgccattccagaactgatgcggatcttcgtggacatcgaaaagctgccgtggtcgaaggcctgggaactgacgcagaagaccttcgcatacaccaaccacaccgtgctgcctgaggcactggagaggtggccagtggacctcgtggaaaagctccttccgcggcatctggaaattatctacgaaatcaaccaaaagcacctcgatcggatcgtagcgcttttcccgaaggatgtggatcggctgcgcagaatgtctctgattgaggaggagggaagcaaacggatcaatatggcacatctctgcattgtaggatcgcatgctgtgaacggtgtggctaagatccattcagatatcgtcaaaactaaggtgtttaaggacttctcagagctggaacctgataagtttcagaataaaactaacggtatcactccgcgccggtggctcctgctgtgcaacccaggcctggctgaattgatagctgaaaaaatcggagaggactacgtgaaagacctgagccaactgacgaaacttcatagctttctcggcgacgatgtcttcttgagggaactcgcaaaggtgaagcaggagaacaagctgaaattctctcagttcctcgagactgagtacaaggtgaaaatcaacccgtcctcaatgttcgatgtgcaggtgaaacggattcacgagtacaaacggcaactgctgaactgcctgcacgtgatcaccatgtacaacagaatcaagaaggatccaaagaagctcttcgtgccgcgcaccgtgatcattggtggaaaggcagcccctggctaccatatggccaaaatgattatcaagttgatcacgagcgttgctgatgtggtgaacaacgacccgatggttgggagcaaactcaaggtgatcttcctcgagaactatcgggtgtcgctggctgagaaagttatccccgcgactgatctctcggaacagatctccactgcgggaactgaggcatccggcactggaaacatgaagtttatgcttaatggcgccttgaccatcgggactatggacggtgcaaatgtcgagatggccgaagaggcgggcgaagagaacttgttcattttcggtatgcgcatcgatgatgttgccgcactggacaagaagggatacgaggccaaagagtactacgaagcgctgccagagctcaaattggtcatcgatcagatcgacaacggattcttttcgccgaagcagcccgacctctttaaggacatcatcaatatgctgttttaccacgaccggtttaaggtgttcgctgactacgaagcgtacgttaagtgccaagacaaggtcagtcaactgtacatgaacccgaaggcttggaacaccatggtgctgaaaaacatcgcggcttcaggcaaattctcgtccgatcgcactatcaaggaatacgcacaaaacatctggaacgtcgaaccatccgacctgaagatttccttgtccaacgagtccaataaagtgaacggaaat

SEQ ID NO: 250890 - DNA, 2541 bp, Artificial Sequence
  Description of Artificial Sequence: Synthetic coding sequence
atggctaaaccgcttacagatcaggaaaaaagacgccagatatctatccggggtatcgtcggggtggaaaacgtcgcggaactaaagaaaagcttcaaccgacatctgcacttcactttggtcaaagatcgcaacgtggctacaaccagggactactacttcgcgctggctcacaccgttcgtgatcatctggttgggagatggatccgcacccagcagcattattacgataagtgtccaaagcgcgtgtactacttaagcctggagttttatatgggccgcactctgcagaataccatgataaatctaggcctccagaatgcttgtgatgaagcgatctatcagcttggtcttgacatcgaagagcttgaagagatcgaagaggatgccggcttggggaatggcggactcggtaggctggctgcttgctttcttgatagtatggccacactaggactcgcagcatatgggtatggaatacgatatgagtacggaatcttcaaccaaaagatcagagacgggtggcaggtcgaggaggcggacgattggctgcggtacggcaacccctgggagaagtctcgccccgaattcatgttacctgtacacttctatggtaaagttgagcacaccaatacaggtacgaaatggatcgatacacaggttgtattggcgctcccatacgacaccccggtaccgggatatatgaacaataccgttaataccatgcgcttatggtcagcccgtgccccaaatgactttaatcttagggatttcaatgtgggagactatatccaggctgtgctagatcgcaacctggccgagaatatctctcgggtcctttaccctaatgacaatttcttcgaaggaaaggagcttaggttaaagcaggagtactttgtggtagccgccacactccaggatatcatccgccgattcaaggctagtaaattcggctcgacacgcggagctggtaccgtcttcgacgcctttccagaccaagtcgcgatccagctgaatgacacccatccagcactcgccataccggaattaatgcggatctttgttgacatcgaaaaactcccctggtctaaagcgtgggagcttacacagaaaacgttcgcgtacacaaaccatacagtcctccccgaggctctggaacgctggccggttgaccttgtggagaaactcctccctcgtcacttggagattatctatgagatcaaccagaagcacctcgaccgtattgtggccctcttcccgaaagacgttgaccgattgcgaaggatgagcttgatcgaggaggaagggtcgaagcggatcaacatggctcatctatgcattgtgggatcgcatgctgttaacggcgttgccaaaattcactctgacattgtcaagactaaagtctttaaggatttctctgagctagagccagacaaatttcagaacaaaaccaacggcatcaccccacggcgctggttgctactctgcaaccctggacttgctgagctcatcgcagaaaaaatcggggaagattacgtcaaagatctgagtcaactaaccaagctacattccttcctaggcgatgacgttttcctccgcgagctggccaaggtgaagcaggagaacaagctgaaattttcacagtttttggagacggagtataaggtcaaaattaatcccagcagtatgttcgatgtgcaggttaagcggatccacgagtacaagagacagctgctgaattgcctccacgtaataaccatgtacaatagaattaagaaggaccccaaaaaattgtttgttccacgcaccgtaattattggaggaaaagcagcacctggttatcatatggctaaaatgatcatcaaattaattacgagcgtggctgacgtcgtgaataacgacccgatggttggtagtaagctgaaggtgatctttctggaaaactaccgcgtgagcttagcagaaaaggtcatccctgccactgacctcagtgagcagatctccaccgccggtactgaggcctctggtaccggaaacatgaagttcatgttgaacggggccctaacaatcggaactatggacggtgcgaatgtagagatggctgaggaggctggtgaagagaacctatttatcttcgggatgcgaattgacgacgttgccgctttggataaaaagggttatgaagctaaagagtattatgaggcgctaccagaactcaagcttgtcatcgaccagatcgataacggattcttttctcccaagcagcctgacttattcaaggatatcattaatatgctgttctatcatgatcgcttcaaggtcttcgccgattatgaagcctatgtcaagtgtcaggacaaggtctcccagctttacatgaatcccaaggcatggaatactatggttctcaagaacatcgccgcctccggtaaattctcttccgataggacaatcaaggagtacgcccagaatatttggaacgtcgagccgagcgatctgaagatctctctgagtaacgagtcgaataaagtaaatggaaat

SEQ ID NO: 250891 - DNA, 2541 bp, Artificial Sequence
  Description of Artificial Sequence: Synthetic coding sequence
atggctaagccactgaccgatcaagaaaagagacgccagatcagcatcagaggtatcgtgggtgttgaaaacgtcgcagagcttaagaagagctttaatcgccatctccatttcactcttgtcaaggatagaaacgtcgctactactagagattattacttcgcactggcccatacggttagggatcatctggtgggccgctggatacgcacacagcagcattattacgacaagtgccccaagcgcgtatactacctgagtctcgagttctacatgggtaggacgctgcaaaacactatgataaaccttggtttgcaaaatgcctgtgacgaagcgatctaccagctgggtttggatatcgaggagctcgaggaaatagaggaagatgctggcctcggaaacggtggtttgggacgcctcgcagcttgcttcctcgattctatggccacgctcggtttggccgcttacggctacggcatcagatacgagtacggaatattcaaccagaagattcgcgacggatggcaggtagaggaggccgatgattggttgagatatggcaacccctgggaaaaaagtcgccctgagtttatgctgccggtgcacttctacggcaaggtcgagcatactaatacgggaactaagtggatcgacacccaggtggtcctggcattgccatacgacacccccgttccaggctatatgaacaacactgtcaacaccatgagactgtggtccgcgcgcgcccccaacgactttaatttgagagatttcaatgtgggtgactatatccaggccgtgctggaccgcaacctggctgaaaatatctccagagtgctgtaccccaacgacaacttctttgaaggcaaggaattgaggcttaaacaggagtacttcgtggtcgcggcgacactgcaggatattattagaaggttcaaggcgagcaagtttggtagcacccgcggcgcaggaacagtgttcgacgccttcccagaccaagtggctatccagctgaacgacacacaccctgcattggccatccctgagctgatgaggatctttgtcgacatcgagaaactgccgtggtccaaggcctgggaacttacgcaaaagaccttcgcttatacgaaccacacggtcctgccagaagcgcttgaacgctggcctgtggacttggtcgaaaagctgctgccccgccatcttgaaatcatctatgaaataaaccagaaacacctggatcgcatagtggctttgttccccaaggacgtggacagactgcgccgcatgtctctgatcgaagaagagggtagtaagagaatcaatatggcccacctctgcatagtaggcagccatgctgtgaacggtgtcgccaagatccactcagatatagtaaagactaaggtgttcaaagacttttccgaactggagccagacaagttccaaaataagacaaacggaattacaccacgcaggtggctgctgctttgtaatcctggccttgcagagcttatcgcagagaagattggagaggattacgtgaaggacctctctcagctgacgaagcttcactctttcttgggagacgatgtcttcctccgcgagttggcaaaggttaaacaagaaaacaagctgaagttctcacagtttctcgaaactgagtataaggtgaagatcaatccttcatcaatgtttgacgtccaggttaagcgcatccacgagtataagcgccagttgctgaactgcttgcatgtgatcacaatgtacaaccgcatcaaaaaagatcctaagaaattgtttgtgcccaggaccgttatcatcggaggtaaagcggcgcctggctaccatatggcgaagatgattattaagctgatcacgagcgtcgccgatgtcgtaaacaacgaccctatggttggatccaagctcaaagtcatcttccttgaaaactatagagtcagtctggcagagaaggtcatccctgctaccgatctgtcagagcagatttcaactgctggtactgaagcaagtggcacaggcaatatgaaattcatgctgaacggcgctctcactatcggaactatggatggagcaaacgtcgaaatggccgaggaggctggagaagagaacctgttcatctttggaatgcgcatagatgatgtcgccgccctggacaaaaagggttacgaggcaaaggagtattatgaggcactgcctgagcttaagttggtgattgaccaaatagacaacggtttcttctctcctaagcagcctgacctttttaaagacatcatcaatatgttgttctatcacgacagattcaaggtcttcgcagactacgaggcctatgtgaagtgccaggacaaggtcagccagctgtatatgaatccgaaggcctggaacacaatggtcctgaagaacattgccgcctccggtaaattttctagcgaccgcactatcaaggaatacgctcagaacatttggaacgtagaacctagcgacctgaagatcagcctgtcaaacgaatccaacaaagtgaatggcaac

SEQ ID NO: 250892 - DNA, 2541 bp, Artificial Sequence
  Description of Artificial Sequence: Synthetic coding sequence
atggctaagccactgactgatcaggagaagcgccgccaaatatccattcgcggcatcgtcggggtggagaacgtagctgagctgaagaagtcttttaaccgacacctgcattttaccctcgttaaagaccgcaacgtagccactacccgtgactattactttgcgctggcacatactgtgcgggaccatcttgttggacggtggattcggacccaacagcactactacgataagtgccctaagcgggtctattatctgtctctggaattctatatgggtcgcacactccagaataccatgatcaatctcggactgcagaatgcctgcgatgaagctatctatcagctggggctggatattgaggagttggaggaaattgaagaggatgctggcctggggaatggcggcctgggccgcctcgccgcatgcttcctcgactccatggcgacattgggactcgctgcctatgggtatggcatccgctatgagtacggaattttcaatcagaagatccgcgatggctggcaggtggaagaggcagacgactggttaaggtatggcaacccgtgggaaaaatccagacctgaatttatgctgcctgtccacttctacggtaaggtcgaacataccaataccggtaccaagtggatcgacacacaggtggtccttgcattaccgtacgatacacctgtaccagggtatatgaataacaccgtgaacaccatgcgcttatggtccgcgcgagcccccaatgacttcaacttgcgcgatttcaatgtcggggattacattcaggctgtgctggatagaaatctggccgaaaacatctccagggttctgtatccgaatgacaatttcttcgagggcaaagaactgcggctgaaacaggagtacttcgtggtggcagctaccctgcaagacattatacgccgtttcaaggcctctaaattcggatctaccagaggggccggcacagtctttgacgcgtttccagatcaggtggcaatccagttaaatgatacacatcccgctctggccataccggagctaatgcggattttcgttgatatcgaaaaactgccttggtccaaggcctgggaactgactcagaagaccttcgcatacactaaccacacggtgctgcccgaggcattagagcggtggcctgtagatctggtagagaaactgcttccgcggcatctggaaataatctacgagatcaaccagaagcatttggacaggatcgtggcactgttcccaaaggatgtggatcgcctgcgtcggatgtccctcatcgaggaggagggatctaagcgcatcaacatggcccatctatgcattgtgggttcccacgctgtgaacggggtagccaaaatccatagcgacatcgtgaagacgaaggtattcaaggatttttctgagctggagccagacaaatttcaaaacaaaaccaatggtattacgccaagacggtggctattgctgtgtaatccaggtctggccgagctcattgctgagaagatcggcgaagactacgtaaaggatctgagtcagcttaccaagcttcactctttcctcggggatgatgtctttttgcgggagctggctaaagtgaagcaagagaataaactcaagttctctcagttcctggagactgagtacaaggtgaagattaacccctcctccatgtttgatgttcaggtcaagcgaatacacgaatacaaacggcagcttttgaactgcctgcatgtcattactatgtacaaccgcatcaaaaaagaccctaaaaagctgttcgtccctagaactgtaatcatcggcggcaaggctgcacccgggtaccacatggctaagatgataatcaaacttattacctctgtagctgatgttgttaacaatgatcctatggttgggtcaaagctaaaagtgattttcctcgagaattatagagtgtctctggccgagaaggtgatccccgccacggatctgtcagagcaaatctctactgccggcaccgaggcaagtggtaccggtaatatgaaattcatgctgaatggagctcttaccatcggcacaatggatggcgccaacgtggaaatggctgaagaggccggagaagagaatctgtttatttttggcatgcgcatagacgatgttgcagcattggataaaaaaggctacgaagctaaagaatactatgaggcgctacccgagctgaagctcgtgatcgatcagatcgacaacggcttcttttcacctaagcaacctgatctgtttaaggacatcatcaacatgctattctaccacgatcgtttcaaggtgttcgccgactatgaagcttatgtgaaatgtcaggacaaagtctcgcagctgtacatgaaccctaaagcctggaacactatggtgctgaaaaatatagcagccagtggcaaattctcaagcgatagaactattaaagaatatgcacagaacatttggaatgttgagccttccgacttgaagatcagcctgtcaaatgagtccaacaaagtgaatggtaat

SEQ ID NO: 250893 - DNA, 2541 bp, Artificial Sequence
  Description of Artificial Sequence: Synthetic coding sequence
atggcgaaaccgttaacggatcaagaaaaacgtcgtcaaatatcgatacgtggtatagtaggtgttgaaaatgtagcggaactaaaaaaatcgtttaatcgtcatctacattttacgctagtaaaagatcgaaatgttgcgacgacgcgtgattattattttgcgttagcgcatacggtacgagatcatctagtaggtcgatggatacgtacgcaacaacattattatgataaatgtccgaaacgtgtatattatctatcgctagaattttatatgggtcgtacgctacaaaatacgatgataaatttaggtttacaaaatgcgtgtgatgaagcgatatatcaattaggtctagatatagaagaactagaagaaatagaagaagatgcgggtctaggtaatggtggtctaggtcgtctagcggcgtgttttttagattcgatggcgacgctaggtctagcggcgtatggttatggtatacgttatgaatatggtatatttaatcaaaaaatacgtgatggttggcaagtagaagaagcggatgattggttacgttatggtaatccgtgggaaaaatcgcgtccggaatttatgttaccggtacatttttatggtaaagtagaacatacgaatacgggtacgaaatggatagatacgcaagtagtactagcgttaccgtatgatacgccggtaccgggttatatgaataatacggtaaatacgatgcgtttatggtcggcgcgtgcgccgaatgattttaatctacgtgattttaatgtaggtgattatatacaagcggtactagatcgaaatttagcggaaaatatatcgcgtgtattatatccgaatgataatttttttgaaggtaaagaactacgtctaaaacaagaatattttgttgtagcggcgacgctacaagatataatacgtcgttttaaagcgtcgaaatttggttcgacgcgaggtgcgggtacggtttttgatgcgtttccggatcaagtagcgatacaactaaatgatacgcatccggcgttagcgataccggaactaatgcgaatatttgtagatatagaaaaactaccgtggtcgaaagcgtgggaattaacgcaaaaaacgtttgcgtatacgaatcatacggttctaccggaagcgttagaacgatggccggttgatttagtagaaaaattattaccgcgtcatttagaaataatatatgaaataaatcaaaaacatttagatcgaatagttgcgctatttccgaaagatgtagatcgtctacgtcgtatgtcgctaatagaagaagaaggttcgaaacgtataaatatggcgcatttatgtatagttggttcgcatgcggtaaatggtgtagcgaaaatacattcggatatagtaaaaacgaaagtttttaaagatttttcggaactagaaccggataaatttcaaaataaaacgaatggtataacgccgcgacgttggttattattatgtaatccgggtctagcggaattaatagcggaaaaaataggtgaagattatgttaaagatttatcgcaattaacgaaactacattcgtttctaggtgatgatgtatttctacgtgaattagcgaaagttaaacaagaaaataaactaaaattttcgcaatttttagaaacggaatataaagttaaaataaatccgtcgtcgatgtttgatgttcaagttaaacgaatacatgaatataaacgacaactactaaattgtttacatgtaataacgatgtataatcgaataaaaaaagatccgaaaaaactatttgtaccgcgtacggtaataataggtggtaaagcggcgccgggttatcatatggcgaaaatgataataaaattaataacgtcggtagcggatgtagttaataatgatccgatggttggttcgaaactaaaagtaatatttctagaaaattatcgagtttcgctagcggaaaaagtaataccggcgacggatctatcggaacaaatatcgacggcgggtacggaagcgtcgggtacgggtaatatgaaatttatgttaaatggtgcgctaacgataggtacgatggatggtgcgaatgttgaaatggcggaagaagcgggtgaagaaaatttatttatatttggtatgcgaatagatgatgtagcggcgctagataaaaaaggttatgaagcgaaagaatattatgaagcgttaccggaattaaaattagtaatagatcaaatagataatggttttttttcgccgaaacaaccggatttatttaaagatataataaatatgctattttatcatgatcgatttaaagtatttgcggattatgaagcgtatgttaaatgtcaagataaagtttcgcaactatatatgaatccgaaagcgtggaatacgatggttctaaaaaatatagcggcgtcgggtaaattttcgtcggatcgtacgataaaagaatatgcgcaaaatatatggaatgtagaaccgtcggatttaaaaatatcgctatcgaatgaatcgaataaagtaaatggtaat

SEQ ID NO: 250894 - DNA, 2541 bp, Artificial Sequence
  Description of Artificial Sequence: Synthetic coding sequence
atggcaaagcccctgaccgaccaggaaaagaggcgacagatcagcattagaggaattgtcggagtggagaacgtggcagagctgaagaagtcgttcaacaggcacctgcatttcacccttgttaaagaccgcaacgtcgccaccacccgcgattactatttcgcactcgcacatactgtgagggatcatctggtcggccggtggattagaactcaacagcactattacgacaaatgtccaaagcgcgtctactaccttagcctcgaattctacatggggcgtacgctgcagaacacgatgattaatcttggacttcaaaacgcatgtgatgaagcaatttaccagctgggactggacatcgaagaactggaggagattgaagaggacgccggactgggtaatggcggacttggaaggttggccgcatgttttctggattcgatggcgacgctcggacttgcggcatacggttatggaatccggtacgagtacggaatctttaatcagaaaatccgagacggctggcaggtcgaagaggctgacgattggctgcgctacggaaacccatgggagaaaagcagaccagaattcatgctgccagtgcatttctacggaaaggtggagcataccaacactggcaccaagtggatcgatacccaagtggtgctcgcgctcccatatgacactccagtgcccggttacatgaacaatactgtgaacacgatgcggctttggtcggcacgggcaccaaatgatttcaacttgcgggacttcaatgtcggggattacatccaagcagttcttgatcggaacctggcagaaaacattagcagagtgctttacccgaacgataacttttttgaaggtaaggaactgagacttaagcaggagtactttgttgtggcagcaactctgcaagacataatccgtcggtttaaggcctcgaaatttggctcaaccagaggggcaggcaccgtctttgacgccttccctgaccaagtcgcaatccagctcaacgatacccatccagcacttgccataccagaactgatgagaatctttgtggatattgagaagctcccatggtccaaggcttgggaacttacgcaaaaaacgtttgcctacactaaccatactgtgctgcctgaggcattggaaaggtggccggtagatctggtggagaagctgttgccccggcatctcgagatcatttacgagattaaccaaaagcacctggacaggattgtggcacttttccctaaggacgtggatcgcctgagaagaatgagcctgatagaggaagaaggttccaagcgcattaacatggcacacctgtgtatcgtgggaagccatgcagtcaatggagtggctaagattcattcggatattgttaagaccaaggtctttaaggatttcagcgaactggaaccagataagtttcaaaacaagactaacggaatcactcctagacgatggctcctcctctgtaaccctggcctcgcagagttgattgcagagaaaattggggaggactacgtgaaagacctgtcgcagctcacgaagctccactcgtttcttggggatgacgtgtttcttagagaacttgccaaggtcaagcaagagaataaactcaagttctcacaatttcttgaaaccgaatacaaggtgaagattaaccccagctccatgtttgatgtgcaggtgaagaggattcatgagtacaagaggcaactcttgaactgcctccatgtcataaccatgtacaaccgcataaagaaggatcccaagaagctgtttgtgcctcggaccgtgattatcggaggaaaggcggcacctggttaccacatggcaaaaatgatcataaaactgatcacttccgtggcagatgtcgtgaacaacgacccgatggtggggagcaaacttaaagtgatctttctggagaattaccgggtgtccctcgcagaaaaggtcatccccgcaactgatctgtccgagcagatatccactgcagggactgaagcgtcgggtaccggcaacatgaaattcatgctcaatggcgcacttaccattggaactatggatggcgctaatgtcgagatggccgaggaagcaggtgaagaaaacctgtttatctttggtatgcggatcgatgacgtggctgcgcttgataagaaggggtacgaggcaaaggagtattacgaggcactgccagagctcaagttggtcattgaccaaattgataatggtttcttctcccctaagcagccagaccttttcaaggatatcattaacatgcttttctaccatgatcgcttcaaggtgtttgctgattacgaagcgtacgtgaagtgtcaagacaaggtgtctcagctctatatgaatcctaaggcctggaatactatggtgctgaaaaacatcgcagcatccggaaaattctccagcgatcgaaccataaaggagtacgcacaaaacatctggaacgtggaacccagcgacctgaagatttccctctcgaacgagtctaacaaagtcaacggcaac

SEQ ID NO: 250895 - DNA, 2541 bp, Artificial Sequence
  Description of Artificial Sequence: Synthetic coding sequence
atggcaaaaccacttactgatcaagagaaacgcagacaaatttcgattcgggggatcgtgggcgtggagaatgtcgcagagctcaagaagtcgttcaatcgccacctccattttactctggtgaaggatcgcaacgtggccacgaccagagactattacttcgcactcgcacacactgtccgcgaccatctcgtcggaagatggatccgaacccaacaacactactacgataagtgtccgaaacgggtgtactaccttagcctggagttctacatgggacgcactctccagaataccatgattaaccttggcctgcagaacgcctgcgatgaagctatctaccaactcggacttgacatcgaggagttggaagagattgaggaggacgccggacttggtaacggtggcttgggacgactggccgcatgtttcctcgatagcatggcaaccttggggctcgctgcatacggctacgggattaggtacgagtacggaatcttcaatcagaaaatccgcgatggttggcaggtcgaagaagctgatgattggcttcgctacggcaacccgtgggagaagtccaggcctgagtttatgctgcccgtgcacttttacggaaaggtggaacacacgaacaccggtactaagtggatcgatacccaggtcgtccttgcacttccttacgatacccctgtgcctggttacatgaacaatactgtgaacacgatgcgtctttggtccgctagagcacctaacgatttcaacctgcgagacttcaatgtcggggactacatccaagctgtcctcgatagaaatctggcagaaaacatttcacgggtgctttacccaaacgataacttcttcgagggaaaggaactgagacttaagcaagaatacttcgtggtggcagccaccttgcaggacattatcaggcgtttcaaagcgagcaagttcggtagcaccagaggagcaggcactgtctttgacgcattccctgaccaagttgcaatccagcttaacgacactcatcccgccctggcgatcccagaacttatgcgcatttttgtggatattgagaagttgccctggagcaaagcatgggaactcacccaaaagacctttgcatatactaaccataccgtccttccagaggccttggaacgttggcctgtggatctggtggaaaagctccttccgaggcacttggagattatctacgagatcaaccagaaacacctggaccgcattgtcgcactgtttcctaaagacgtggatagactgcgccgaatgtcgctcattgaagaggaaggttcgaaacgtattaacatggctcacctgtgtattgtcggatcgcatgccgtgaatggagtggccaagatccattcggatattgtcaagaccaaggtgttcaaagattttagcgaactggaaccagataagtttcagaataagaccaatggcattacgccgagacgttggcttcttctgtgtaaccctgggctggcagaactgattgccgaaaagataggagaggattacgtcaaagatctgtcccaattgaccaaactgcatagctttctgggagatgatgtctttcttcgcgaactggctaaggtcaagcaagaaaacaaacttaagttcagccaatttcttgaaacggagtacaaggtcaagatcaatccttcatcgatgttcgacgtgcaggttaaaagaattcatgaatacaaacgacaactgctgaactgtctgcatgtgatcacgatgtacaatagaatcaaaaaggatcctaaaaagctgttcgtcccccggaccgtcataataggcggcaaagcagcaccaggataccacatggcaaagatgatcatcaagctgatcacttcagtggcagatgtggtgaataacgacccgatggtgggatccaagctgaaggtcatctttctggaaaactatcgcgtgtcacttgcagaaaaggtaatcccagcaaccgacttgtccgagcagattagcaccgcaggtaccgaggcatccggaactggcaacatgaagtttatgctgaacggagctctgaccattgggaccatggacggtgcgaacgtggagatggcagaagaggcaggtgaggaaaacctctttatcttcggcatgcggatcgatgacgtcgcagcactcgataagaaaggctatgaggcgaaagagtactacgaggcactgcctgaactcaagctggtcatcgatcaaatagataacggcttcttttctcccaagcagcctgatctgtttaaggacatcattaacatgcttttctaccatgatagatttaaggtgttcgcagattacgaagcgtacgtgaagtgtcaagacaaagtctcgcagctttacatgaatccaaaggcctggaacactatggtgctcaagaatatcgcggcgtctggcaagtttagctcggaccgaactattaaggaatacgcacaaaacatttggaacgtggaaccatccgatttgaagatatcgctttctaacgaatcaaacaaggtcaacggcaat

SEQ ID NO: 250896 - DNA, 2541 bp, Artificial Sequence
  Description of Artificial Sequence: Synthetic coding sequence
atggccaaacctcttactgatcaagagaagaggcgacaaattagcatccgcggtatcgtgggtgtcgagaatgtggcagagctcaagaagtccttcaaccgtcaccttcattttacgctggtgaaagaccggaatgtcgcaactacccgggattactactttgcattggcccataccgtcagagatcatcttgtcggtaggtggatccgcactcaacaacactactacgataagtgcccaaagcgagtgtactacctgtcacttgagttttacatgggccgcaccctgcaaaacaccatgataaacctggggcttcagaatgcctgtgatgaagcaatctatcagcttggtctggatatcgaggaactcgaagagattgaagaagatgccggtctgggcaacggtggacttgggcggctcgcagcgtgttttcttgattcgatggccacgctgggcctggccgcgtacggttacgggatccgttacgagtacggcatattcaaccagaaaattcgggacggatggcaggtggaagaggccgatgattggctgcgctatggtaacccttgggaaaagagccggcctgagtttatgcttccggtgcacttttacggaaaggtggaacacactaacactggaactaagtggatagatacgcaagtggtgcttgctttgccatacgatactccggtgccaggatacatgaacaataccgttaatactatgcgtctgtggagcgcacgcgcgccaaacgacttcaatctgcgtgatttcaacgtgggggattacatccaggcagtccttgaccgaaatctggcagagaacatctccagagtgctgtacccaaatgataacttcttcgagggaaaagaacttagactcaagcaggaatactttgtggtggcagcgacgctgcaagacattattcgtcgctttaaggcatccaagttcggttccaccagaggggccggaaccgtttttgatgcgtttccagaccaagtggcgatccagctgaatgatacccatccggcattggcaattcctgaactgatgagaatctttgtggacatcgaaaaactcccttggtccaaagcatgggaacttacccaaaagacttttgcatacactaatcacaccgtcctgccggaagcccttgagagatggcccgtggatctggtcgaaaagctgcttccgaggcatctggagataatctacgaaatcaaccaaaagcatctcgacaggatcgtggccctgtttcccaaggatgttgacaggttgcgaagaatgtcgctcattgaagaggaaggatcgaaaagaattaacatggctcatctctgtattgtgggatcccatgcggtgaatggggtggcaaaaatccactcggacattgtcaaaaccaaagtctttaaggatttttccgaactcgaacccgataagtttcagaacaagactaatgggataactcccaggcgctggctgctgttgtgtaatccaggcctcgctgagcttatcgccgagaaaataggtgaggactacgttaaggatctgtcccaattgaccaagctccactcgttcctgggagatgacgtctttctccgcgagctcgcaaaggtgaagcaggaaaacaagttgaagtttagccaattccttgaaactgaatacaaagtcaagatcaatccatcgtccatgtttgatgtgcaggtgaagcggattcacgaatacaagagacagctcctgaactgccttcatgtgatcacgatgtacaatcgcatcaaaaaggatcctaaaaagctgttcgtccctagaactgtgataattggaggaaaagccgcaccaggctaccacatggcaaagatgatcattaagctcatcacttcggtggcagatgtggtcaataacgaccctatggtgggaagcaaacttaaagtcatttttcttgaaaactaccgggtgagcctggcagaaaaagtgatccctgcaaccgatctttcggaacaaatctcaactgcaggtactgaggcatcgggtactgggaatatgaagtttatgctgaacggagcacttaccattggaactatggatggtgccaatgtggaaatggctgaagaagcaggtgaagaaaacctcttcatttttggaatgagaatagatgatgtggccgcccttgataagaagggatacgaagcgaaggaatactacgaggcacttccagagctcaagctggtgatcgatcaaatcgataacggattctttagcccgaaacagccagatctgtttaaggacattatcaacatgcttttctaccatgatcggttcaaggtgtttgccgattacgaagcctacgtcaagtgccaggataaggtcagccagctttacatgaatccaaaagcatggaacactatggtgctgaagaacatcgcggcatccggcaaattctcgtcggatcgcactataaaggagtacgcacagaacatctggaacgttgaaccaagcgacttgaagatttcgctgtcgaacgagtccaacaaggtgaacggtaat

SEQ ID NO: 250897 - DNA, 2430 bp, Artificial Sequence
  Description of Artificial Sequence: Synthetic coding sequence
atggagcacaaggaagtggtgttgttgctccttctgtttctgaagtccggccagggcgaacctctcgatgactacgtgaacacccaaggagcgtcgctgttttcggtgacgaagaaacaactgggtgcaggctcaattgaagaatgtgccgcaaaatgtgaagaggatgaagaatttacttgtagagcctttcaataccattccaaggagcagcagtgtgtgattatggcggagaacagaaagtcgtcgatcataattcgcatgagagacgtcgtcttgttcgagaaaaaggtgtacctgagcgaatgtaagacggggaacggaaagaactaccgagggaccatgtccaagacgaagaacggtatcacctgtcaaaagtggtcatcgacctcgccacatagacctcgcttttcccctgccacccatccatccgaaggactcgaggaaaactactgtcgcaatcccgacaacgaccctcagggaccttggtgttacaccaccgaccctgaaaaacgttacgactactgtgatattctcgagtgtgaagaagagtgtatgcattgttccggggagaactacgacgggaagatttctaagaccatgtcgggtttggaatgccaggcttgggattcacagtcccctcacgcacatggatacattccatcgaaatttcctaataagaacctcaagaagaattactgcagaaacccggatagggagcttcgtccatggtgttttaccactgatcccaataagcgttgggagctgtgtgacatccctaggtgcacgactcccccaccctcctcgggtcccacctaccaatgccttaaggggactggtgagaattaccggggcaacgtcgcagttacggtatcggggcacacctgtcaacattggtcggcacaaacccctcacacccataatcgtactccagagaattttccttgtaagaatcttgacgaaaactattgccgtaatcctgacggcaagagagcaccttggtgccatactaccaatagccaggtcagatgggaatattgcaaaataccctcatgtgactcctcacctgtctccactgaacaactggcacctactgcccctccagagttgacccccgttgtgcaggactgctaccacggagacggacaatcgtaccggggaaccagctcgactactaccactggtaagaaatgtcaatcctggtcctccatgacgccacaccggcatcaaaagaccccggaaaactatccaaatgcagggctgaccatgaactattgtcgaaatccggatgctgataagggtccttggtgtttcaccaccgatccaagcgtgcgctgggagtattgtaaccttaagaaatgcagcggtaccgaagcgtctgttgtcgcaccaccccctgtggtgcttctgcctgatgtcgaaaccccatcagaagaagattgtatgtttggcaatggaaagggataccgtggaaaacgggccactacggtgactggaactccttgccaggattgggcagcacaggaaccccacaggcattcaatctttaccccagagactaatccgcgggcagggctcgagaagaactactgtagaaatcccgatggggatgttggaggtccatggtgctacaccaccaaccctcgtaagctgtacgactactgcgatgtgcctcagtgtgcagctcctagctttgattgtgggaagcctcaggtcgagcctaagaaatgtcctgggcgcgtggtcggtggctgcgtcgcgcatccgcattcctggccctggcaagtgtccctgagaactcgattcggtatgcacttctgcggaggaacgctgattagtcccgaatgggtactgactgcagcccactgcctggagaaatcacctaggccgagcagctacaaggtgatccttggggcccaccaagaggtgaatctggaacctcatgtccaagagatcgaagtcagcaggctgttcctggaacccacccggaaggatattgcgcttttgaagctgtcatccccggcagtgattacggataaggtgattccagcatgcctgccatcccctaattacgtggtggcagatcgcactgaatgcttcattaccgggtggggtgaaactcagggtacgttcggcgccggactgctcaaggaagcccagcttcctgtgatcgagaataaagtgtgcaacaggtacgaatttctgaacggccgcgtgcaatccaccgaactttgtgcaggacatctggccggaggtaccgattcatgtcagggtgatagcggaggaccgcttgtgtgcttcgaaaaagacaagtacatccttcagggggtaacgtcgtggggactgggatgtgcacggccaaataagccaggtgtctacgtccgggtcagcagatttgttacttggatcgagggagtgatgcggaacaat

SEQ ID NO: 250898 - DNA, 2430 bp, Artificial Sequence
  Description of Artificial Sequence: Synthetic coding sequence
atggagcacaaagaggtcgttctgctgttgttgctgttcttgaagagcggacagggggaacctttggacgattacgtcaacactcagggagcgagtctcttctcagtcacgaagaagcaactcggtgcgggcagcatcgaagagtgcgccgctaagtgtgaggaagatgaagagtttacttgtcgggcgttccagtatcactccaaagagcaacagtgcgtgatcatggcagagaacagaaagtcctccattatcattcggatgagagacgtcgtgttgtttgaaaagaaggtgtacctgtccgagtgtaagacgggcaacggaaagaattaccgcggtaccatgtctaagaccaagaacggaatcacctgccagaagtggtcgagcacttccccgcacaggccacggttctcaccggcgacgcacccatcggaagggctggaagagaattactgtcggaacccagacaatgatcctcaaggtccatggtgctacaccaccgacccggagaaacggtatgattattgcgacatcctggagtgcgaagaagaatgtatgcattgttcgggtgagaattacgacggtaaaatctcaaaaaccatgtccgggctcgagtgtcaggcttgggatagccagagcccgcatgcccacgggtacatcccatccaagttccctaataagaacctgaaaaagaactactgtagaaatccggaccgggaactgaggccatggtgcttcacgacggatcccaacaagagatgggaattgtgcgacattccacggtgtactactccgcccccatcatccggaccaacgtaccagtgtctcaaaggaaccggagagaattaccgtggcaacgtggcagtaaccgtgagcggccacacttgccagcactggtcggctcaaactccgcatacgcacaatcgcactccagagaatttcccgtgcaagaacctggatgagaactactgccgcaaccctgacggcaaacgggctccatggtgtcatacgacgaacagccaggtgcgctgggagtactgcaagatcccaagctgcgattcatccccagtctcaactgagcaactggccccgactgcgcccccagagttgactcccgttgtccaggactgctaccatggagatggccaatcgtaccgcggcacgtcgtccaccaccactactggaaagaagtgccagagctggagctcaatgaccccgcaccgacatcaaaagactcccgagaactacccgaacgccgggctcaccatgaactactgtcggaatccggacgcagataaaggcccgtggtgctttaccacggacccgtccgtcagatgggaatactgcaacctcaagaaatgctccgggaccgaagcgagcgtggtggcacctccgcccgtggtcctgctcccggacgtggaaaccccaagcgaagaggactgcatgttcggtaacggaaaggggtacagaggaaagcgggcaacgactgtgaccggaacgccgtgccaggactgggcggcgcaagagccgcatcggcattctatcttcaccccggagactaacccgcgcgccggcttggaaaagaattactgccggaatccagacggagacgtggggggaccgtggtgttacactaccaatccaaggaagttgtacgactactgcgatgttccgcagtgcgctgccccgagcttcgattgtggcaagccacaggtggaacccaagaagtgcccagggcgagtggtgggaggatgcgtcgcgcacccgcattcctggccgtggcaggtcagcctgcggaccaggttcggaatgcacttttgcggaggaaccctgatttcgccggaatgggtgctcactgccgcacactgtcttgaaaagtctcctcgcccgtcctcctataaagtgatcctgggcgctcaccaggaagtgaacctggagccacacgtgcaagagattgaagtctcacggctcttccttgagcccaccagaaaagacatcgctctccttaagctgtcaagcccagccgtgatcactgataaggttatcccagcttgcctgccgtcaccaaactacgtggtggctgacagaaccgagtgctttatcaccggttggggggaaacccaaggaaccttcggagccggactgctgaaggaggcccaactgccggtgatcgagaacaaagtgtgtaatagatatgaattcttgaacggccgcgtgcaatcgactgagctgtgcgccggccacttggcgggtggtaccgacagctgccagggagattccggcggacccctggtctgcttcgaaaaggacaaatacatcctgcaaggagtcactagctgggggctgggctgcgcacgccccaataaacctggagtgtatgtgagagtgtccaggtttgttacttggatcgaaggagtgatgcgcaacaat

SEQ ID NO: 250899 - DNA, 2430 bp, Artificial Sequence
  Description of Artificial Sequence: Synthetic coding sequence
atggaacataaagaagtggtgttgctccttctactgttcctcaaatcaggacagggagaacctctcgacgactatgtgaatacacagggagcgtccctgttctctgtcactaaaaaacaacttggagctggaagtatagaagagtgtgccgcaaaatgtgaagaggatgaagaattcacatgtcgcgccttccagtatcactccaaagagcagcagtgtgtgataatggcagaaaataggaaatcctctataataatacgaatgagggatgttgtgctcttcgaaaaaaaagtatacctgagtgagtgtaaaactgggaatggaaaaaactatcgcggaacaatgtctaaaacaaaaaatgggattacttgtcagaaatggtcatcaacttccccacatcggcccagattctctcccgctactcatccctcagaagggcttgaagaaaactattgcagaaaccccgataacgatcctcaagggccatggtgttatactacagatcccgagaaaaggtatgattattgtgatatcctagagtgcgaagaagaatgcatgcactgctctggggaaaactacgatggaaaaatttccaaaacaatgagtggattagaatgtcaggcttgggactcacagagtccccacgctcatggatatatccctagtaaattccctaataaaaacctgaaaaaaaattattgtcgcaatcccgatagggaactcaggccatggtgtttcactactgatcccaataaacgatgggaactctgcgatattccgcggtgtacaacacctcctccatcctccggaccaacataccagtgtctgaaaggaacaggggaaaactatcgcgggaacgtcgccgtgactgtatctggacatacttgtcagcattggtcagcccaaactccccatactcacaatagaacaccagaaaattttccttgtaaaaacctggatgaaaactattgccggaatcccgatgggaaaagagccccatggtgccacactactaactctcaggtgagatgggagtattgtaaaatcccttcctgcgatagttctcccgtgtccacagaacagctcgcccctacggctccacccgaacttacacctgtggtgcaggattgctatcacggggatggacaatcctatcggggaacttcgtcaactactacaacaggaaaaaagtgccagtcttggtctagtatgactccgcaccggcatcagaaaacaccagaaaactaccccaatgccggactgactatgaattattgcagaaatcccgatgctgataaaggaccctggtgtttcacaacagatccatctgtcaggtgggaatattgcaatctgaaaaaatgctccgggactgaggcatctgtcgtggcgccacctcctgtagttctcctgcccgatgttgaaactccaagtgaagaagattgcatgtttgggaatggaaaagggtataggggaaaaagagccactacagtgacaggaactccctgtcaggattgggcagcccaggaaccacaccgccattcaatatttactccagagacaaaccctcgcgctgggctagaaaaaaactactgcaggaatccagatggagatgtgggaggaccttggtgttatactacaaatccacgcaagctatatgattattgcgatgtgccccaatgtgctgccccctcattcgattgtggaaaaccacaggtagaacccaagaaatgccccgggcgggtggtgggggggtgtgtggctcatcctcactcctggccttggcaggtatccctccggacgcgcttcggaatgcacttttgtggagggactctcatctcaccagaatgggtccttacggcagcacactgtttagaaaaaagtcctaggccctcttcatacaaagtgattctgggggcacaccaggaggtgaatcttgagccccatgtgcaggaaatcgaagtatccagactgttcttggagcccactcgaaaggacattgcacttttaaagctttcctcacctgctgtcataacagataaagtgatacctgcttgcctcccctcacctaactatgttgttgcggataggacagagtgtttcatcactggatggggggaaacacagggaacattcggagccggattgctgaaagaagcccagttgcccgtaatcgaaaataaagtttgcaacagatatgaatttttgaacggaagggtgcagtctactgaactgtgcgcgggacatctggctggaggaacagattcgtgccagggggattccggggggcctctcgtgtgtttcgaaaaagacaaatatatactacagggagtaacaagttggggactcgggtgtgcccggcccaacaaaccaggggtgtacgtaagagtaagtaggttcgtgacttggatagaaggggtgatgagaaataac

SEQ ID NO: 250900 - DNA, 2430 bp, Artificial Sequence
  Description of Artificial Sequence: Synthetic coding sequence
atggagcataaagaagtcgtgctcctccttctgctgtttctgaagagcggtcagggagaacctcttgatgattatgtcaacactcagggggcatcattgttttcagtgaccaagaagcagctgggagccgggtccatcgaggaatgtgcagccaagtgtgaagaagatgaggaatttacgtgcagggcatttcaataccactccaaggaacagcaatgcgtgataatggcagagaaccggaagtcaagcatcatcatcagaatgagggatgttgttctgttcgaaaagaaggtgtacctttccgagtgcaagactggaaatggtaaaaactaccgcggaacgatgagcaagactaagaacggcattacttgtcaaaaatggtcatcgacttccccccatcgcccgcggttttcccctgctacccatccgagtgagggactggaagaaaactattgccggaaccctgataacgatccacaaggaccctggtgctacactacggatcccgagaagagatatgattattgcgacatactcgaatgcgaggaagaatgcatgcactgttcgggggaaaactatgacggaaagatttctaagaccatgtcgggtcttgagtgtcaggcatgggatagccagtcgccgcacgcccacggttacattccttcgaagtttccaaacaagaacttgaaaaagaattactgtagaaacccagatcgagaactgcggccatggtgcttcactaccgaccctaacaagagatgggaactttgcgacattcctagatgcactacccctcctccatccagcggcccaacttaccagtgtctgaaaggaaccggcgagaactacagaggtaacgtcgccgtgaccgtgtcgggacatacctgtcagcattggtcagctcaaacccctcacactcacaatcgaactcctgagaactttccatgtaagaatctcgacgagaactactgtaggaaccctgatggaaagagagccccttggtgccatactactaactctcaagtgagatgggaatactgtaagattccatcgtgtgattcgtcaccagtctccactgagcaacttgcaccaactgcgccaccagaacttactcctgtggtgcaggactgttaccacggagacggccagtcgtacagggggaccagctcaaccactaccaccggaaagaaatgtcaaagctggtcctcaatgaccccacacagacatcaaaaaaccccggagaactaccctaacgccggccttactatgaactattgcagaaatcccgacgcagataagggcccatggtgttttactactgaccctagcgtgagatgggagtattgcaatctcaagaagtgttcgggtaccgaagcatcggtggttgcacctcccccggttgttctcctgcctgacgtcgaaactccttcagaagaggattgtatgttcggtaatgggaagggatacagagggaagagggccaccactgtgacgggaaccccatgtcaagattgggccgcgcaagaaccccaccgtcactcaatctttacccccgaaaccaacccacgggcaggtcttgaaaagaactactgtcgcaaccccgacggggacgtggggggaccctggtgttacactactaacccacgcaaactctacgactactgcgatgtgccccaatgtgcagcaccctcattcgactgtggcaaaccacaagttgaacctaaaaagtgtcctggaagggtggtgggcgggtgcgtcgctcatccccactcctggccttggcaagtgagcctgaggacccgttttggcatgcacttttgtggaggtacccttatttctcctgaatgggtcctgactgccgcacattgcctggaaaagtctccacgacctagctcctacaaggtgattttgggagcacaccaggaagtcaaccttgaacctcatgttcaggaaattgaagtgtcacggctttttcttgagcctactcggaaagatattgctctgctgaaactttcctcgcctgccgtcattactgataaagtgatccctgcatgcctgccttcgccaaactacgtcgtggcagatagaactgagtgttttatcaccggatggggtgagactcaagggacgttcggagcggggctgctcaaggaggcacagctcccagtcatcgagaataaagtgtgcaaccgttacgagttccttaatggacgcgtgcaatccaccgagctttgtgcgggacatctggcaggtggtaccgattcatgtcagggagattcaggtggaccgcttgtgtgttttgaaaaggataagtatattctccagggagtaacttcatggggcttgggatgcgcaaggcctaataagcccggggtgtacgtgcgagtctcccgatttgtgacctggattgaaggagtcatgagaaacaac

SEQ ID NO: 250901 - DNA, 2430 bp, Artificial Sequence
  Description of Artificial Sequence: Synthetic coding sequence
atggagcacaaggaggtagtgctcctactgctcctgttcctcaagtcgggtcaaggtgagcccttagacgactatgtaaacacgcagggagcgagcctgttcagcgtgaccaagaagcagctcggcgcgggttctatcgaggagtgtgccgccaagtgtgaagaagatgaggagttcacatgtcgcgcctttcagtaccacagcaaggagcagcagtgcgtgatcatggccgagaaccgaaagagctccataattattcgtatgcgcgatgtcgtgcttttcgagaagaaagtctacctctcagaatgtaagacgggaaatggaaagaactaccgcgggaccatgtcgaagaccaaaaatggtatcacctgccagaagtggagctccaccagccctcaccgaccgcgcttcagtcctgccacccatccgtctgagggcttagaggaaaactactgccggaacccggacaacgatccccaggggccgtggtgttacaccaccgaccccgaaaaacgctacgattattgcgatatcctcgaatgtgaggaagagtgcatgcattgcagcggggagaactacgacggcaaaatctccaaaacgatgagtggtctcgaatgccaggcttgggattcccagtctccccacgctcacggctacatcccctctaaatttccgaacaaaaacctcaagaagaattactgccgtaaccccgatcgcgagcttcggccctggtgtttcaccactgaccccaacaagcgttgggagctctgtgacattccccggtgtaccactcctcccccgagttctggccccacttaccagtgcttgaaggggaccggggagaactaccgcggaaacgtcgcggtcactgttagcggccacacgtgtcagcattggtccgctcaaaccccgcatacgcacaatcgcaccccggaaaatttcccatgtaagaacctggatgagaactactgccggaatccggatggtaagcgtgcgccctggtgccacaccaccaatagccaggtacgttgggaatactgcaagatcccctcctgtgactctagtcccgttagtacggagcagctggcgcccacggctcccccggagctgacaccagtcgtccaggactgctaccacggagatggtcaatcttatcgcgggacctctagcaccacaactactggcaaaaagtgccaatcctggtcgtctatgacgcctcatcgacatcagaagactcctgagaattaccccaatgccggcctgaccatgaactactgtcgcaatcctgatgctgacaagggtccctggtgcttcacaactgatcctagtgtgcgttgggagtactgcaacctcaaaaagtgttccggaaccgaggcttccgtcgtcgcccctccacccgtcgttctgcttcctgatgtcgagacccctagtgaggaagattgcatgttcggcaacggtaagggctaccgtggcaagcgtgcgacgacggtcacgggcaccccatgtcaggactgggctgcgcaggagcctcaccggcattccatcttcacccctgagaccaaccccagagcgggtttggaaaagaattactgcaggaatcctgatggtgatgtgggcggcccgtggtgctatacgactaatccacggaagctctatgactattgtgatgtccctcagtgtgcagcaccatctttcgattgtggtaagcctcaagtggagcccaagaagtgccctggccgcgtcgtcggcggatgcgtcgcccacccccattcgtggccgtggcaggtgtcccttcgtacgagattcggtatgcacttttgcggcggaactctcatctctcccgagtgggttctaaccgccgctcattgtttggagaagtctccacgccccagttcctacaaggttattctcggtgcacaccaagaggtcaacctggaaccgcacgtccaggagatcgaggtgtctaggctcttcttggaacctacccggaaggatattgccctcctcaagctcagctccccggcggttattaccgataaagtcatcccagcctgccttccgtccccgaattatgtcgtcgcggatcggactgagtgctttatcaccggctggggcgagacccagggcaccttcggtgctggcctgctcaaggaggcccagcttcccgtaattgagaacaaggtctgtaaccgctatgaattcctcaatggcagggtgcaaagtactgagttgtgcgcaggtcacctggcaggtggaacagattcctgccagggcgactccggcggacctctcgtctgctttgagaaggataagtacatccttcagggtgtaacctcctggggtctgggttgcgccaggccaaacaagcccggcgtctacgttcgcgtgtcccggtttgtcacctggattgagggggttatgcgcaataac

SEQ ID NO: 250902 - DNA, 2430 bp, Artificial Sequence
  Description of Artificial Sequence: Synthetic coding sequence
atggaacataaagaagtggttctcctcctgctcctgtttctgaagtctggccaaggggagcccttggatgattatgttaatactcagggagcttcgctgttcagcgtgacaaaaaaacagctgggagccggctcaatcgaggaatgcgcggccaaatgcgaggaggatgaagaatttacgtgtcgcgcttttcagtatcactccaaggagcagcagtgtgtgatcatggccgagaatagaaagagttctatcattatccgaatgcgcgacgtagtgttgtttgaaaagaaggtctatctgtccgagtgcaagacggggaatgggaaaaattaccgaggcacaatgtcaaagactaagaacggaatcacctgtcagaaatggagtagtactagcccacacagaccgcgcttttccccagccacacacccttctgagggtctggaggagaactattgtagaaatccggacaatgacccgcagggtccgtggtgttacactaccgatcccgaaaagcgctacgactactgcgatattctggagtgtgaggaagagtgcatgcactgttccggtgaaaactacgatggcaagatctccaagacaatgagcggactggagtgccaggcctgggatagccagtctcctcatgctcatggctatatccctagcaagttccctaacaaaaatttaaaaaaaaactattgcagaaaccccgatcgggagctccggccatggtgcttcacaaccgatcccaacaagcggtgggagttgtgtgatattccgcgctgtacaactcctccacccagttctggccctacgtatcagtgtctgaaaggtacaggggagaactatcggggcaatgtagctgtgaccgtatcaggacatacttgtcaacattggtcggcccaaacacctcacactcacaataggacacccgaaaatttcccctgtaagaatctcgatgagaactattgtcgcaacccagatggaaaacgcgcaccttggtgccacacgacaaatagtcaggtgcggtgggagtactgtaagatcccgtcgtgcgattcctccccagtctctaccgagcagcttgcccctaccgccccgcctgagttaactcccgtagtgcaggactgttaccacggagacggccagtcttacaggggaacatcctccacaaccaccacaggcaaaaaatgtcaaagctggtcgtctatgaccccgcatagacaccagaaaacccccgaaaactaccctaacgctggtctgacaatgaattactgtaggaatccggatgcggacaaggggccttggtgctttaccaccgacccttcggttaggtgggagtactgtaacctcaaaaagtgttcaggaacagaagccagtgttgtggctccaccccccgtagttctgctgccagacgtagagaccccttccgaggaggattgtatgttcggcaatggtaaaggctatcgcggcaagcgggcaactaccgtcacaggaaccccttgccaggactgggccgcccaagagccacacaggcactccatcttcactccggagaccaatccacgagccggactcgaaaaaaactattgcaggaacccagacggggatgtcggcgggccctggtgctatactacaaatcctaggaagctgtatgattactgcgatgttcctcagtgtgccgctccttctttcgactgcggtaaacctcaggtggagcccaagaagtgtccaggtagagtcgtcggaggttgcgtggcgcacccccacagttggccctggcaggtgagcctcagaacccgattcggtatgcacttctgtggaggcaccctgatatcccccgagtgggttctgacagcggcccattgccttgaaaagtccccccggccctcgtcatacaaggtgattctgggtgctcaccaggaagtgaacttggagcctcacgtgcaggaaatcgaagtgagtaggctttttctggaaccaacccggaaggatattgccctcctgaaattaagttctccagcagttatcacagacaaggtgatacctgcctgcctgccttcacctaattacgtcgttgccgacagaaccgagtgtttcatcacagggtggggcgaaactcaggggacatttggggcagggctgctgaaagaagcacagctccctgtcatcgaaaataaggtttgcaatagatatgagtttctgaatggaagagtacagagtaccgaactctgcgccggccatctcgctgggggcacagacagttgtcagggtgatagcggcggacccctggtgtgttttgaaaaagacaaatacatcctgcaaggggtgacttcctggggcctgggatgcgctcgtccaaacaaaccgggtgtctacgtgagagtctccaggttcgtgacttggatcgagggtgtgatgcgcaataat

SEQ ID NO: 250903 - DNA, 2430 bp, Artificial Sequence
  Description of Artificial Sequence: Synthetic coding sequence
atggagcacaaggaagtcgtgctgcttcttcttctttttctcaagtccgggcaaggtgagcccctggatgattacgtgaacacgcagggcgcaagccttttttcggtgactaagaagcaactcggggccggttcgatagaagagtgcgcagctaagtgcgaagaagatgaggaattcacttgtagagcttttcaataccactcaaaggaacagcaatgcgtgattatggccgaaaatcgaaaatcctcgatcattatcagaatgagagatgtggtgctgtttgagaagaaggtctatctttcagaatgcaagacgggtaacggcaaaaactacaggggcactatgtcaaagactaagaacggaattacctgtcagaagtggagcagcaccagtccgcacaggccaaggttctcgccggcaacccatccgtccgaagggctcgaagaaaactactgtcgaaatccggataacgatccacagggtccgtggtgttacaccaccgacccggaaaagcgctacgattactgcgacattctggagtgtgaagaagaatgtatgcattgttcaggggagaattatgacggaaagatctctaaaaccatgtccggacttgagtgtcaagcatgggactcgcagtcccctcatgcgcatggctacatccctagcaagttccctaacaaaaaccttaagaaaaactactgcagaaacccggaccgggaattgcgtccttggtgttttaccaccgatccgaacaaacgctgggagctgtgtgatattcccaggtgtactacgcctcccccctcgtccggtcctacttatcaatgcctcaagggcaccggagaaaactaccgagggaacgtggccgtgaccgtctcaggtcatacttgtcaacattggtcggcacaaactccacatactcataatcgtactcccgaaaactttccctgcaaaaatctggatgagaactactgtagaaacccggatggaaaacgggccccttggtgtcacaccacgaactcacaagtgagatgggaatactgtaagattccttcctgcgattcctcaccagtctcaactgagcaactggcgcccaccgctccccctgagctgacgccagtggtccaagactgttaccacggcgacggtcaatcgtataggggaaccagctccactaccaccactggaaagaagtgtcagtcgtggtcgtccatgactccacatcgacatcagaaaactccggagaactaccctaatgccgggctgaccatgaactactgccgaaatcctgacgccgataaagggccttggtgcttcaccacggatccatcggttcggtgggagtactgcaaccttaagaagtgttcaggaaccgaagcatccgtcgtggcgcctcctccggtggtgctcctgccggatgtggaaaccccatctgaggaggactgcatgtttgggaatggaaagggatacaggggaaagcgcgcaactaccgtgactggaaccccttgccaggattgggcagcccaggaaccgcatagacactccattttcactccagaaacgaatcctcgagccgggttggagaagaactattgtcggaaccctgatggagacgtggggggaccatggtgttacactaccaatccgcggaagctgtacgactactgtgatgtcccacaatgcgcagctccatccttcgactgcggaaagcctcaagtggaacctaagaaatgtcctggaagagtcgtgggtgggtgtgtggcacacccacacagctggccttggcaggtatccctcagaacccgattcggtatgcacttctgtggaggcactcttatatcgcccgaatgggtgctgactgcagcacactgccttgaaaagtcgccgaggccaagcagctacaaggtgattcttggagctcatcaggaagtgaacctggagcctcatgtgcaggagatagaggtgtcaagactgtttttggagccaaccagaaaggatatcgcgctcctcaagctctcctcgcctgccgtgattactgataaagttattcccgcctgtctcccttcacctaattacgtggtggcggatagaaccgaatgctttatcaccggctggggggagactcaagggacttttggagcgggtctgcttaaagaagcacaactccccgtgattgagaataaggtctgtaatcgatacgagtttcttaacggtcgggtgcaatccacggagctgtgtgcaggacatctggcaggtggaaccgactcttgtcagggggattcagggggcccacttgtctgcttcgaaaaagacaagtacatacttcaaggtgtcacctcctggggcctgggctgtgcacgtccaaacaagcctggtgtgtacgtgcgagtctcaagatttgtgacgtggatcgaaggtgtgatgagaaacaac

SEQ ID NO: 250904 - DNA, 2430 bp, Artificial Sequence
  Description of Artificial Sequence: Synthetic coding sequence
atggaacataaggaggtcgttctcttactgctcttgtttctcaagagtgggcagggggagccactggatgactacgtcaatacccagggggcttctctgttcagcgtgactaagaagcaactgggagcagggagcattgaggaatgcgcggccaaatgcgaggaagatgaggagttcacttgtcgagccttccagtaccacagcaaagaacaacaatgcgtgatcatggcagagaaccggaagtcgagcatcatcataaggatgagggatgtagtactctttgaaaagaaggtgtatctgtccgagtgcaaaaccgggaacggcaagaattaccgcggtacaatgtcaaagacgaagaatggcatcacatgtcagaaatggtcctcaacctcgccccaccgtccccgtttttcacctgcaactcatccttccgaaggactagaagagaactattgtagaaatcccgataatgatccacaagggccgtggtgttatacaactgatcctgaaaagcgctacgactattgcgacatcctggagtgtgaagaggagtgtatgcactgctccggagaaaattatgacggaaaaatatccaagacaatgtccgggctggagtgccaggcttgggactcccaaagtccccacgctcacggctatatcccaagtaaatttccgaacaagaacttgaagaaaaattactgcaggaaccccgacagagaactgaggccctggtgtttcacaacagatcctaacaagaggtgggagctgtgcgacatccccagatgtaccacaccccctccatccagtgggcccacatatcaatgtttgaaagggaccggagaaaattatcgaggcaacgtggccgtaaccgtctcaggccatacatgccagcattggtccgcccagacgcctcacacccacaataggacacccgagaactttccatgcaagaacttggacgaaaactactgcaggaaccctgacggtaagcgtgccccttggtgtcacacaacgaattctcaggtccggtgggagtattgcaagataccttcctgcgacagttccccagtaagtacagaacagctggcacctaccgcgcctcccgagctcaccccagtcgtgcaggattgctaccacggagacggacaatcataccgcggtacgtcctcgaccacaaccactggaaaaaagtgccagtcatggagttccatgactccgcataggcatcagaagaccccggaaaactaccccaacgccggcctgactatgaattactgccgaaatccggacgcagacaaggggccgtggtgtttcaccactgatccaagcgtccgatgggaatattgtaacctgaaaaagtgttcgggcacggaggcttctgttgtagccccgccccccgtggtcctgctgcccgacgttgagaccccttcggaggaagattgtatgttcgggaacggcaagggctacaggggtaaacgggccaccactgtcaccgggactccttgtcaggattgggcagctcaggagcctcacagacattctatatttacacctgaaacgaatccaagagcagggctggaaaaaaactactgccgcaaccccgatggggacgttggaggaccatggtgctataccacaaatccccgaaagctatatgactattgtgacgttccacagtgtgctgccccaagctttgattgtggcaagcctcaagtggagccaaaaaagtgcccgggcagagttgtgggcggttgtgtggctcatccccatagctggccttggcaggtgagcctccgcacgcgatttggtatgcacttttgtggaggaaccctaatatcacccgagtgggtgctgaccgccgcccattgcctggaaaaatccccaagaccctcttcttacaaggtgattctgggggcacatcaggaggttaatctggaacctcacgttcaggagattgaagtgagtcggctattcctagagccaacccgcaaggacatcgcgctattaaaactatccagtccggctgttatcaccgacaaggtaatccctgcgtgcttgccaagcccaaattacgttgtagctgataggacagaatgcttcattacgggctggggcgaaacacaaggcacgttcggggcgggcttgctgaaagaggctcagctgcctgtcatcgaaaacaaagtgtgtaatagatacgaatttctcaacggacgcgtccagtccaccgagctgtgcgctggccatctcgcaggcggaacagatagttgtcaaggagactcagggggcccccttgtctgtttcgagaaggacaaatatatcttacagggagtgacgagctgggggctgggatgtgcccgtccaaacaagccaggcgtctacgttcgcgtgtctcggttcgtgacctggattgaaggggtgatgaggaacaat

SEQ ID NO: 250905 - DNA, 2430 bp, Artificial Sequence
  Description of Artificial Sequence: Synthetic coding sequence
atggaacataaagaagtggtgctgctgctgttactcttcctgaaatcagggcagggggagcccctggacgactatgttaatacacagggagcctcgctgttttctgtgaccaaaaaacagctaggggcggggtccatcgaggaatgcgcagccaaatgtgaggaggatgaagagttcacctgccgagccttccagtaccacagtaaggaacagcagtgcgtcatcatggcggaaaataggaaatcttctatcataatacgaatgagagatgtggtgctattcgaaaagaaggtgtacctgtcagagtgcaaaaccggcaatggaaagaactaccgcggcactatgtccaagaccaaaaatggcataacgtgccaaaagtggtcgagcaccagtcctcaccggccgcgcttctcacccgcgacacatccttctgagggattagaagagaattattgtaggaacccagacaatgatccccaggggccatggtgttacacaactgatcctgagaagaggtatgattactgcgacatcctagagtgtgaggaagagtgtatgcactgctctggagagaattacgatgggaagatttcaaagacaatgagtggcctcgaatgccaggcttgggactcacagagcccacatgctcatgggtatatcccttcgaagttcccaaacaagaacctgaagaagaattattgcaggaaccctgacagggagctgcggccgtggtgctttaccacagatccaaacaaacgatgggaactgtgcgatattccccggtgcaccacaccacctccaagctcaggccctacctatcagtgcctcaaaggaactggcgagaactaccgcggaaacgtggcggtcaccgtctccggccacacatgtcagcattggtccgcgcagactccgcacacccataaccgaaccccagagaattttccctgcaagaacctagacgagaattattgcaggaaccccgacgggaagcgggccccttggtgccacaccaccaactcccaggtgcggtgggagtactgtaagatcccgagctgcgatagttctcccgtgtctaccgagcagctggcaccaacggctccgcccgaactgacacccgtggtgcaagattgctaccacggggatggccagtcataccgggggacctcgtcaactaccactacaggaaaaaagtgccagtcttggtcgtcaatgactccccatcgccatcagaaaactccagaaaattatcctaacgccggactgaccatgaattattgtcgcaatcctgacgccgacaagggtccatggtgctttaccacggatccctccgtacggtgggagtactgtaacctgaaaaaatgctcaggcaccgaagcttcagtcgtcgctcccccacccgtcgtactactgccagacgtggagactccgagcgaggaggattgtatgttcggcaatgggaagggatatcggggcaaaagagcgactaccgtaactggcacaccttgccaggattgggctgcccaggagccacatcgacactccattttcacacccgaaaccaatccgagggcagggttggagaagaattactgtaggaaccctgacggggatgtgggaggaccttggtgctacaccactaaccccaggaaactatatgactattgtgatgtgccacaatgtgccgctccgtcattcgattgtggaaagccccaggtagagcccaagaagtgtccaggaagggtagtgggaggctgtgtcgcacatccacactcctggccctggcaggtaagcctcaggaccagattcggcatgcacttctgtggggggacacttatcagtcctgaatgggtattaactgccgcccactgtcttgagaaatcaccgaggccgtcttcctataaggttatcctcggtgcgcatcaagaggtgaacctcgagccccacgtccaagaaatcgaggtctctagactatttctggaacctactcgaaaggacatcgccctcctgaaactgtcctccccagccgtcattacagacaaggtcatacccgcgtgtctaccctcccctaattatgtggtggcagacaggaccgagtgcttcatcacggggtggggcgaaacacaaggcactttcggagcgggactactcaaagaagcccagcttccagtgatcgagaataaagtctgtaatcgttacgaattcttgaatggaagggtgcagagcaccgaactctgtgccggccacttagcaggcggcaccgactcatgccagggggacagcgggggccccctggtgtgttttgaaaaggacaagtacattttgcagggggtgacctcctggggcctaggatgtgctagacctaacaaacctggcgtttacgtgcgggtgtcaagattcgttacatggattgaaggcgtgatgcgtaacaac

SEQ ID NO: 250906 - DNA, 2430 bp, Artificial Sequence
  Description of Artificial Sequence: Synthetic coding sequence
atggagcataaggaggtcgtcttgctcctgctcctgttcctgaagtcgggacagggagaaccactggacgactacgtcaacactcagggggcaagcctgttctcggtcaccaaaaagcagctcggcgcaggatcgatcgaggaatgcgctgcaaaatgtgaagaggacgaagagttcacctgcagggcctttcagtatcactcgaaggaacaacaatgcgtgatcatggccgaaaaccgcaagtccagcatcatcattcggatgcgggacgttgtgctctttgaaaagaaggtgtaccttagcgaatgcaaaaccggaaatggaaagaattaccggggcactatgagcaagaccaagaatggcatcacttgccagaaatggtcgtcgaccagccctcacagaccccggttcagcccggctacccatccgtcggagggattggaagaaaactactgccgcaacccagataacgacccgcaagggccgtggtgctacacgacggacccggaaaaaagatatgattactgcgatatactggagtgcgaagaggaatgtatgcactgttccggggagaactacgacggaaagatcagcaagacgatgagcggactggaatgtcaagcctgggactcccagtccccgcacgcacatggttacatcccttcgaaattccccaataagaatctgaagaagaattactgccgtaacccggatcgcgaactgcgcccgtggtgcttcacgaccgatccgaacaagagatgggagctttgcgatattccacggtgcacgacccctccgccatcctccggaccgacctaccaatgcctcaagggaacgggtgagaactatcgtggaaatgtggctgtgactgtgtccggtcacacgtgccagcattggagtgcacagactcctcatactcacaacaggaccccggaaaacttcccttgcaaaaacctggacgaaaactattgcagaaatcccgacggaaagagagcgccatggtgccataccaccaattcgcaggtgaggtgggagtactgtaagatcccatcatgtgactccagcccagtgtccaccgagcagctggcgccaaccgcccctccagaattgacgcccgtggtccaggactgctaccacggagacggccaaagttacagaggaacctcatcaactaccaccactggaaaaaagtgccagtcgtggagctcgatgactccacatcgacaccaaaagactccagaaaactacccgaatgctggactgacgatgaactactgccggaatcctgatgccgacaaaggaccctggtgtttcactacggatccgtctgtcagatgggaatactgcaatctgaaaaagtgctcaggcactgaggctagcgtcgtggctcctccgccggtggtgctgctcccggatgtggaaactccatcagaggaggattgtatgtttgggaacggaaaggggtaccgcggaaagcgcgctaccactgtgaccggaactccctgccaagactgggcggcccaggaaccacaccgccactccatctttaccccagaaactaacccccgggcaggcctggagaagaactactgcagaaacccggacggtgatgtcggaggtccctggtgttacaccactaatcctcggaagctgtacgattattgcgacgtcccgcagtgcgccgcaccctcatttgattgcggcaagccacaagtcgaaccgaagaagtgcccgggtagagtggtcggcggctgtgttgcacacccgcattcatggccttggcaagtttccctcagaacccggttcgggatgcatttctgcggcggaactttgatatcaccggagtgggtcctgactgctgcgcactgtctcgaaaagagcccacgcccgagcagttacaaggtgattctcggggctcaccaggaggtgaacctggaaccacacgtccaagagattgaagtgtcccgcctcttccttgaacccacccgcaaagatatcgcccttctgaaactgtcctcccctgccgtgatcactgacaaagtgatccctgcatgtctgccgtccccaaattacgtggtggctgaccgcactgagtgtttcatcactggatggggagagacgcaggggacctttggagccggtcttttgaaggaggcacagctccccgtgatcgaaaacaaggtctgcaaccgctacgaattcctcaacggaagggtgcagtcgaccgaactgtgtgccggccaccttgcaggagggaccgactcctgccaaggcgactcgggcggaccgcttgtgtgcttcgagaaggacaaatacatccttcagggggtgacctcctggggactggggtgcgcacgtcccaacaaaccaggggtctacgtgcgggtgagccggttcgtaacttggatcgagggcgtcatgaggaacaac

SEQ ID NO: 250907 - DNA, 2430 bp, Artificial Sequence
  Description of Artificial Sequence: Synthetic coding sequence
atggaacacaaagaagtggtgcttctgctgctgctgtttctgaaatcaggccaaggagagccattggatgactacgttaacacccagggggcctcactcttttcggtgactaaaaagcagctgggcgccgggtcgatcgaagaatgtgcggctaaatgtgaagaagatgaagaatttacctgtcgcgctttccaataccattctaaggaacagcagtgcgtgattatggcagaaaacagaaaatcatcgatcatcattagaatgcgggatgtcgtcctttttgagaaaaaggtgtacctgtccgaatgtaagactggaaacggaaagaactacaggggaacgatgtccaagactaagaacgggataacttgccaaaagtggtcctcaaccagcccccatcgacccaggttctccccagcaacccacccctcggaaggactcgaggaaaactactgtaggaacccagataacgatccacaaggcccctggtgttacaccaccgatccggaaaaaaggtacgactattgtgacatcctggagtgcgaagaagaatgcatgcactgttcaggagaaaactatgacggaaaaatctcaaagactatgtcaggacttgagtgtcaagcctgggacagccagtcgccacatgcacatggttatatcccgagcaagttccccaacaagaatctgaagaagaactactgccgaaatccagatagagaacttcgcccctggtgcttcaccactgatccaaacaagagatgggagctttgcgatattcctagatgtactactccacctcctagcagcggacccacttatcaatgtctgaagggaactggtgaaaactacagaggaaatgtggcagtcacggtgtcgggtcatacctgtcagcattggtcagcacaaactcctcatacccataacagaaccccggaaaactttccttgcaaaaacctggacgagaattactgtagaaatcctgatgggaagagagcaccttggtgccatacgacgaactcgcaagtgcgctgggaatactgcaagatcccgtcgtgtgatagctcacctgtgtcaaccgagcagctggcaccaactgctcctcccgagcttactcctgtcgtccaggattgctaccacggtgatggacagagctaccgggggaccagctcgaccaccaccaccgggaagaagtgtcaatcgtggtcctctatgacccctcaccggcaccaaaagaccccagaaaactacccaaatgccggcttgactatgaattactgtcggaatcctgatgccgacaaaggaccttggtgctttaccaccgatcctagcgtccggtgggagtactgtaaccttaagaagtgttcaggaactgaagcatcggtggtggcaccgcctccagtcgtgttgcttccagatgtcgaaaccccttccgaagaagattgtatgtttggtaatggtaaaggttaccggggaaaacgagcaacgaccgtgactggtaccccgtgccaagactgggccgcacaggagccacaccggcattccatcttcacccccgaaaccaacccacgtgcaggtctggagaagaactattgtcgcaacccggacggggacgtgggaggaccctggtgctacactactaacccaagaaagttgtacgattactgtgatgtcccacaatgcgcagcaccctcctttgattgtggcaagccacaagtggaacctaaaaagtgccccggacgggtggtgggaggatgtgtggcccatccccattcttggccttggcaggtgagcttgcggactcgttttggaatgcacttttgcggcgggaccctgatttcaccagagtgggtgcttacggcagcacactgtcttgagaagtcaccgcggccgtcatcctacaaggtgatccttggtgcacaccaagaggtcaacctcgaaccacatgtgcaggagattgaggtgtcgcgtctgttccttgaaccaacccgtaaggatatcgcactgctgaagctcagctccccagccgtcattaccgataaagttattccggcatgcctgccttcgccaaactacgtcgtggcggaccgtaccgagtgtttcatcactgggtggggtgaaacccagggtactttcggtgccggccttctcaaagaggcgcaactgcccgtgattgagaacaaagtgtgcaatcgctacgaattcctcaacggacgtgtccagtcaactgagctgtgtgcggggcatcttgctgggggaaccgattcctgtcagggagactccggtggaccactcgtttgctttgaaaaagataagtacatccttcaaggcgttacgtcatggggcctcggttgtgcccgccctaataagcctggtgtttatgtgagggtgtcaaggttcgtgacctggattgaaggtgtcatgagaaataac

SEQ ID NO: 250908 - DNA, 2430 bp, Artificial Sequence
  Description of Artificial Sequence: Synthetic coding sequence
atggagcacaaagaagtcgtgctgctcctgcttctgtttcttaaaagcggacagggagaaccgctggacgactacgtgaacactcagggggcatcgctgttttcagtgaccaagaagcagctgggcgcaggttcgattgaggaatgtgccgcgaagtgtgaagaggacgaagaattcacctgccgggccttccaataccattcaaaggaacaacagtgcgtcatcatggcggaaaacaggaagtcctccataatcatcagaatgagagacgtcgtgcttttcgagaaaaaagtgtacctgtccgagtgcaaaaccggaaacggtaagaattacaggggaacgatgtccaagactaagaacggaatcacgtgtcagaaatggagcagcacttcgccgcaccgcccgcggttctcgccggccactcatccatccgagggtttggaggagaactactgccgcaatccagataacgacccccagggtccctggtgctatactactgacccggaaaagagatacgattactgcgacatattggaatgtgaagaagaatgtatgcattgctcgggcgagaactatgacggcaaaatctcaaagactatgtcgggactcgagtgccaggcttgggattctcagtccccacatgcgcacggatacatcccaagcaagttccccaacaagaatctcaagaagaactattgtcgtaacccggaccgcgagcttagaccctggtgttttactaccgacccgaacaagcgttgggaactgtgcgacatcccgcggtgcactactcctcccccgtcgtccggaccgacttaccagtgcttgaaaggaactggagagaattatcgcggaaacgtggcagtgactgtgtcaggacatacctgccaacactggtcagcgcagacccctcatacccataacaggactcctgagaacttcccttgtaagaacctcgatgagaattactgccgaaatccagatggaaaacgggccccttggtgccacaccaccaactcccaagtcaggtgggaatactgcaagattccgagctgcgattcgtcgccagtctccaccgagcagctggcgccaaccgcaccaccggaactgaccccggtggtccaggactgctaccacggggacggacaatcgtataggggcacctccagcaccactacgactggaaaaaagtgccaatcgtggtccagcatgactccacacaggcaccaaaagaccccggaaaactacccgaacgccggcctcacgatgaactactgcaggaatccggacgcggataagggcccgtggtgcttcacgaccgaccccagcgtgagatgggagtactgcaatcttaagaagtgtagcggtaccgaagcctcggtggtggccccgccgccggtggtgcttctccccgatgtggaaacgccgagtgaagaggactgcatgtttgggaacggaaagggataccgcggcaagcgcgccacgaccgtcaccgggactccatgtcaggactgggctgcgcaagaaccccaccgccacagcattttcactccggaaactaatcctcgagcgggcctggaaaagaattactgcaggaacccggacggagatgtgggcggaccctggtgctacaccaccaatcctagaaagctgtatgactactgcgatgtccctcagtgcgcggcgccatctttcgattgtgggaaaccacaggtggagcctaagaaatgcccgggaagggtggtcggaggctgcgtcgcccatccgcactcgtggccatggcaggtgtcgctgagaacgcgtttcggcatgcacttctgcggcggcaccctgatctcgcctgagtgggtcctgactgcggctcattgtttggagaagtcacctagaccgagcagctacaaggtcatcctgggggcccaccaggaagtgaatttggaacctcatgtccaagaaatcgaggtgtcgcggttgtttcttgaaccaacccgcaaagatatcgctctcctgaaactctcctccccggctgttatcactgataaggtgatccccgcatgcctgccatccccaaactacgtggtggccgatcgcactgaatgctttatcactgggtggggggaaacccaaggaactttcggagccggattgctgaaggaggcgcagctgcctgtgatcgagaataaggtgtgtaaccgctacgaattcctcaatggtagagtgcagtccactgaactgtgtgcgggccacctggcgggagggaccgactcgtgtcaaggagattccggaggacctctggtatgtttcgagaaagataagtacatactgcaaggcgtgactagctggggcctcgggtgcgctcgcccgaacaagcctggggtgtacgtccgggtgtcgcgcttcgtgacttggatcgagggcgtgatgagaaataac

SEQ ID NO: 250909 - DNA, 2430 bp, Artificial Sequence
  Description of Artificial Sequence: Synthetic coding sequence
atggagcataaggaggtggttctgctgctcctcctgttcctgaagagcggacaaggagaaccgctggacgactacgtcaacacccagggagcttcgctgttcagcgtcactaagaagcagcttggagcgggaagcatcgaagagtgcgctgcaaaatgtgaggaggacgaagagttcacgtgccgagccttccagtaccacagcaaagaacaacagtgcgtgatcatggccgaaaataggaagtcctcaatcatcattagaatgcgggacgtcgtgttgttcgaaaagaaggtgtacctctccgagtgcaaaaccggaaacggcaagaattacagaggaaccatgtcgaaaactaagaacggaatcacctgccagaagtggtcctcgacgtccccacaccgaccacggttctcgccagccactcacccgtcagagggactggaggagaactactgtcggaaccctgataacgacccgcagggcccgtggtgctacactaccgatccagagaagaggtacgactactgcgacatcctcgaatgtgaagaagaatgtatgcactgctcgggggaaaactatgacggaaagattagcaagaccatgtccgggttggaatgccaggcgtgggattcgcagtcccctcacgcgcatggatacatcccatcgaaattccccaataagaacctcaagaagaattattgccgtaatcctgaccgggaactcagaccttggtgcttcacgactgatcctaacaaaagatgggaactgtgcgacattccgcgctgtactaccccaccgccgtcatccggacccacctaccaatgccttaagggcactggtgagaactacagagggaacgtggctgttaccgtgagcggacatacctgccagcactggtccgcccagactccgcacacccacaaccggaccccagagaattttccgtgcaagaatctcgacgaaaactactgcagaaatccagatggcaagcgcgcgccgtggtgccatactactaacagccaagtgcggtgggaatactgtaaaatcccgagctgcgattcgtctccggtcagtaccgagcagctggcgccaaccgctccgccggagcttactccggtggtacaggactgctaccacggagatggccagtcgtaccgcgggacctcatcgaccaccactactggaaaaaagtgccagtcatggtcctccatgacccctcatcggcaccaaaagaccccagaaaattacccgaacgcaggcctgaccatgaactattgccggaatcctgacgccgacaaaggaccgtggtgttttaccaccgacccatccgtgagatgggagtactgtaacctgaagaagtgctcgggtactgaagcctcagtggttgcgccacccccagtggtgctgctcccagatgtcgaaactccatcagaggaagattgcatgttcggcaacggaaaaggctacagggggaagagggcaactaccgtgacgggtacgccgtgccaggattgggctgcccaagagccgcaccgccattccatctttacgccggagactaatcctcgggccggtctggaaaagaattactgcaggaacccggacggcgacgtcgggggtccctggtgttacaccactaacccccgcaagttgtacgactattgcgacgtgcctcaatgtgcagccccatcgttcgattgcggaaagcctcaggtggaaccgaagaagtgtcccggacgcgtggtgggaggttgcgtggcgcatccccacagctggccctggcaagtgtccctgcggacgcgctttgggatgcacttctgtggcggaactctgatctcgccggagtgggtgctcactgcagcccattgccttgagaaaagcccccgcccgtccagctacaaagtgatccttggagcccatcaggaagtcaatctcgaacctcacgtccaagaaatcgaagtgtcgcgtctctttctggaaccgaccagaaaggacatcgcactgctcaagctgtctagtcctgccgtcatcaccgacaaggtcattccggcctgtctcccgagccctaactacgtggtcgccgaccggactgagtgcttcatcactggatggggcgaaacccaaggcactttcggagcgggcttgctgaaagaggcccaactgcctgtgatagaaaacaaggtgtgcaaccggtacgaatttctgaatggccgcgtgcagtcgaccgagctgtgtgcaggtcatctggctggagggaccgattcctgccagggcgattcaggtggaccactggtctgcttcgagaaagataaatacatcctccagggagtgacctcatggggattgggatgcgcgcgcccgaataagccgggggtctacgtgcgcgtctcacgcttcgtgacttggatcgaaggcgtgatgcgcaacaac

SEQ ID NO: 250910 - DNA, 2430 bp, Artificial Sequence
  Description of Artificial Sequence: Synthetic coding sequence
atggaacataaggaggttgttttactgctgcttttgttcctgaaaagcggccaaggagagccattagacgactatgtgaacacacagggcgcgagcctgttcagtgtcacgaagaaacaactgggggccgggtctatcgaggaatgcgccgcaaagtgcgaggaagacgaagaattcacatgtcgcgcctttcagtaccactctaaagagcaacagtgtgtgatcatggccgagaacagaaagagcagtatcatcatcagaatgagggacgtggtcctctttgaaaaaaaggtttatctgtccgaatgtaaaaccggaaatggcaaaaattacagaggcactatgagtaagacgaagaacgggattacctgccaaaaatggagctctacaagcccacaccggccgcggtttagtcccgcaacccacccatcggaaggactcgaggaaaactactgcagaaatcccgataacgatccacagggcccctggtgctatactacagaccccgagaagaggtatgactattgtgatatcctcgagtgtgaggaggaatgcatgcactgttccggtgagaattatgacggtaagatcagtaaaactatgtcaggactggaatgccaggcctgggattcacagtctccgcatgctcacgggtacattccatccaagttccccaataagaatctaaagaaaaattattgtcgcaaccctgatcgcgagctgaggccatggtgttttactaccgaccccaacaaaaggtgggaactttgcgatatacctagatgcacaactccccccccatccagcggaccaacctaccagtgtctgaaagggacaggtgaaaactaccgaggcaatgtcgcagtgaccgtttccggacacacatgccagcattggtcagcccaaaccccccacacccacaatcgaacccccgagaatttcccatgtaagaacctggatgaaaattactgcagaaaccccgatggaaaaagagcaccctggtgccatactactaacagtcaggtgcggtgggaatactgcaagatcccgtcctgtgattcaagccccgtcagcacagaacaactggcacccaccgcacctccggaactgacacccgtagttcaggattgctatcacggtgacggccagtcctaccgtgggacctcttcaactacgaccacaggaaagaaatgccagagctggtcttcaatgaccccccacaggcatcagaaaacccctgagaattaccccaacgcaggcctaacaatgaactactgccgcaatcctgacgcagataagggcccctggtgctttaccacggatcccagcgtccgatgggagtattgcaatctcaaaaagtgtagcggaactgaggcttctgtggttgctcctcctccggtcgttctgctgcccgatgtcgaaacaccatccgaagaagactgcatgtttggcaacgggaaagggtatcgcggcaagagagctacaaccgttaccggaactccgtgccaggactgggccgcacaggagccacataggcactcgattttcaccccagaaaccaatccaagagctggtctcgagaaaaactactgtcgtaatccagatggggacgtaggaggtccctggtgttatacaacaaaccctagaaagctgtatgattactgcgatgtgccccaatgtgctgctccgtccttcgactgtggaaaaccacaagtcgaacccaagaaatgtcctggtagggtcgtgggggggtgcgtggcacaccctcactcttggccctggcaggtgagtttgcgcacccgcttcggcatgcacttctgtgggggaacactgatcagcccggaatgggtactgaccgccgcgcactgccttgaaaagagtccccgaccttcctcttacaaagttattctcggggcccaccaggaggtgaatctggagcctcacgtccaggagatcgaagtcagcagactttttctagaaccaacgcggaaggatatcgccctgctgaaactcagctcccccgctgtcatcaccgataaggtgattcctgcatgcctcccttccccaaattacgtcgttgcagatcggactgagtgttttattaccggctggggagagactcaagggaccttcggcgctggactgttaaaggaagcacagctaccagttattgagaataaagtgtgcaatcggtatgaattccttaatggacgtgtccagagcacagagctatgcgccgggcatcttgccggcggtactgatagctgccagggggatagcgggggccctctggtgtgtttcgaaaaggataaatatattctgcagggcgtcacgtcttggggcctcggatgcgcaaggcctaacaaaccaggggtctatgtgcgagtgagccgcttcgtgacttggattgaaggagtcatgagaaataat

SEQ ID NO: 250911 - DNA, 2430 bp, Artificial Sequence
  Description of Artificial Sequence: Synthetic coding sequence
atggaacacaaagaggtggtacttctgctcctgctgtttcttaagtcgggccaaggagaacctctggatgactacgtgaacactcagggcgcaagtctattttccgtgaccaaaaagcagctgggtgccggtagcattgaggagtgtgcagccaagtgtgaagaggacgaggagtttacatgtcgagccttccagtatcatagcaaggagcagcagtgcgttattatggcagagaatcgaaaatcttcaattatcatacgcatgagagatgtcgtccttttcgaaaaaaaagtgtacttgagcgagtgtaaaacaggtaatggcaaaaattatcgcggaactatgagcaaaactaagaacggtattacttgccagaagtggtcatctacaagcccacacaggcctagattctccccagccactcacccgagtgagggcctcgaggaaaattactgtaggaacccggataacgaccctcaagggccatggtgttatacaactgacccagagaaacgatacgactattgcgacattttggaatgcgaggaagaatgcatgcactgttcaggggagaactacgatgggaaaatttcaaaaaccatgagtggcctggaatgtcaggcttgggattcacaatcgccgcacgctcacggttatatacctagcaaattcccaaataagaacctaaagaagaattactgtcggaatcccgaccgggagcttcgcccttggtgtttcacaaccgatccaaacaagaggtgggaactatgtgacattccaaggtgtacaactccaccaccaagctctggacccacctatcagtgccttaaaggtacaggggagaattatagaggaaacgtagctgttaccgtctccggacacacttgccagcactggagcgcacagacgccccatacgcataacaggacccccgagaacttcccttgtaaaaatctggacgaaaattactgtcggaaccctgacggcaagcgggccccgtggtgccacacaacaaactcacaggttagatgggagtattgtaagatccccagctgtgattcctcacccgtgtccacagagcagctggcgccaaccgcgcccccagagctgacccctgtggtccaagactgttaccatggagacgggcagtcttacagggggaccagcagcaccactaccacaggaaagaagtgccaatcttggtcctctatgacgccacatcggcatcagaagacacccgaaaattatccaaatgcaggcctgaccatgaattactgtagaaaccccgacgcagataaggggccttggtgcttcactaccgatccgtctgtcagatgggaatactgcaatctgaaaaagtgtagtggcacagaagcgagcgttgtggcaccccctccagttgtactgctgcccgatgtggagacccccagcgaggaagactgtatgttcgggaatggcaaagggtatcgaggcaaaagagccactacggtgaccggcacaccatgccaagattgggccgcgcaggaaccccaccggcactcaatcttcacgcctgagactaacccaagggcaggtctggaaaagaattattgccggaacccagatggagacgtcggagggccttggtgttatacgacaaatccccggaagctgtatgactactgcgacgttccccagtgtgcggctccttcattcgactgcggtaagcctcaggtggagcctaagaagtgtcctggcagagtagtaggcggctgtgttgctcatccccacagctggccatggcaagtcagcctacgtactcgcttcgggatgcatttttgcgggggcacactcattagtcctgagtgggttctgacagctgcacattgcctcgagaaatcaccacggccaagttcctacaaggtgatccttggcgcacaccaggaagtcaatctggagcctcatgtacaagaaatcgaggtttcaaggctattcttggagcctactcggaaggatatcgcactgctgaagttgagctcccccgctgtgatcacagataaggtgatcccagcttgccttccgagcccaaactacgtggtggcagatcggacagagtgttttattactggatggggagaaacccaaggaaccttcggcgcggggttattgaaggaagcccagttgccggtgatcgaaaacaaggtctgcaatagatatgagtttctgaacggacgggtccagtcaaccgagctgtgtgcaggtcacctcgcaggcggaaccgattcctgccagggtgactccggtggcccactagtatgctttgaaaaggataagtacattctgcagggggtgacatcctggggcttaggctgcgcccgccctaataagccaggggtgtacgtcagggtcagccgcttcgtgacgtggattgaaggtgtgatgaggaataac

SEQ ID NO: 250912 - DNA, 2430 bp, Artificial Sequence
  Description of Artificial Sequence: Synthetic coding sequence
atggagcacaaagaggtggtgctcctactccttctattcctaaaatcaggacagggggagccccttgacgattacgtcaatacacagggagcatcattattctcagtgacaaaaaaacagctaggagctgggtccatcgaagagtgtgctgccaaatgtgaagaagatgaagagttcacatgcagggcattccagtatcatagtaaggaacagcagtgcgtcataatggcagaaaaccgcaaatcttctattatcatccggatgagagatgtagtactctttgaaaaaaaggtttatctctctgaatgtaaaactggaaatggaaaaaactatcgggggacaatgtctaagacaaagaacgggatcacatgccaaaaatggtcatcaacatccccacatcggccacgattcagtcctgccacacacccatctgaaggattagaagaaaactactgccgaaatccagataatgaccctcaggggccatggtgttatacaacagatccagaaaaaagatatgattattgcgatattctggaatgcgaggaagaatgtatgcattgttctggggaaaactacgatgggaagatctctaaaacaatgtcagggctcgaatgccaggcctgggatagtcagtctccacacgcccacggatatattccttctaaattccctaataaaaatctgaagaagaactattgtagaaacccagatagggaattacgaccttggtgtttcacaactgatcctaacaaaaggtgggaactatgtgatatccccaggtgcactactccacccccttcttccgggcccacataccagtgtctaaaagggacaggagaaaattatagaggaaacgtcgcggtgactgtctctgggcatacatgccagcactggagtgctcagactccccatacacataatagaactcccgaaaattttccatgtaagaacctagatgaaaattattgccggaatcccgatgggaaaagggctccttggtgccatacaactaactcccaggtcaggtgggaatattgcaaaattccatcttgtgattcatctccagtgagtactgaacagttagcacccactgctcctcccgagctaactcctgtggtacaagattgttatcacggagatgggcagagttataggggaacttcttctacgactactacagggaaaaaatgtcagtcttggtcctccatgacaccacataggcaccagaaaacacccgagaactaccctaacgctggactaactatgaactactgccgcaaccctgatgccgataagggaccatggtgctttacaacagatccttctgtccggtgggagtattgtaatctcaaaaaatgcagtgggacagaagccagtgtggttgcaccccccccagtggttcttctacccgatgtcgaaactccaagtgaagaggactgtatgttcgggaatggaaaaggatataggggaaaacgagccacaacagtcactgggactccctgccaggattgggctgcacaggaaccccatcgacacagtatcttcactccagaaacaaacccccgggcaggacttgaaaaaaactattgtcgcaatcccgatggagatgttggaggaccatggtgttacacaacaaaccctagaaaattatatgattattgtgatgtgcctcagtgcgcagctccatccttcgattgtgggaaacctcaggtggaaccaaagaaatgtcctggaagagtagtcggaggatgcgtagcccacccccactcatggccatggcaggtctcgctcaggactagattcgggatgcatttttgtgggggaactctgatttcacctgaatgggtccttactgctgcacactgtctggaaaaatccccaaggccctccagttacaaggtgatcctaggggcccatcaggaagtaaatttagaaccacacgtccaggaaatcgaagtgtcacgcctgttcctagagcctactcgaaaagatatagccctcctgaaattgtcctcgccagctgtcatcacagacaaagtgatacccgcttgtttgccctccccaaactacgtcgtggccgatcggacagaatgctttatcacaggatggggagaaactcaggggacatttggagcagggctgctcaaagaggcacagttacctgtgatcgaaaacaaggtctgcaacaggtatgaattcctaaacgggagagtgcagtctactgaactctgtgcagggcacctggcgggagggactgattcttgtcaaggagattctggggggccactcgtctgtttcgagaaagataaatatatcttgcaaggagttacttcttggggattgggatgtgctcggcctaataaaccaggggtttatgtccgcgtatctcggtttgttacttggatagaaggggtaatgcgcaataac

SEQ ID NO: 250913 - DNA, 2430 bp, Artificial Sequence
  Description of Artificial Sequence: Synthetic coding sequence
atggagcacaaggaagtggtgcttctcctgctattgtttctgaagagcggccagggagaacctctcgatgactacgttaacacacagggagcttctctgttttcggtcacaaaaaagcagctgggagcgggttctatcgaggaatgcgcagcaaaatgtgaggaggatgaggaatttacctgcagggccttccaatatcactcaaaggaacaacaatgcgtgattatggctgagaatagaaagagctcaatcatcatcagaatgcgtgacgttgtgctatttgaaaaaaaggtgtacctgtctgagtgcaaaacagggaacggcaagaactacagaggaactatgagcaaaaccaagaacgggattacttgtcagaagtggtcatcaacctctccgcacagaccaaggtttagtcctgccacccacccttctgaaggactcgaggagaactattgtcggaatccagacaacgatccgcagggaccctggtgttatacaaccgatccagagaagcgctatgattactgtgacattctggagtgtgaggaggagtgcatgcattgcagcggtgagaattatgatgggaaaattagtaaaactatgtcagggctggagtgtcaagcttgggacagccagagcccacacgcccatgggtacataccttcaaaattcccgaacaaaaacctgaagaaaaattattgcaggaacccagacagggaattgagaccttggtgctttacaaccgaccccaacaaacgatgggagctgtgtgacatcccccgctgcacaacaccaccgccttctagtggaccgacataccaatgcttgaaagggacaggcgaaaactacaggggcaacgttgctgtcactgtctccggacatacatgtcagcactggtccgcccagacccctcatactcataaccggacaccggagaacttcccatgcaaaaaccttgatgagaactattgccgaaacccagatggcaagagagcaccatggtgccacacaactaactcacaggtcagatgggaatattgtaaaattccatcatgcgatagcagccctgtgagcaccgaacaactagcaccaactgctccaccagaactgacacctgtcgtgcaggactgctatcatggagacggccaaagctatcgcggaaccagtagcaccacaacaacaggcaaaaagtgccaaagctggagtagtatgaccccgcaccgtcaccaaaagactcctgagaattaccctaatgccggattaaccatgaactactgcagaaacccagacgctgataaaggtccatggtgtttcacaacagaccctagcgtccggtgggagtactgcaatctcaagaagtgctccggcactgaggcctcggtggtggcccctccacctgtggtgttactcccagacgtggaaacaccgtcagaggaagactgcatgttcggtaacggcaagggatataggggaaaaagagcaacaacagtcaccgggaccccatgccaggattgggcagcccaggaaccccacaggcacagcatttttacccctgaaacaaacccacgagccggccttgagaagaactactgtcgtaacccagatggggacgttggagggccctggtgttatactaccaacccacggaaactgtacgactactgtgacgttcctcagtgcgccgccccgagcttcgattgcggaaaaccacaggtcgagccgaaaaaatgccctggaagagtcgtgggggggtgcgtcgcgcaccctcactcgtggccgtggcaagttagtttgcgcactagattcgggatgcatttttgtggaggcaccctgatcagcccagaatgggtacttaccgctgcccactgcctggagaagagcccccgcccttccagctataaagtgatcctgggtgcccatcaggaggtgaatctcgagcctcacgttcaagagattgaagtgtctcgactcttcctcgaacccacacgtaaagacatcgcactccttaagctttcttcaccagcggtcatcaccgacaaagttattcccgcatgtttgccatcccctaactatgtggtggctgatcggaccgagtgctttattacggggtggggagagacccaagggacttttggggctgggctgcttaaggaggcgcagctgcccgtgatcgagaataaggtgtgtaacagatacgagtttctgaacggaagggtgcagtcaacggaattatgcgccggacatttggctggaggcactgactcttgtcagggggatagtggcggcccactggtgtgtttcgagaaagacaagtatatcttgcaaggcgtcacatcctgggggctgggatgtgcgagacccaataaaccaggagtctatgtgagagttagcaggtttgtgacttggatcgaaggggttatgcgcaataac

SEQ ID NO: 250914 - DNA, 2430 bp, Artificial Sequence
  Description of Artificial Sequence: Synthetic coding sequence
atggaacacaaggaagtcgtcctgctcctgcttctcttcctcaagagcggacaaggagaacctcttgacgattacgtgaacacccaaggcgcaagtctgttcagcgtgacgaagaagcaactgggcgccggatctattgaagaatgcgctgccaaatgcgaagaagatgaggagtttacgtgtcgggcatttcagtaccactcgaaggagcagcagtgcgtgatcatggccgagaatcgcaaatctagcatcatcatccgcatgagagacgtcgtgttgtttgagaagaaagtctacctcagcgagtgtaaaactggtaacggaaagaattacagaggcaccatgtccaaaactaagaacggtatcacttgccagaagtggagctcgacctcgcctcaccgtcctaggtttagccctgcaacccacccgtcggagggccttgaagagaactactgtagaaacccggacaatgatccgcaaggcccatggtgttacaccactgatcctgaaaaaaggtatgactattgtgatattctcgaatgcgaggaggaatgtatgcattgctcgggtgagaactacgatggaaaaatctccaagaccatgtcgggactggaatgccaggcctgggattcccagtccccgcacgctcacggatacattccgagcaagttcccgaacaagaatctgaagaaaaactactgccgaaacccggaccgagagctgcggccgtggtgctttaccactgatccgaacaagagatgggagctgtgcgacatccctagatgcactacgcccccgcctagtagcggcccgacctaccaatgcctgaagggaactggcgagaactaccggggtaacgtggccgtcaccgtctccggacacacctgccagcactggtcagcccagaccccacatacgcataaccggaccccagagaatttcccgtgcaaaaatctcgatgaaaactattgtcggaaccccgatgggaaaagggccccgtggtgccacaccacgaacagccaggtgaggtgggagtactgcaagatcccttcatgcgactcatcccccgtgtccaccgaacagctggcgcctaccgcaccgcccgagctgacccccgtggtccaggactgttaccacggagacggacaatcctacagaggaactagctcgactaccacgaccggcaaaaagtgccaatcgtggtcatctatgactccgcataggcatcaaaagactcctgaaaactacccgaacgcgggtctgacgatgaactactgccgcaacccagatgcggacaagggaccatggtgtttcactactgatccatcagtccgctgggaatactgcaatttgaagaagtgctcgggaacggaggcttccgtagtggctcctccgccggtggtgctcctcccagacgttgaaactccatcggaggaggactgcatgttcggaaatggtaaaggataccggggaaaacgcgcgaccaccgtcaccggaaccccatgccaggactgggcagcccaagaaccccatagacatagcattttcactcccgaaactaatccacgcgcgggtcttgaaaagaattactgtcggaatccggacggagacgtcggtggaccgtggtgctacaccacgaatccacgcaagctgtacgactactgtgacgtgccacagtgcgctgcaccttcattcgattgtggtaagccccaagtagagcctaagaagtgtccaggacgggttgtcgggggctgtgtcgcgcatccacatagttggccttggcaagtgtcgttgcggacccgcttcggcatgcacttctgcggaggaaccctgatctcgccagaatgggtgcttaccgccgcgcattgcctggaaaaaagtccgcgcccgagctcatataaggtgatcctgggagctcaccaggaagtgaacctggaaccccacgtccaagaaatagaggtgtccagactcttcttggaacccactcgaaaagatatcgcgctcctcaagctgtcatcgccagcagtcatcaccgacaaggtcatcccggcgtgcctccccagccccaactacgtggtggccgacaggactgagtgctttatcaccggatggggcgaaactcagggcaccttcggtgcggggctcctgaaggaagcccagcttccggtgatcgagaataaagtgtgcaatcggtacgagtttttgaacgggcgcgtgcagtccactgaactgtgcgccggacatctcgccggaggaactgactcttgccagggagactccgggggaccactggtgtgcttcgagaaggacaagtatattcttcagggggtcacctcctgggggctgggctgcgctcggccgaataagccgggagtctacgtgcgcgtatcgaggttcgtcacttggatcgagggcgtgatgcggaataac

SEQ ID NO: 250915 - DNA, 2430 bp, Artificial Sequence
  Description of Artificial Sequence: Synthetic coding sequence
atggagcacaaagaggtggtcctgctgctgctattatttctgaagtctgggcagggcgagcctttggatgactacgtgaacacacagggcgctagcttgttctcagtgacaaagaagcaacttggggctgggtcgatcgaggaatgcgccgctaagtgtgaggaggatgaagaattcacctgccgggctttccaataccacagcaaagagcaacagtgcgtaatcatggcggagaatagaaaaagctctatcattatccggatgcgggatgtggtgctgttcgagaagaaagtgtacctcagcgagtgtaagacaggaaatgggaagaactaccgcggaactatgagcaaaaccaagaacggaatcacttgtcagaagtggtcttcaacgagtccccatcgaccccggttcagtccggcaactcacccgagtgaggggctcgaggagaactattgcaggaatcctgacaacgatcctcaggggccctggtgctatacgaccgaccctgaaaaaaggtatgactactgcgatatactagagtgtgaggaggaatgtatgcattgctctggagagaactacgacggcaagattagcaaaaccatgagcggactcgaatgccaggcgtgggatagccagtccccccatgctcacggttacattccgtccaagtttcctaataaaaacctgaagaagaactactgcagaaaccccgatcgcgaactgagaccctggtgctttactaccgatcccaataagaggtgggaactgtgtgacattccgcgttgtaccacacccccaccttcctccggacccacttaccagtgtttgaaaggcacaggggaaaactacagggggaacgtcgctgtcactgtgagcggccatacctgccagcactggtcggcccagacgccccatacccataacagaaccccagagaatttcccgtgcaagaacttagatgagaattactgccgtaatcctgacgggaagcgggccccttggtgccacaccacaaacagccaagtgcgttgggagtactgcaagattcccagttgcgattcttcacctgtctctaccgaacagcttgccccaacagctccgcccgagctgacccccgtcgtgcaggactgctatcatggcgacggacagagttaccggggaacgtcatcaactacaaccaccggcaagaagtgccagtcctggtcatccatgaccccgcacaggcaccagaaaactcccgaaaattacccgaatgccggccttaccatgaattattgtcgcaatcccgacgccgataaaggaccctggtgtttcaccacagatccatctgtccgatgggagtactgcaacctgaagaagtgtagtggaaccgaagcctcggtggtggctccccctccagtcgtgctgctccccgacgtggagaccccaagcgaggaagactgcatgttcggcaacggcaagggttacaggggaaaacgggcgactaccgtaacaggcacaccctgtcaggattgggcggcccaggagccccatcggcacagtatcttcacgccagagacaaatcctcgtgccggtctagagaagaactattgcaggaaccccgacggagacgttggcggaccctggtgctacacaaccaacccccggaagctgtatgattactgtgatgtgccgcagtgcgccgcacctagcttcgattgtggaaaacctcaagtggagcccaagaaatgtccagggcgggttgtgggaggctgtgtcgcgcacccccactcctggccctggcaggtgtctttacgtacaagattcgggatgcacttctgcggaggcaccctgatcagccccgaatgggttctgaccgctgcgcactgcctggagaagagccctcgcccgtcgtcatataaagtgattcttggggcacatcaggaggtgaatttggagccccatgtccaggaaattgaagttagtaggctgttcctggaaccaacccgcaaggatatcgcactgctgaaactcagctcgcccgccgtaatcaccgacaaggtcatacccgcctgtctgccatctccaaattatgtggtggccgataggacagagtgcttcatcacggggtggggcgaaacccagggcacttttggcgccggcctgctcaaagaggctcagctccctgtgatcgaaaataaagtctgtaacagatatgagttcttgaacggcagggtacagagcaccgagctgtgtgccggacacctggccggcggcactgacagttgccaaggcgattccggaggccccctggtttgttttgagaaggacaaatacatcctgcagggggttacaagctggggcttggggtgcgccaggccgaacaagcctggcgtttatgtgagggtgagccggtttgtgacttggatcgaaggagtcatgcgcaacaat

SEQ ID NO: 250916 - DNA, 2430 bp, Artificial Sequence
  Description of Artificial Sequence: Synthetic coding sequence
atggaacacaaggaggtagtcctgctgctgttactcttcctcaagagcggacagggagaacctctggatgactatgtgaatactcagggcgcaagcctcttctccgtcacaaagaagcaactcggcgcaggtagtattgaggagtgtgctgcaaaatgcgaggaggacgaagagtttacttgtcgcgcatttcagtatcatagcaaggagcagcagtgcgtgataatggccgaaaatcggaagtcatctattatcataagaatgcgggatgtcgtactattcgagaaaaaagtctacttgagcgaatgcaagaccggtaatggtaagaattatcggggtacaatgagtaaaaccaagaacggcatcacgtgccagaagtggtccagtacttccccccaccgccctcggttcagtcctgcgacacacccctccgaaggactcgaggagaactactgccggaatcctgacaatgacccacaaggcccctggtgctacactaccgatccggagaagcgctacgattattgtgatattttggaatgtgaggaagagtgtatgcactgctctggagaaaattacgatggaaagatttctaagaccatgagtgggctcgagtgccaggcctgggacagccagtcacctcatgcccatgggtatattccgtctaaatttccaaacaagaacctcaagaagaattactgcagaaaccctgacagagagctgcggccctggtgcttcacgaccgatccgaacaagaggtgggagctctgcgatattccgcggtgtactacgccacccccttcctccggccctacttatcagtgtctcaaggggaccggggagaactacaggggaaatgtggcggttactgtctccggtcacacttgtcagcactggagcgctcagacaccacacacccataaccgcacccccgaaaattttccatgcaagaacctggatgagaactattgcagaaacccagacggaaaacgcgcaccatggtgccacactacaaactctcaagtgagatgggaatattgtaagataccatcctgtgactcttcacccgtttctaccgaacagctcgcccctactgcccctcctgagttgacacccgttgtgcaggactgttaccatggtgacggtcagtcttacagggggacctcttctactaccaccaccggcaaaaagtgtcagagctggtccagcatgaccccccatcgtcatcaaaagacacccgagaattaccccaacgccggtttaacaatgaattattgcaggaaccctgacgccgataagggtccttggtgttttactactgatccaagcgtacgctgggaatattgcaacctcaagaaatgttctggaaccgaggcgagcgtagttgcccctcctccagtagtacttcttcctgatgtcgaaaccccttccgaggaggactgcatgtttggtaacgggaagggatatcgcggtaaaagagccactacagtgacgggcactccatgccaggactgggccgcacaagagccccatcgacacagtatcttcacccccgagacaaacccgagggcaggattggaaaagaactactgccggaaccccgatggggacgtggggggcccatggtgctacaccacaaaccctaggaaactctatgattattgcgacgtaccccaatgcgccgcgcccagcttcgattgcggaaagccacaagtcgaacccaaaaaatgtcctgggcgggttgtgggaggctgtgttgctcatccacactcttggccgtggcaggttagccttagaacacggttcggcatgcacttttgtggcgggactctgattagtcccgaatgggtactgacggctgctcactgtctggagaagagtccaaggcctagctcctacaaggtgattctgggggctcatcaggaggtaaacctcgagccacacgtgcaagagatagaggtgtctaggcttttccttgagccaacaaggaaggacatcgcccttctcaagctttcttctcctgccgtgattactgacaaggttatcccagcttgtctaccatcgccgaactacgtggtagccgatcgtactgagtgttttatcactggatggggcgagacccaaggcacattcggcgccgggctcctgaaagaagcccagctccccgtgatcgagaataaggtgtgcaatcggtacgagtttctgaacgggagggttcagtcaactgaactgtgtgccggacatcttgcaggtggcaccgattcttgccagggagacagcggcgggccactggtgtgcttcgagaaagacaagtacatcctccagggggtgaccagctggggactggggtgtgcacgtcctaataagcccggcgtttatgtgagagtgtctcggtttgtgacttggattgaaggcgttatgcgaaataat

SEQ ID NO: 250917 - DNA, 2430 bp, Artificial Sequence
  Description of Artificial Sequence: Synthetic coding sequence
atggaacataaagaagtagtattactactactattatttttaaaatcgggtcaaggtgaaccgttagatgattatgtaaatacgcaaggtgcgtcgttattttcggtaacgaaaaaacaactaggtgcgggttcgatagaagaatgtgcggcgaaatgtgaagaagatgaagaatttacgtgtcgtgcgtttcaatatcattcgaaagaacaacaatgtgttataatggcggaaaatcgtaaatcgtcgataataatacgaatgcgtgatgttgtactatttgaaaaaaaagtatatttatcggaatgtaaaacgggtaatggtaaaaattatcgaggtacgatgtcgaaaacgaaaaatggtataacgtgtcaaaaatggtcgtcgacgtcgccgcatcgtccgcgattttcgccggcgacgcatccgtcggaaggtttagaagaaaattattgtcgaaatccggataatgatccgcaaggtccgtggtgttatacgacggatccggaaaaacgttatgattattgtgatatattagaatgtgaagaagaatgtatgcattgttcgggtgaaaattatgatggtaaaatatcgaaaacgatgtcgggtttagaatgtcaagcgtgggattcgcaatcgccgcatgcgcatggttatataccgtcgaaatttccgaataaaaatttaaaaaaaaattattgtcgtaatccggatcgtgaattacgtccgtggtgttttacgacggatccgaataaacgttgggaactatgtgatataccgcgttgtacgacgccgccgccgtcgtcgggtccgacgtatcaatgtttaaaaggtacgggtgaaaattatcgaggtaatgttgcggttacggtatcgggtcatacgtgtcaacattggtcggcgcaaacgccgcatacgcataatcgtacgccggaaaattttccgtgtaaaaatctagatgaaaattattgtcgtaatccggatggtaaacgtgcgccgtggtgtcatacgacgaattcgcaagttcgttgggaatattgtaaaataccgtcgtgtgattcgtcgccggtttcgacggaacaactagcgccgacggcgccgccggaattaacgccggtagtacaagattgttatcatggtgatggtcaatcgtatcgaggtacgtcgtcgacgacgacgacgggtaaaaaatgtcaatcgtggtcgtcgatgacgccgcatcgacatcaaaaaacgccggaaaattatccgaatgcgggtttaacgatgaattattgtcgaaatccggatgcggataaaggtccgtggtgttttacgacggatccgtcggttcgatgggaatattgtaatctaaaaaaatgttcgggtacggaagcgtcggttgttgcgccgccgccggtagttttattaccggatgttgaaacgccgtcggaagaagattgtatgtttggtaatggtaaaggttatcgtggtaaacgtgcgacgacggttacgggtacgccgtgtcaagattgggcggcgcaagaaccgcatcgtcattcgatatttacgccggaaacgaatccgcgagcgggtttagaaaaaaattattgtcgaaatccggatggtgatgtaggtggtccgtggtgttatacgacgaatccgcgtaaactatatgattattgtgatgtaccgcaatgtgcggcgccgtcgtttgattgtggtaaaccgcaagtagaaccgaaaaaatgtccgggtcgtgttgtaggtggttgtgtagcgcatccgcattcgtggccgtggcaagtatcgttacgtacgcgatttggtatgcatttttgtggtggtacgttaatatcgccggaatgggtactaacggcggcgcattgtttagaaaaatcgccgcgaccgtcgtcgtataaagttatactaggtgcgcatcaagaagttaatttagaaccgcatgtacaagaaatagaagtatcgcgtctatttttagaaccgacgcgtaaagatatagcgttattaaaattatcgtcgccggcggtaataacggataaagtaataccggcgtgtctaccgtcgccgaattatgtagtagcggatcgtacggaatgttttataacgggttggggtgaaacgcaaggtacgtttggtgcgggtttattaaaagaagcgcaattaccggttatagaaaataaagtttgtaatcgttatgaatttctaaatggtcgtgtacaatcgacggaactatgtgcgggtcatctagcgggtggtacggattcgtgtcaaggtgattcgggtggtccgttagtatgttttgaaaaagataaatatatactacaaggtgtaacgtcgtggggtttaggttgtgcgcgaccgaataaaccgggtgtttatgttcgagtatcgcgttttgttacgtggatagaaggtgtaatgcgaaataat

SEQ ID NO: 250918 - DNA, 2430 bp, Artificial Sequence
  Description of Artificial Sequence: Synthetic coding sequence
atggaacacaaggaggtcgtgctgctgttgttgctttttctgaagagtgggcaaggcgagccgctggacgattatgttaacactcaaggcgcaagtcttttctctgtgactaaaaaacagttgggggcggggagcatagaagaatgcgcagccaaatgtgaggaggatgaggagttcacttgtcgcgcctttcaataccactctaaggaacaacagtgcgtgattatggctgaaaataggaagagctcgataatcattcgtatgagagacgtggtgctgtttgagaagaaggtctatctttccgaatgtaagacaggaaatggcaagaattacagggggaccatgtcaaagactaagaacggaattacgtgtcagaaatggtcctctacatcccctcaccgcccccggttctcacctgcaactcatcctagtgagggactagaagagaattattgcagaaatccagataacgatcctcagggaccttggtgttataccaccgatccagagaagcggtatgattactgcgacattcttgaatgcgaggaggaatgtatgcactgttccggagagaattacgacggcaagatttccaaaaccatgtccggtcttgagtgccaggcctgggactcccagagtccgcacgcccacggttatattccttccaaatttcccaacaagaatttgaaaaagaattattgtaggaatccagaccgggaactcagaccttggtgctttacaacagaccccaataagcggtgggagctgtgtgatattcctagatgcacgactcccccacccagttccggacctacatatcagtgtctaaaaggaacaggggagaattatcgggggaacgtcgcggtcaccgtaagcggtcacacgtgccagcactggagtgcgcagacaccacatacccacaacaggaccccggaaaatttcccctgtaaaaatttagatgagaactattgcaggaatcccgacggcaagcgggctccctggtgccacacgaccaactcacaagtcagatgggagtactgcaaaattcccagctgcgactcttcaccagtgtccaccgagcagctcgccccaacagcccccccggaacttacgccagtcgtgcaggactgctatcacggggatggccagagttatcgtggtacctcaagcacgaccactacaggaaagaaatgtcagagctggtcctccatgacaccccaccgtcatcaaaagactcccgagaattaccctaatgccggcctcacaatgaattactgtcggaaccccgacgcagataagggaccatggtgtttcactacggacccttctgtcagatgggagtactgcaatctgaagaaatgcagcggaactgaggcctctgtcgtagcaccccctcccgtggtattgctgccagatgtagagacaccatctgaagaagactgcatgttcggtaatgggaaggggtacaggggcaagcgggcgaccactgttaccggtaccccgtgtcaggattgggctgcccaggagcctcatcgccactctatcttcacgcccgaaactaaccctcgagcgggcctcgaaaaaaactattgcagaaacccagatggagacgtgggcggaccatggtgctatacaaccaatccacgcaaattatacgattactgtgatgtcccacagtgtgcagccccttctttcgactgtggtaaaccccaggtggagcccaaaaaatgcccagggcgcgtcgtgggagggtgcgtggctcacccccactcttggccctggcaagtgtctctgcgcacccggtttgggatgcatttttgtggtggaaccctaatttcgccagagtgggtcttgaccgccgcacactgtttggagaagagccctcggccctcctcctataaggttatcttgggcgcacaccaagaagtcaacctggagccccatgttcaagaaatcgaggtcagccgactgttcctcgaacctacccgtaaggacatagccttgctcaagctctcctcaccagccgtgattactgacaaggtgataccggcatgcctgccatccccaaactacgtggtggccgaccgcacagaatgcttcatcacgggatggggcgagacgcaaggtacattcggcgccggactgctgaaagaagcacaactcccagttatagaaaataaggtgtgtaacaggtacgaatttctcaacggcagagtgcaatctaccgaactttgcgccggccatcttgcaggcggaacggattcttgccaaggcgattcagggggaccgctcgtgtgtttcgagaaggataaatacatcctgcagggcgtaaccagctggggtctagggtgcgcccgccctaacaagcctggggtgtacgtgcgggtgagcagatttgtgacctggatcgaaggtgtaatgagaaacaac

SEQ ID NO: 250919 - DNA, 2430 bp, Artificial Sequence
  Description of Artificial Sequence: Synthetic coding sequence
atggaacacaaggaggtcgtgctcctgcttcttctgttcctgaaatctggtcaaggggaacctctggatgattacgtgaacacccagggcgcgtccttgttttcagtgaccaaaaagcagctcggagcggggtcgatcgaagaatgcgcggcaaagtgtgaggaagatgaagagtttacttgccgtgcgtttcaataccatagcaaggagcaacagtgcgtgattatggcagagaaccgtaagagtagcatcattatccggatgcgagacgtcgtgctctttgaaaagaaagtgtacctgagcgagtgcaagaccggtaacgggaagaactaccggggaaccatgtctaagaccaagaacgggataacttgtcaaaaatggagctcaacttcccctcatcgtcccagattttcgccggctacgcacccatccgagggcctggaggagaactactgtcgtaacccggataacgaccctcaagggccctggtgttacactactgacccagagaagagatacgattattgtgacatattggaatgtgaagaagaatgtatgcattgttcaggtgagaattacgatgggaagatctcgaaaaccatgagcggtttggaatgtcaagcatgggactcacagagcccacatgcacacggatacattccatcaaaattcccaaacaagaatctcaagaagaactattgccggaaccccgatcgggagctcaggccttggtgttttactactgacccgaataagagatgggaactgtgcgatataccgcgctgtacgacccctccaccatccagcggccctacctaccaatgccttaagggcactggcgaaaactaccgcggcaatgtggctgtgaccgtcagcggacacacttgtcaacactggagtgcccagacccctcatactcataatagaacccctgaaaactttccgtgtaagaacctggatgaaaactactgcagaaaccctgatggaaaaagggctccatggtgccatacgaccaacagccaggtgagatgggaatattgcaagataccgtcgtgcgattcgtcgcctgtgtccaccgaacagcttgcaccgactgctccaccagaactgacccctgtggtgcaggattgctaccatggagacggacagtcctaccggggcacttcgtccactactactacgggaaagaagtgtcaatcgtggtcctcaatgactccacaccgacaccaaaagacccccgagaactaccccaatgcaggacttaccatgaattactgtcgcaaccctgacgcggataagggtccgtggtgcttcactacggacccttcggtcagatgggagtactgtaatctgaagaaatgttccggcactgaagcctcggtggtcgctccgcccccggtcgtgcttcttcccgatgtggaaaccccatcggaggaggattgtatgtttggaaacggaaagggttatcgcggtaagcgagccaccactgtgactggtactccttgtcaggattgggcagcacaggagcctcataggcattccattttcactcctgaaaccaacccacgcgccggacttgagaagaattactgcaggaatccagatggtgatgtgggtggcccttggtgctacaccaccaatcctaggaagctgtacgactactgcgacgtgccacaatgtgcagcgccatccttcgattgtggtaagccacaggtggagcccaagaagtgtcccggtagggttgtcggagggtgtgtggctcatccccattcgtggccttggcaagtctcccttagaactcgatttggtatgcacttttgtggaggaactctcatttcaccagagtgggtcctgaccgcagcacactgtctggaaaagagccccagaccctcaagctataaagtcatcctgggcgcccatcaagaggtgaacctcgaaccacacgtgcaagagattgaagtctcccggctctttctggaacccactcgcaaggacatcgcacttctcaaactgagctcgccagcagtgattactgataaggtgattcccgcatgtctcccttcccctaactacgtggtggcagatcgaaccgagtgtttcataaccggatggggtgaaacccaaggcacgtttggtgccggactcctgaaagaggcccaattgccagtcattgagaataaagtgtgcaaccgctacgagtttcttaacggtcgggtgcaatcaacggaactgtgtgcaggccatcttgcaggtggtaccgactcctgtcagggggactccggaggtcccctggtgtgctttgaaaaggataagtacatcctccagggagtgacctcgtggggtttgggatgtgcacgacccaacaaacctggagtgtacgtgagagtgtcccgctttgtgacttggatcgaaggagtgatgagaaacaac

SEQ ID NO: 250920 - DNA, 2430 bp, Artificial Sequence
  Description of Artificial Sequence: Synthetic coding sequence
atggagcataaggaagtagtgctgttgctcttgctcttcctaaagtcaggacagggcgaacctctcgatgactacgtcaatacccagggagcttccctgttctctgttactaagaagcaattaggagccggctctattgaagaatgcgccgctaagtgtgaagaagacgaagagttcacttgcagggccttccaataccactccaaggaacagcagtgcgtgatcatggcggagaaccgaaagagcagcattatcatccgtatgcgcgatgtggtgctcttcgaaaagaaagtttacttgtcggaatgcaagaccggtaacgggaagaattaccgcggaacaatgtcaaagacgaaaaatgggatcacctgccagaagtggtcatcgactagcccacatcgacccaggtttagcccagcaacccatccctcggagggcctggaggagaactattgccgtaatccagacaacgacccgcagggtccctggtgttatacaaccgatcctgagaaacgctacgattattgcgacattctggagtgcgaagaagaatgtatgcactgctcgggcgaaaactacgacggtaagattagcaagactatgagtggactggagtgtcaggcttgggactcacagtctcctcatgctcatggctacattcctagtaagttccccaataaaaacctgaaaaagaactattgcagaaaccctgaccgggagctccgcccttggtgcttcacgacagaccctaataaacggtgggaactctgcgatattccacgatgtacaactccgccgccctcctccggaccaacttaccaatgtctgaaagggaccggcgaaaactatagaggtaacgttgctgttacagtgtccgggcacacgtgccagcactggtcagcccagactccgcatacacataaccggacacccgagaatttcccgtgtaaaaatcttgacgagaattactgtagaaatccagacgggaaacgggcaccatggtgccacacaaccaactcccaggtacgttgggagtattgtaaaatcccaagctgtgactcctcaccagtgtcaacagaacagttggcacccactgccccccctgaattaacacccgtggtccaggattgctaccacggcgacgggcaatcctacaggggaacaagctcaacgaccacgaccggtaaaaagtgtcaaagctggtcatccatgacaccgcaccgacatcagaaaacgccagagaattaccctaacgctggcctaacgatgaattactgtagaaacccagatgctgataagggcccctggtgtttcaccacagatccatcagttagatgggaatactgtaatctgaagaagtgcagcgggaccgaagcttcagtagtggcaccgccacctgtcgtgcttctccctgacgtcgagacaccgtcagaggaagactgtatgttcgggaatggaaaaggctaccggggcaaaagagccaccacggtgactggcaccccgtgtcaagattgggccgcccaggagcctcacagacatagcatctttactcccgagaccaatcccagagccgggttggagaagaactactgtcggaaccctgacggcgatgttgggggcccgtggtgctataccaccaacccacgaaagttatatgactattgtgatgtcccccaatgtgcggccccctcgttcgattgtggtaagccgcaggtggaacccaagaagtgtccaggacgggtggtggggggatgcgtcgctcacccacatagctggccatggcaggtgtccttaaggacacgctttggcatgcacttctgtggaggtactctgatctcccctgagtgggttcttacagctgcccactgcctagaaaaatcgcccaggccttcctcttacaaggtgattttgggcgcccaccaggaggtgaacctggaaccccacgtccaagaaatcgaagtatctcgcctctttctggagcccactcgaaaagacatcgctctcctgaaactgagctctcctgcggtgatcacggacaaggttattcccgcttgcttgcctagccctaactacgttgtcgctgacagaactgaatgcttcatcaccggatggggggagacccaaggtaccttcggagcaggtttgctgaaggaagcgcagcttcctgtgatagagaataaagtatgtaacagatatgaattcttgaacggccgggtgcagtccactgagctctgtgctggacacttagccgggggcacagactcttgtcaaggcgattctggtgggcccttggtgtgtttcgaaaaagacaagtatattctccagggagtaacctcctgggggctgggatgtgcccgacccaacaagcctggggtgtatgtccgagtctctagattcgttacatggattgagggtgtaatgcgtaacaat

SEQ ID NO: 250921 - DNA, 2430 bp, Artificial Sequence
  Description of Artificial Sequence: Synthetic coding sequence
atggagcacaaagaagtggtgctgctgctcctgctgtttctgaagagcggacaaggtgaaccgctggatgactacgtgaatacccagggggcctcgctgttttccgtgactaagaagcagttgggggcgggatcaatcgaggaatgtgcagccaagtgcgaggaagatgaagagttcacctgccgcgcgttccaataccactccaaagagcagcagtgcgtgatcatggcggagaacagaaaatcctcaataatcatcaggatgcgggatgtggtgctgttcgagaagaaggtgtacctgagcgagtgcaagacggggaatggaaaaaactatcgcggaactatgtcgaaaaccaaaaacggaatcacctgccagaagtggtccagcacttcgccacatcgcccacgcttcagcccagctactcacccatcagaagggctcgaggagaattactgcaggaatccagacaacgatccacagggtccttggtgctatactactgatccggaaaagcgctacgattactgtgacatcctcgaatgcgaagaggagtgtatgcattgctccggagaaaactacgacggaaagatcagcaagacgatgtccggcctcgaatgccaggcatgggactcgcagtcgccacacgcacacggatacatcccgtccaagttcccaaacaaaaaccttaagaagaactactgcagaaacccggatcgcgaactgcgcccctggtgttttaccaccgatccaaacaagcgctgggagctgtgcgatatcccccggtgtactacccctcccccttcctccggacctacttaccaatgcctgaaagggactggagagaattaccgtggcaatgtggcggtcactgtgtccggccacacttgtcaacactggtcagctcagacccctcatactcataataggaccccggaaaacttcccgtgcaaaaatctggacgaaaactactgccgcaaccccgacggaaagcgcgcgccatggtgccacaccactaattcgcaggtgcgctgggaatactgcaagatccccagctgcgattcttcgccagtgtcgaccgagcagcttgcgcctactgccccgcctgaactgactccggtcgtccaagactgctatcacggagacggacagagctaccgcggaacttcgtcaaccacgaccaccggaaagaagtgccagagctggtcctccatgactccgcatcggcaccaaaagacccctgagaactaccctaacgcaggattgaccatgaactactgccgtaatccggatgccgataagggaccgtggtgctttaccaccgacccatccgtgcgctgggagtactgcaacctcaagaagtgctccggaacggaggcatcggtcgtggcaccgccgccggtcgtgctgctgccggacgttgagacgccatcggaagaggattgtatgttcggtaacggaaagggataccgcggcaaacgagcaactactgtcactggcactccgtgtcaggactgggccgctcaggagccgcaccgccactccatcttcacccctgaaaccaacccccgcgctggactggaaaagaactattgtcggaatcccgacggagatgtgggaggcccgtggtgctatacgactaacccgagaaagctgtacgactactgcgacgtgccgcaatgtgcggctccttcgtttgattgcggtaagccgcaggtggagccgaaaaagtgtcctgggcgggtggtggggggctgcgtcgcccaccctcactcctggccgtggcaagtgtcccttagaacgaggttcggaatgcatttctgtggaggaaccctgatcagccctgaatgggtgctgaccgcggcacactgcctggagaagtcacctagaccttccagctacaaagtgatcctgggagctcatcaagaggtcaacctcgagccgcatgtgcaggaaatcgaagtgtcccgcctcttcctcgaaccaactcggaaggacatcgccttgctgaagctgtcgtcgccggcggtgatcactgacaaggtgatcccggcttgcctccctagccctaattacgtggtcgccgacagaactgagtgctttatcactggctggggcgaaactcaaggaactttcggagcggggctgcttaaagaagcacaattgccagtgattgagaataaagtgtgtaatcgctacgaattcctgaatgggagagtccaatctactgaactgtgcgcaggccatctcgcgggaggcaccgacagctgccaaggagatagcggaggtccactcgtctgctttgaaaaggacaagtatattctccaaggagtgacttcgtggggtctgggatgcgcacgcccgaataagcctggggtctacgtccgcgtctccagattcgttacttggatcgaaggcgtgatgaggaataac

SEQ ID NO: 250922 - DNA, 2430 bp, Artificial Sequence
  Description of Artificial Sequence: Synthetic coding sequence
atggagcacaaggaagtggtcctgctgctgctattattcctgaagtctgggcagggcgaacctctggacgactacgtgaatacccagggcgcctctctgtttagtgttacaaaaaagcagctgggggctggtagcatagaggagtgcgctgccaagtgtgaggaggacgaggagtttacatgtcgcgcattccagtaccactccaaggagcagcaatgcgtcatcatggctgaaaatcggaagtccagtatcatcatacgcatgcgcgatgtggttttgttcgagaagaaagtatatctgtcagagtgcaagaccggaaatggcaaaaactaccggggcaccatgtcaaagactaagaacgggatcacctgccagaaatggagtagcacatcacctcatcggccccggttctcgcccgcaactcaccccagtgagggactcgaggagaattactgtaggaaccccgataacgacccgcaggggccttggtgttatacgacagatcctgagaaacggtatgattattgcgatattcttgagtgcgaggaggagtgtatgcactgctctggagagaactacgacggaaaaattagcaaaacgatgagtggattggaatgtcaggcttgggacagccagtccccccatgcacatggttacatcccctcaaaattccctaataaaaatctgaaaaaaaactactgtcgtaacccggatagggagctgcgaccgtggtgtttcacgacggaccccaataaaaggtgggagctctgcgacatcccccggtgtactacaccgcctcctagctcagggcccacataccagtgtttgaaaggcaccggggagaattaccgaggcaatgtggcggtgacagtgagcggccatacatgccagcattggagtgcacagaccccccacactcacaaccgaacacccgaaaatttcccctgtaaaaatctcgatgagaattattgccggaatcctgatggcaagagagctccttggtgtcataccaccaattcacaggtccgttgggaatattgcaagataccctcttgtgattcttcaccagtctccaccgaacagctggcacccaccgccccccccgagctcacgcccgtggtccaagattgctatcatggagacggccagagttaccgtggcacaagtagcacaacaaccacgggaaagaagtgtcagagctggagcagtatgaccccacaccgccatcaaaagactcctgagaactacccaaacgccggcctaactatgaattactgtagaaaccctgatgctgataagggcccttggtgtttcaccaccgatccatctgtgcgctgggaatactgcaatctgaaaaaatgctctggtacagaagcaagcgtagtggctccgcctcctgtggtactactacctgacgtggaaaccccatcggaagaggactgcatgttcggcaatggaaagggctatcggggcaagagggcaactaccgtgaccgggactccctgtcaggactgggcggctcaggagccacacaggcatagtatcttcacccctgagaccaaccctcgtgcgggtctggagaaaaactattgcaggaatcctgacggcgatgtagggggcccgtggtgctatactacaaaccctcgaaaactttatgattactgtgatgtgccccagtgcgcagccccatcattcgattgtggaaagccacaggtcgaacccaaaaaatgtccaggaagggtagtaggtggttgcgttgcccatccccactcctggccttggcaagtgtccctgcggaccagatttgggatgcatttctgtggagggacgttgatcagtcctgagtgggtcctgaccgctgcacactgtttggagaagtctccgaggcctagttcatacaaggtgatccttggcgcccaccaggaagttaaccttgagccccacgtgcaagagatcgaagtcagccgccttttcctggaaccaactaggaaggatatcgccttgctcaaactgtcatccccagcagtcattactgacaaggtgataccagcttgcctgccttctcctaattacgtggtagctgacagaactgaatgtttcatcaccggctggggagagacccaaggtaccttcggcgctggcttgctcaaagaggcccagctacctgtaattgaaaataaggtatgcaacaggtacgaatttctgaacggcagggttcagtcaactgagttatgcgcaggacatcttgctgggggcacggatagctgccagggtgatagcggggggccactcgtttgcttcgagaaggataagtatatcttgcagggcgttacaagctgggggctcggatgcgcccgccctaacaagcccggcgtgtatgtgcgggtgagcaggtttgtgacgtggatagagggggtcatgcgaaacaat

SEQ ID NO: 250923 - DNA, 2430 bp, Artificial Sequence
  Description of Artificial Sequence: Synthetic coding sequence
atggagcacaaggaggtggtgctcctgttgcttctgtttttgaaatcaggacagggtgaacctctcgacgattacgtgaacacacagggagcctcactcttttcagtgaccaaaaagcagctcggtgccgggtctattgaagaatgcgccgcaaagtgcgaagaagatgaggagttcacttgtcgggcctttcaatatcattccaaggaacagcagtgcgtgatcatggccgagaatcggaagagcagtatcatcatcagaatgcgggatgttgtgctgttcgagaagaaggtttatctttctgaatgtaagaccggaaatggaaagaattacaggggcacaatgtctaaaaccaagaacggaattacgtgtcagaagtggagctctaccagccctcacagacccaggtttagccccgccactcacccctcagagggcttggaggagaactactgtagaaacccagataatgacccccagggcccatggtgttacacaaccgacccggagaaacgctacgactactgtgacattctggagtgcgaagaagagtgcatgcattgctcaggcgagaattatgacggaaagattagcaaaaccatgtccggcctggagtgtcaggcatgggattcccaatctccccatgctcacggctatatcccatccaagtttcctaataaaaatctgaagaaaaactattgtagaaaccccgacagagaactgagaccttggtgtttcacaaccgaccctaacaagcgatgggagctgtgtgacatcccaagatgcacaactcccccccctagttccggccccacatatcaatgcctcaagggtaccggagaaaattaccgggggaacgttgcagtcacagtgagtggacacacctgtcaacattggagtgcacaaacaccgcatactcacaatcgaactcccgagaattttccttgtaagaatctggatgaaaactactgtagaaatccagatggaaaacgcgccccctggtgtcacacgacgaatagccaagtaaggtgggaatactgtaagatcccttcctgtgactcaagccccgtgtcaaccgagcagctcgcacccacagcacccccggagctgacccccgttgtgcaagactgctatcacggagatgggcaatcctatcgggggacctctagcaccacaacgaccgggaagaaatgccaaagctggtcttctatgacaccccaccgccaccagaaaacccctgagaattaccctaacgccggactgacgatgaattattgcagaaaccccgacgctgacaaaggaccatggtgctttacgacggatccaagcgtgcgctgggagtactgcaacctgaagaagtgttctggcacagaggccagtgtcgtcgctcctccaccagtcgtgctgttgccagacgtcgaaacacccagtgaggaggattgtatgtttggcaacggaaagggctaccgggggaagagggccaccacggtgaccggtactccttgtcaggattgggcagcacaggaaccacatagacacagtatattcacgccagaaacaaaccccagagccggtctcgagaagaactactgccgcaaccctgacggcgacgtgggaggcccctggtgttacaccactaacccaaggaaactgtacgattattgtgacgtgccccagtgtgccgcgcccagttttgactgtgggaaaccgcaagtcgaacctaagaaatgcccaggacgggtggtgggcggatgcgtagcacatccacatagctggccctggcaggtgtcactgaggacacgattcggcatgcatttctgcggcggtactctcatctctccagagtgggtactgactgcggcccactgcctggagaagtcccctaggccctcaagctacaaggtcattcttggggcccaccaagaggtgaatttggagccacacgtgcaagaaatagaagtaagtagactgtttctggaaccaactagaaaggatattgcactgctcaagttgtcaagtccagcagtgattacggataaggtcatccccgcgtgtctgccctcccctaactacgtcgtggccgacaggaccgaatgttttataacaggatggggtgagactcagggcacattcggcgcagggctcttgaaggaggctcagttgcccgtgattgaaaataaagtgtgcaacaggtacgagttcttgaatggccgagtgcagtctacagagctgtgcgcaggccaccttgcagggggcaccgattcatgccaaggggatagtgggggacctttggtgtgcttcgagaaagataagtatattctgcagggggtcacatcttggggcttgggctgtgcccgccccaacaagccaggcgtgtatgtccgcgtttcccgcttcgtgacatggatcgaaggcgtgatgcggaataac

SEQ ID NO: 250924 - DNA, 2430 bp, Artificial Sequence
  Description of Artificial Sequence: Synthetic coding sequence
atggagcacaaggaagtcgtgctgctgttgctcctgttccttaagtcggggcaaggagaaccgttggacgattacgtgaatactcaaggagcctcactgttctccgtgaccaaaaagcaactgggagcaggaagcatcgaagagtgcgcggccaaatgcgaagaggacgaggagttcacttgtagggcctttcaataccactccaaagagcagcagtgtgtgatcatggcggagaatcgcaagagctcaatcatcatccgcatgcgcgatgtcgtgttgtttgaaaagaaggtgtacctgtcggaatgcaaaactggaaacgggaagaactacaggggaactatgtccaagaccaaaaacgggatcacctgccaaaagtggtccagcacctcgcctcaccgcccgcgcttctcaccggctacccacccgagcgaaggacttgaggagaattactgccgaaatccggataatgatccacaaggcccctggtgctacactaccgatccggaaaagcggtacgattactgcgacattctcgagtgcgaagaggagtgcatgcattgttcaggcgaaaactatgatggtaagatttctaagaccatgtccggcctcgagtgccaggcatgggactcgcaaagccctcatgcgcatggctacattccatccaagttcccaaataagaacttgaaaaagaactactgccggaaccctgaccgggagcttcgcccctggtgtttcaccacggatccaaataagaggtgggaactctgcgacatcccgagatgcaccaccccaccgccctcatccggaccgacctatcagtgtttgaaaggaaccggagagaactatcggggcaacgtcgccgtgactgtctcaggacatacttgccagcattggagcgcccaaactccacacactcacaaccgcactcccgaaaacttcccatgcaagaatttggacgagaattactgtcgtaatccagatgggaagcgcgcaccgtggtgccacaccacgaattctcaagtgcgatgggaatactgtaagatcccaagctgtgacagctccccagtgtcgaccgaacagctcgcacctactgccccgcctgaactgaccccagtggtgcaggactgctaccacggagatggtcaaagctaccggggaacttcttcgacgacgacgaccgggaaaaagtgccagtcgtggagctcaatgacgccgcaccgccatcaaaaaacgccagaaaactacccgaatgctggcctcaccatgaactactgtaggaacccggatgcggataagggtccgtggtgcttcactacggatccgtcagtgcggtgggaatactgcaatctcaagaaatgctccggcacggaagcctccgtggtggcccctccaccagtggtgctccttccagacgttgaaaccccttccgaagaggactgcatgttcggaaacggtaaaggttacagaggaaagagagcaactactgtcaccggtactccgtgccaggactgggcagcacaggaaccccaccgccatagcatcttcacccccgagacgaatccgcgcgctggcctcgaaaagaattactgcagaaaccctgacggggacgtgggaggcccgtggtgttacaccacgaaccctcgcaagctgtacgactactgcgacgtgccgcagtgcgcagccccctcgtttgactgcgggaaacctcaggtcgagcctaaaaagtgccccggaagggtcgtcggcggctgcgtggcccatccgcatagctggccttggcaagtgagccttaggactcggttcggaatgcacttctgtggtggcaccttgatcagccctgagtgggtgctgactgctgcacactgcctcgaaaagtcgccgcgaccttcttcctacaaggtgatactgggagcccaccaggaagtcaacctggagccgcacgtgcaggaaatcgaagtttcgagactgttcctggagcccactcgcaaagacatcgctctgctcaagctcagctcaccggccgtgatcactgacaaggtgattcccgcatgtctgccgtccccgaactacgttgtggcggaccgcactgagtgttttatcaccggctggggggaaacccagggaacgttcggcgctggactgctgaaggaagctcagctcccggtgattgaaaacaaagtctgtaacaggtacgagtttctgaacggtcgtgttcagtcaactgagctgtgtgctggacacctggcgggaggaactgactcgtgccagggagattccggaggccctctcgtttgctttgagaaggacaagtatatactgcagggggtcacgtcatggggcctgggatgcgcccggcctaataagccaggagtctacgtgcgagtgtcccgcttcgtgacctggatcgaaggtgtcatgcgcaacaac

SEQ ID NO: 250925 - DNA, 2430 bp, Artificial Sequence
  Description of Artificial Sequence: Synthetic coding sequence
atggaacacaaggaggtggtgctgctgctcctattgttcctgaaatccggccagggagagccactcgatgactatgtgaacacacagggggcaagcctcttcagcgtaaccaaaaaacagcttggtgctggctctattgaagagtgcgctgcgaaatgtgaagaggatgaggagttcacatgccgcgcattccaataccacagcaaggagcaacagtgcgtgatcatggctgaaaacagaaagtcatcaataataatcaggatgcgggatgtggtactcttcgagaagaaagtctacctcagcgaatgcaagacaggcaatggaaaaaattaccgtgggaccatgagtaaaacgaagaatggaattacttgtcagaagtggtccagtacgagtccacaccggccaagattcagcccggctactcatcccagcgaaggactagaggagaactattgccggaaccctgacaatgacccacagggaccttggtgttataccactgaccctgagaagcgctacgactactgtgacatcctcgaatgtgaggaagaatgtatgcactgttctggagagaattacgatggcaagatcagcaagacaatgagtggtcttgaatgccaggcctgggattcacagtccccgcatgcgcatggctatatacccagtaagtttccaaacaagaatctaaaaaagaattattgtaggaaccctgaccgggaattgaggccctggtgtttcacaacggacccaaacaagcggtgggagctctgtgatatacctagatgcactactccacctcccagcagcggcccgacttatcagtgcctcaagggcaccggagaaaactacaggggcaacgtcgctgtcactgtgagcggtcacacatgccagcactggtcagcacagactccccacacgcataaccgcacacccgagaacttcccatgcaaaaacttggacgaaaactattgcaggaaccccgacggcaagcgcgcaccttggtgtcatacaacgaattcccaggtcaggtgggaatactgcaaaataccttcctgcgactcgtccccggtctcaaccgaacaacttgcgcccaccgccccaccagagttaaccccagttgtccaagactgctatcacggtgacggtcagtcctatagaggaacatcatccacgacgactacagggaagaaatgccagagctggtccagcatgacgccacataggcaccagaagaccccagagaattaccccaacgctggcctgacaatgaattactgtagaaaccccgacgctgataagggaccctggtgctttacgacggatccctctgtgcggtgggagtactgtaatctgaaaaagtgcagcggaacagaggcaagtgttgtggctccaccgccggtggtgctcttgcctgatgtcgaaacaccaagcgaagaggactgtatgttcggaaatggtaagggatacagaggtaagagagcgaccaccgtgaccggcacaccctgccaggactgggccgcgcaggaaccccaccgacactcaattttcaccccagagacgaatccccgcgcaggcctggagaagaactactgtcgaaaccctgacggcgatgtgggcggcccttggtgctacaccaccaacccaagaaaactttatgattactgcgacgtgccacagtgtgccgccccatcttttgactgtggcaagcctcaggtcgagcctaaaaaatgccctggtagagtcgtgggcgggtgtgtcgcccaccctcattcctggccctggcaggtgagcctgcggacccgcttcgggatgcatttttgcggcggtaccctaataagtccagaatgggtcctcacagctgcgcattgtctggaaaaatccccccgcccaagcagctacaaggtgattctcggggcgcatcaggaggtgaatctagagcctcatgtgcaggagatcgaggtttcacgactgtttctggagcccaccaggaaagatatcgcccttctgaagctgtccagccctgcagttataacagataaggtgatcccagcgtgcctgccgagcccaaattacgtagtggcggatcgcactgaatgcttcattaccgggtggggggagacacaagggaccttcggtgccggactcctgaaggaggctcaactgcctgtcatcgagaataaggtgtgcaaccgttatgagtttttaaacgggcgcgtacagtctactgagctgtgtgccgggcatctcgcaggcggcacggattcttgccagggggacagcggcgggcctttagtgtgctttgaaaaagacaagtatatactccagggagttacgtcttggggcctggggtgtgctcgtccaaataaacctggagtttatgtccgtgtgtcacgctttgtaacttggatcgagggcgtcatgcgcaacaac

SEQ ID NO: 250926 - DNA, 2430 bp, Artificial Sequence
  Description of Artificial Sequence: Synthetic coding sequence
atggaacacaaggaggtggtgcttctgctcctcttgttccttaaaagcggacagggagagccactcgatgattacgtcaacacccagggggcctcactgttctccgtgaccaagaaacaactgggcgctggaagcatcgaggagtgcgcggctaagtgcgaagaagatgaggaattcacctgcagggcctttcagtaccactcaaaggagcaacaatgcgtcattatggcagagaacagaaagtcgtcgatcatcattcgaatgcgggacgtggtcctctttgaaaagaaggtgtatctgtcggaatgcaaaacgggcaatggaaagaattaccggggaactatgtccaaaaccaagaacggaatcacctgccagaagtggtcgtcgacgtcaccacaccggccgcggttctcgcccgccacgcacccatcggaaggcctggaagagaattactgcagaaaccctgacaacgacccacaggggccatggtgctacaccactgaccccgaaaagcgctatgactattgcgacatcctcgaatgtgaggaggagtgtatgcattgctcgggggagaactacgatggaaagatctcaaagaccatgtccggactggagtgccaggcttgggactcgcagtcgccgcatgcgcacggttacattccatcgaagttccctaataagaacctgaaaaagaactactgccgaaatcccgaccgggagctccgcccgtggtgcttcactactgacccgaacaaacgctgggaactgtgcgatatcccgcggtgcactacccctccaccttcctctggcccaacgtaccaatgtcttaagggaaccggagagaactaccggggtaatgtcgccgtgactgtcagcggacacacctgccagcactggtccgcacagacccctcacacgcataaccgaactccagaaaactttccgtgcaaaaatctggacgagaattactgtaggaatccagatggaaagagggccccttggtgccacactaccaactcccaggtgcgctgggaatactgcaagattccgtcgtgcgactcgtccccggtgtctactgagcagttggcgccgactgccccacctgaacttaccccggtcgtccaagactgctatcatggggacggacagagctaccgcggtacctcctcaaccaccacgaccggtaagaagtgccaatcgtggtcatccatgaccccacataggcatcaaaagactcccgagaattacccaaacgccggactgacgatgaactactgcagaaatccggatgccgataagggaccatggtgtttcaccaccgacccgtccgtgagatgggagtactgcaatctgaagaaatgttccggtaccgaggccagtgtcgtggcacccccgccggtcgtgctgctccctgatgtggagacgccgtcagaagaggactgcatgtttggaaatggcaagggctaccggggcaagcgcgcgactactgtcactggaactccatgccaagactgggccgcgcaggagccgcaccgccattcgatcttcacccctgaaactaatccgcgagccggcctcgagaagaactattgtcggaacccggatggagatgtggggggaccgtggtgctacacgactaacccgcggaagctgtacgactactgcgacgtgccgcaatgtgcggccccgtctttcgactgcgggaaaccccaggtcgaacccaagaagtgcccaggaagggtcgtgggcggatgtgtcgcccacccgcactcctggccgtggcaggtgtctcttcgcactaggtttggcatgcatttctgcggaggaactctgatctcgccggaatgggtgctgaccgcggcccactgtctcgagaagagccctaggccatcgtcctataaagtgatcctcggcgcccaccaggaggtgaacctggaacctcacgtgcaggaaatcgaagtcagccggctcttcctggagccaacccggaaggatatcgcgctgctcaaattgtcctccccagcggtgattaccgataaggtgatccctgcgtgccttccgtcaccgaattacgtcgtcgccgaccggactgagtgcttcatcactggctggggagaaacccagggaaccttcggcgctggcctgctcaaagaagcacagctgcctgtgattgaaaacaaagtgtgtaatcggtacgaatttctcaacggcagagtgcagtcgaccgagctctgcgcgggacatctggccggcggcacggattcatgccagggagattctggaggaccgctggtgtgtttcgaaaaggacaaatacatcctccagggagtgacctcatgggggctgggatgtgctcggcctaacaaaccgggagtctacgtgcgcgtgtcgcggttcgttacctggatcgaaggagtcatgaggaacaac

SEQ ID NO: 250927 - DNA, 2430 bp, Artificial Sequence
  Description of Artificial Sequence: Synthetic coding sequence
atggaacacaaggaggtcgttctcctcctgctgctgtttctaaagtctggccagggggagcccctggacgactacgttaatacccagggagccagcctgtttagtgtgactaagaaacagcttggggctggctctatcgaggagtgtgccgccaaatgtgaggaagacgaagagtttacgtgtcgtgctttccagtatcatagcaaggaacaacagtgcgtcatcatggctgagaaccgaaagagctctataatcattcggatgagggacgtggtgctgtttgaaaagaaggtctatttaagcgagtgcaaaaccgggaatggtaaaaactatcggggcaccatgtctaaaacaaagaacggcatcacctgccagaagtggtctagcacctctccccataggccccggtttagtcccgctactcacccgagcgaaggtctcgaggagaactactgcagaaaccctgataatgatcctcagggtccttggtgctacacaactgatcctgaaaagcgatacgactattgtgatattttagagtgcgaggaagagtgcatgcactgctctggagagaactatgatggcaagatctccaagacgatgtcaggattggagtgtcaggcatgggattcgcagtcgcctcatgcgcacgggtatatcccaagcaaatttccaaataagaatttaaagaagaactactgccgcaacccagatcgggagctccgaccttggtgttttacaaccgaccccaataagagatgggaactctgtgatatccctaggtgtactaccccacccccctcctcaggccctacatatcaatgtcttaaggggaccggagaaaactatagaggaaacgtcgcagtgacagtgtctggtcatacttgtcagcattggagcgcccaaacgcctcacacccacaatcgcaccccggaaaattttccgtgtaagaatctggacgaaaattattgcaggaatccggatggaaagagagctccctggtgccataccactaactctcaggttcgttgggaatactgtaaaattccttcatgcgattcgagccccgtgtccacggagcagctggccccgaccgccccaccagagctaacccccgtggttcaggactgctaccacggcgatggccagagttatcgtggcacaagttctacaacaactacggggaaaaaatgccagtcttggtcaagcatgactcctcacaggcatcagaaaactcccgagaactaccctaacgccggtctcacaatgaactattgcaggaaccccgacgccgataagggcccatggtgctttaccacggatccatcggtccgctgggaatactgcaacctgaagaagtgttctgggaccgaagcctcagttgttgccccccctcccgtggtgctccttcccgatgtggagacaccatctgaggaagattgtatgttcggcaacgggaagggctatcgcggcaaacgagcaacaacagttaccgggactccttgtcaggattgggccgcgcaagaacctcaccgacacagtatcttcacccctgagacaaatcccagggcaggccttgaaaaaaattattgtcgaaatcccgatggtgacgtgggtggaccatggtgttacactaccaatcccaggaaactatacgattactgcgatgtgccgcagtgcgcagccccctcgttcgattgtgggaaaccacaagttgagccaaagaaatgtcccggccgagtagtgggcggctgcgttgcgcacccgcactcttggccctggcaggtaagcctgaggactagatttggcatgcatttctgtggggggacccttatttccccagaatgggtgcttacggccgctcattgcttggagaaatctccccggccgtccagttacaaggttatccttggcgctcatcaagaagtgaacctggagcctcacgtgcaagagatagaagtgtcccgactgtttctggagccaacgaggaaagacatcgcccttctaaaactttcgagccctgctgtgataaccgataaggtaatcccagcttgtttgccgtcaccgaattatgtggtcgccgacaggacagaatgtttcatcactggctggggcgagacacaggggacatttggcgccggcttgctcaaggaggcccagctgcctgtgatcgagaacaaggtgtgtaacagatacgaatttcttaatggccgagtgcagtctacagaactgtgtgccggacatctggcagggggaaccgattcatgccagggagattcgggtggtccactggtgtgctttgagaaggacaagtacatccttcagggagttaccagctgggggctgggctgcgcccgacccaataaaccgggagtgtacgtgagggtctcgagatttgtgacctggattgaaggagtgatgcgcaataat

SEQ ID NO: 250928 - DNA, 2430 bp, Artificial Sequence
  Description of Artificial Sequence: Synthetic coding sequence
atggaacataaggaagtcgtgctcctgcttctgctgtttctcaaatctgggcaaggtgagccccttgacgattacgtcaacacccagggagcatcgcttttttccgtgaccaaaaagcagctcggtgcaggctcgatcgaagagtgtgccgcaaaatgtgaagaagatgaagaattcacttgtagagcattccagtaccattccaaagaacaacaatgtgtgatcatggcagaaaaccgaaagtccagcatcataattcggatgcgggacgtggtgctcttcgaaaagaaggtgtacctctccgaatgtaagaccggaaatggtaagaactacagaggtactatgtccaagactaagaacgggattacttgtcaaaaatggtcaagtacgtcacctcacagacctcgatttagccccgcaacgcacccttccgaaggcctcgaggaaaactattgtcgcaatccggacaatgatccacagggtccttggtgctacacgactgacccagagaagcgctacgattactgcgatatcctcgagtgtgaggaagaatgcatgcactgctcgggcgagaactacgatggaaagatcagcaaaactatgtccggactggaatgtcaggcttgggattcgcagtcgcctcatgcgcatggttacataccttccaaattccctaacaagaacctcaagaagaattactgtcgcaaccctgacagggaattgaggccatggtgttttacgaccgaccctaataagaggtgggaactgtgcgatatccctcgatgtactacccctcctccaagcagcggacctacctaccagtgccttaagggtactggcgaaaactaccgtggtaatgtcgcagtcacggtgtcgggacacacttgccaacattggtccgcgcagaccccgcatactcacaacagaacccccgagaactttccatgtaaaaacctggacgaaaactactgtaggaacccagatggaaagcgtgcaccatggtgtcatactactaactcccaagttaggtgggagtactgtaagattccttcttgcgactcttcgccggtgtcgactgaacaactggctccaactgcaccccccgaactgaccccagtggtgcaggattgctaccatggggatgggcagagctatcgtgggacctcctccactaccactactggaaagaaatgtcagagctggagctctatgactccccatcgacaccaaaaaaccccagagaattacccaaacgcgggccttaccatgaactattgcaggaacccagacgcggataaagggccttggtgctttactaccgacccaagcgtgagatgggaatactgcaatctcaagaagtgtagcggaaccgaagcgtctgtcgtggctcctccccccgtcgtgctccttccggacgtggagacgccttcggaggaggactgcatgttcgggaacggaaagggttaccgtggaaagcgagcaacgaccgtgaccggaactccttgtcaagattgggccgcacaagagccccataggcattcgatctttaccccggagactaaccctcgagcaggtttggaaaagaactactgtagaaatcccgatggagatgtaggtggaccttggtgctataccactaaccctcgcaagctgtacgattattgtgatgtgcctcaatgtgcagccccctccttcgattgtggaaaaccacaggtggaaccaaagaagtgtcctgggagggtcgtcggcggttgtgtggcccacccccactcgtggccatggcaagtatcactgcggaccaggtttggaatgcacttttgtggaggtactctgatctcgccagagtgggtgcttactgcagcacactgtcttgagaagagccctcgaccttcctcatacaaagttattctgggcgcccatcaagaagtcaacctcgaacctcatgtgcaagaaatcgaggtgtcaagactgtttctggaacctacccgtaaagatatcgcactgctgaaactttcctccccagccgtgattacggataaagtgatccctgcctgtctgcccagcccaaattacgtggttgcagatcgcaccgaatgctttatcactggctggggtgagactcaggggacgttcggagccggactgcttaaagaagcccaattgcccgtgatagaaaacaaagtgtgcaatcgatacgaatttcttaacggtcgggtccaatcgaccgaattgtgtgccggtcatctggcagggggcaccgacagctgtcagggtgattccggtggacccctggtgtgcttcgagaaagacaagtacattctgcaaggcgtcacctcctggggacttggatgtgcacgccccaataagccgggggtgtacgttcgtgtgtcgcgttttgtgacttggattgagggagtgatgagaaacaac

SEQ ID NO: 250929 - DNA, 2430 bp, Artificial Sequence
  Description of Artificial Sequence: Synthetic coding sequence
atggagcacaaagaggtggtgttgcttctcctgctttttctgaagtcgggtcagggagaaccacttgatgactacgtcaatacgcagggtgctagccttttttccgtcaccaagaaacaactgggtgcaggaagtatcgaagaatgtgccgcaaagtgtgaagaggacgaggaatttacctgcagagcattccaataccattcgaaagaacagcaatgcgtcattatggcagagaatagaaagtcatcgatcattatcagaatgcgcgatgtggtgctgtttgagaaaaaagtctatctctccgaatgtaagacgggcaatgggaagaattacaggggtactatgagcaagactaaaaacggaatcacttgtcagaagtggtcgtccacttccccgcataggccaagattttcaccagcaactcatccttcggaagggctggaggaaaactattgccgtaacccagataacgacccccaagggccatggtgctacaccactgacccagagaagcgatatgattactgtgacatactcgaatgtgaagaggagtgtatgcattgcagtggagaaaactacgacggtaagatttcaaaaactatgagtggactcgaatgtcaggcatgggattcccagtccccacatgcgcatggctacattccttccaaattcccaaacaagaatctcaagaagaactattgcagaaatcctgatagagaacttagaccgtggtgttttactaccgatcctaacaagaggtgggagctgtgtgatatccctagatgtactactcccccgccaagctcgggcccgacctaccagtgcctgaagggcaccggagagaactatagaggcaacgtggcagtcaccgtctcaggccacacttgtcaacactggagcgcacaaacgccacacacccataaccggactcccgaaaactttccctgcaagaacttggatgaaaactactgcaggaatcccgacggaaagagggcaccttggtgtcataccactaattcgcaggtgagatgggagtactgcaagattccatcctgtgatagctctcctgtgtcaaccgagcagctcgcccctacggccccgcctgagcttaccccagtggtccaagattgctaccacggagacggacagagctatcggggaacctcgtcgactactacgactgggaaaaagtgtcagtcgtggtcctcgatgaccccgcaccgacatcaaaaaacccctgaaaactaccctaacgcaggtcttactatgaattactgtcgcaacccggatgcagataaaggaccatggtgtttcaccaccgaccctagcgttcgatgggaatactgcaatcttaagaagtgttctggaaccgaagctagcgtggtggccccacctcctgtggtgctgctgccagatgttgagactccatcagaagaagattgtatgttcggtaacgggaaaggatacagaggtaagcgtgctaccaccgtgaccggtactccctgtcaagactgggcggcacaggaacctcatcgccacagcatctttactcctgaaacgaaccctcgcgcaggcctcgagaaaaactattgtagaaatcccgacggcgatgtaggcggaccttggtgctatactaccaatccacgcaagttgtacgattactgtgatgtccctcagtgcgccgcacctagcttcgattgtgggaagccgcaagtggaacccaagaagtgtccgggtagggtcgtcggaggctgcgtggcacatcctcattcatggccttggcaggtgtcccttcggacccgctttgggatgcatttttgtggcggtacgctcatcagccctgaatgggtgcttaccgcagcacactgccttgaaaaatcgcccaggcctagctcgtacaaagtgatcttgggagcgcaccaagaagtgaacctggaaccacatgtgcaagagatcgaagtcagcagattgttccttgaacctacccgcaaggacattgcactccttaagctgagcagccccgcggtcataactgataaggtcatccccgcatgccttcctagccctaattacgttgtggcagaccggaccgagtgcttcataaccggctggggtgaaactcaaggaactttcggagcaggactgcttaaggaggcacaactcccggtgattgaaaacaaggtgtgtaaccggtacgagttcctgaacggacgcgtgcaatccaccgagttgtgtgccggtcatttggcgggtggtaccgactcctgccaaggtgattcaggaggccccctggtgtgcttcgaaaaagataagtacatactgcagggcgtaaccagctggggacttggttgcgcaagacctaataagcctggtgtgtacgtgcgcgtgtcgaggtttgtcacttggattgaaggagtgatgcggaacaac

SEQ ID NO: 250930 - DNA, 2430 bp, Artificial Sequence
  Description of Artificial Sequence: Synthetic coding sequence
atggagcacaaggaagtggtcttgctgcttttactttttcttaaaagcggccagggcgaacccctcgacgactacgtcaacacccagggtgcgtcactgttttccgtgacgaagaagcagttgggggccgggagcatcgaagagtgtgcagctaaatgcgaagaggacgaggaatttacttgccgagcgttccagtatcactctaaagaacaacaatgcgtcatcatggctgagaatcgcaagagcagcatcattatccgaatgcgagacgtcgtcctgtttgaaaaaaaagtttatctttccgaatgtaagaccggcaacggtaaaaactacaggggcactatgagcaagaccaagaatgggattacttgtcagaaatggtcaagcacctcgcctcatcgcccccgtttctctcccgcaacacatccgtctgagggactggaagaaaactactgtcggaaccctgataacgatccccaaggcccctggtgttacacaacagatccagaaaaacgttatgattactgcgatattctggaatgtgaagaagagtgtatgcactgctccggagaaaactatgatggcaagatctcaaagactatgtccggtctggaatgccaggcctgggactcacaatctcctcatgcgcacggatatataccttcaaaatttccgaacaagaatcttaaaaagaattattgtaggaatcccgaccgggaactcaggccctggtgttttactaccgacccaaataagcgctgggagttatgtgacataccaaggtgtaccaccccccctccctcatcaggccccacttatcaatgcctgaaaggcactggcgagaattacaggggaaacgtggcggtcacagtgtctggccatacctgtcagcattggagtgcccagacgccccatacccataatcggacccctgagaactttccctgtaaaaacctagacgaaaactactgcaggaaccccgacggaaaaagggctccctggtgtcacaccacaaatagtcaggtgcgttgggaatattgcaagattcccagctgcgactcatcaccagtgtccacggagcagctcgcccctactgcccctcctgaactgactcctgttgtccaggactgctatcacggcgacggccagagctaccggggcacttcctctacgaccactaccggaaagaaatgtcaaagttggtctagtatgacaccacaccggcaccagaaaacaccagaaaattatcctaatgcgggcctcacaatgaactactgtcgcaatccagatgctgacaaaggcccctggtgctttactacagatccctccgtcaggtgggagtattgtaacctgaagaaatgctctggtacagaggcatcggtggtggctccaccccctgtagtgcttcttccggatgtggaaacaccatcggaagaggactgtatgttcggaaatgggaaaggctatagggggaaacgtgccacaaccgtgaccggcactccttgccaggactgggcagcccaggagcctcaccgccattcaatatttacgccagagaccaatccgagggcaggattggagaagaactactgtagaaatcctgacggtgacgtcggcgggccctggtgctacacgactaatccacggaagttgtacgattactgtgatgtgccccagtgtgcggccccgtcatttgattgcggaaagccccaggtggagccaaagaaatgccccggaagagttgtgggcggctgtgttgctcaccctcattcttggccctggcaggtgtcattgcggactagattcgggatgcacttctgcgggggcaccctcatctcacctgagtgggttctaaccgccgcccattgcctcgaaaagagccccaggcccagctcctataaggtcattttaggcgctcaccaggaggttaatctggagcctcacgtgcaggagattgaggtatcccgcctgttcttggaaccgacccggaaagatattgccctgctaaagctgtcttcgcccgccgtaatcacggataaagtcatccctgcttgtcttccaagcccaaattacgtggtggctgacagaaccgagtgcttcatcacaggttggggcgaaacgcagggaaccttcggtgccgggctccttaaggaggctcaactgcctgtgatcgagaataaagtgtgcaaccgatacgagttcctgaatggccgtgttcaatctacagaactctgtgctgggcatctagctggaggcactgattcctgccagggcgattcaggaggccctctggtgtgtttcgagaaggataagtacatcctgcagggggtaaccagctgggggctcggctgtgctagacccaacaaaccgggcgtatatgttcgtgtatcccgctttgtaacttggatcgagggggttatgcgtaataac

SEQ ID NO: 250931 - DNA, 2430 bp, Artificial Sequence
  Description of Artificial Sequence: Synthetic coding sequence
atggaacataaggaggtcgttctgctgctcctgctgttcttaaagagcggccaaggcgagccactagatgattacgtaaatacccagggcgcttctcttttcagcgtcaccaagaaacagctgggagccgggtctattgaggaatgcgccgccaaatgcgaggaagacgaggagtttacctgtcgtgccttccagtaccattcaaaggagcagcagtgcgtcatcatggcagaaaatcgtaaatcctccatcattattcgtatgagagacgtggttctctttgagaagaaggtctatctgtcagagtgcaagacaggtaacggcaaaaattacaggggtactatgtctaaaacaaaaaacggcatcacctgtcaaaagtggagctccacaagcccccaccggccacggttttcccccgcgacacatccatccgagggccttgaggaaaactattgcagaaatccggataatgacccacagggaccatggtgctacaccacagatccagagaaacgctatgactactgcgatattctggagtgcgaagaagaatgcatgcattgtagtggcgagaactatgacggcaaaatatctaaaacgatgtccggcctcgaatgccaggcttgggatagccagtctcctcacgctcatggttacatccctagcaagtttcctaataagaacctgaaaaagaactactgccgcaatcctgatagggaactccgcccttggtgtttcacaaccgacccgaacaagaggtgggagctatgcgacatccctagatgcactaccccccccccgtcgagcggacctacatatcaatgcctgaaggggaccggagagaattataggggtaacgtggccgtcacggtgtcgggacatacctgtcagcactggtcagcccagacgcctcacacccacaacagaacaccagagaatttcccctgcaaaaatctggacgaaaattattgccggaaccccgacgggaaacgcgccccatggtgccacacaacgaattcacaggtgaggtgggagtactgtaagataccctcttgtgactctagcccagtgtctacagagcagttagcacccaccgccccccctgaactgaccccggtggttcaggactgctaccacggagatggacagagctaccgggggacatctagtactaccaccactggcaaaaaatgccagtcatggagctcaatgacacctcaccggcaccagaagacaccagagaattacccaaatgccggattgacaatgaattactgtaggaaccctgacgcagacaagggcccatggtgctttactaccgatccatctgttcgatgggagtactgcaacctgaagaagtgttctgggaccgaggctagtgttgtcgccccgccgcccgttgtgctgttgcctgacgtggagacacccagcgaggaggactgcatgttcggcaatgggaagggctaccggggaaaacgggccactacggtcaccggaaccccatgccaggattgggcggctcaggagccgcacagacactcaatctttactcccgagaccaacccccgggccggcctggagaagaactactgtaggaatccagatggagatgtgggtggtccctggtgttatacaacaaaccctaggaagctctacgactactgcgatgtgcctcagtgcgctgcaccctccttcgactgtggaaagcctcaggtcgagcccaagaagtgcccagggcgggtggtgggaggctgtgtggcgcatcctcacagctggccgtggcaggtgtccttgcgcaccagatttgggatgcacttttgcggcggcacattgatcagccctgaatgggtcctaaccgctgcccactgccttgaaaaatcacctcgaccttcttcctataaggtgatcctgggcgcacatcaagaggtcaaccttgagccacatgtgcaggaaatcgaggtgagcagactctttttggagcccacacgcaaggatatcgcccttctgaagttgtcctctccggctgtgattaccgataaagtgatccccgcttgccttccttcaccaaattatgtcgtagcggaccggactgagtgctttataacaggatggggcgagacacagggaaccttcggagccggtctactgaaggaggcccagttgcccgtgatcgagaacaaggtatgcaaccggtatgagttcctgaatggccgggtacaaagcaccgagctgtgcgcaggacacctagcagggggaactgacagctgccagggcgacagcggagggcctctggtgtgtttcgaaaaagacaagtacatccttcagggagtgacttcctggggcctcggatgcgcccggccaaacaagccgggtgtgtacgtgcgtgtaagtcgattcgtcacatggattgagggggtgatgcgcaataat

SEQ ID NO: 250932 - DNA, 2430 bp, Artificial Sequence
  Description of Artificial Sequence: Synthetic coding sequence
atggaacataaggaagtggtgttgctgctgctcctttttctgaagtcaggacagggggagccattggatgattacgtcaatacccaaggggcatcccttttttccgtgaccaaaaagcaacttggagcagggtccatcgaagagtgcgcagccaagtgtgaggaagatgaagaatttacttgccgcgcatttcaataccattcgaaggaacaacagtgcgtcattatggcagaaaacagaaagagctcgataatcatcagaatgcgagatgtcgtgctgtttgagaagaaagtctacctctccgaatgcaaaactggcaatggcaagaattaccggggtaccatgtccaaaaccaagaacggcattacttgtcagaagtggtcatccaccagcccacatcgcccacgcttcagccccgctacgcatccatccgaaggtctggaggagaattactgtagaaaccccgacaatgatccccaggggccatggtgctacacgactgatccagaaaagaggtacgactactgcgacattctcgaatgcgaggaggaatgtatgcattgttcgggagagaactacgatggtaagataagcaagactatgtccggacttgaatgccaggcatgggattcacagtctccacacgcccatggatacattccgtcaaagtttcccaacaagaatctgaagaaaaactactgtaggaacccagaccgggaacttcgcccttggtgttttaccaccgaccccaataaacgatgggaactttgtgatattcctagatgcaccactcctcccccctcatcgggaccgacctaccaatgtctgaagggaaccggagaaaactaccgaggcaacgtggcagtcacggtatctggacatacgtgtcagcattggtcggcgcagaccccacatacgcataatcgaacgcctgaaaacttcccctgcaagaatcttgatgagaactattgtcggaatcccgacggtaagagagcaccctggtgccacactacgaattcacaagtcaggtgggaatactgcaaaattccgagctgtgatagctcccccgtcagcaccgaacaactcgcacctaccgcgcccccggaacttacccctgttgtgcaagattgctaccatggtgacgggcagtcctaccgtggaacctcctcgaccactaccactgggaagaaatgccaaagctggtcgagcatgactccacaccgtcaccaaaagacccccgaaaactacccaaatgcaggactcaccatgaactattgtagaaacccggatgctgacaaaggtccgtggtgtttcactaccgatcccagcgtgagatgggagtactgcaacctcaagaagtgctccggaaccgaggcctcagtagttgcgccaccaccagtggtcctcctgcccgacgtggaaaccccatcagaagaagattgtatgttcggaaacggaaaaggctaccgcgggaaaagagcgaccacggtgaccggtaccccttgtcaggattgggcagcacaagaacctcaccggcattcaattttcactccggaaactaaccccagagcaggattggaaaagaactattgccgaaatccagatggtgatgtcgggggtccatggtgctatactacgaaccctcggaaactctacgactactgtgatgtgccccaatgtgcagccccctcatttgactgtggaaaaccccaggttgaaccgaagaaatgtcctggtagggtggtgggtggttgtgtcgcacatcctcattcatggccctggcaggtgtcgctcaggaccagatttggtatgcacttttgtggaggaaccctcatttcccctgagtgggtcctgaccgccgcacattgtcttgagaaatcccctcgaccgtccagctacaaagtgattcttggtgcccaccaagaagtgaaccttgaaccacacgtccaggaaatcgaggtgtccagattgttccttgaaccaacccgaaaggatattgcccttctgaaactgtctagcccggctgtgattactgataaagtgatcccagcttgccttcctagccctaactacgtcgtcgccgatcggactgaatgctttatcactggttggggtgaaactcaagggacttttggggcaggacttctcaaagaagcgcagcttcctgtcatagagaacaaagtgtgtaatcgctacgaatttctgaacggccgcgtccaaagcacggaactgtgtgccggacaccttgcgggaggaactgactcatgccaaggagattcgggaggaccgcttgtgtgctttgagaaggataagtacatcctccagggggttacctcctgggggctgggctgcgcgcgtcctaacaagcctggagtgtacgtccgtgtctccaggttcgtgacttggattgaaggtgtgatgcgcaataac

SEQ ID NO: 250933 - DNA, 2430 bp, Artificial Sequence
  Description of Artificial Sequence: Synthetic coding sequence
atggagcacaaggaggtggttctcttgctgttgctctttttaaagtcaggtcagggggaacccctcgacgattatgtcaacactcagggagccagcttgttcagcgtgaccaagaagcagctgggtgcgggttctattgaagaatgcgcagctaagtgcgaggaagatgaggaattcacctgcagggcatttcaatatcactctaaagagcagcagtgcgtgatcatggcagagaacaggaagagctccataataatccgaatgagagacgttgtgctgttcgagaaaaaggtatatctgtccgagtgcaagaccggtaacggcaagaattatagaggaacgatgagtaaaaccaagaatggcataacctgccagaagtggagttccacatcacctcacagaccaagattctctccagcaacccacccctccgagggactggaggagaactactgtcgcaatccggataacgaccctcaagggccctggtgttatacgactgatcctgaaaagaggtacgattattgtgatatcttggagtgcgaagaagaatgtatgcactgtagcggggaaaattatgacggcaaaatctccaaaaccatgagcggtttggagtgtcaagcctgggatagccagagcccacatgctcacgggtatattcccagcaaattcccaaataagaatttgaagaagaactattgtcgtaatcccgacagggagctgagaccatggtgttttaccacagacccaaataagcgatgggagctgtgtgatattccaaggtgtacaacgccccctccaagcagcggccctacatatcagtgtcttaagggaacaggggagaattatcggggtaacgtggctgtgactgtcagtggacatacatgtcagcactggagtgcacaaactccgcacacacacaatagaacaccagagaatttcccttgcaagaacctagatgagaattactgtaggaaccctgatggaaagagagctccctggtgtcatacaactaacagccaggtaagatgggaatactgtaaaattccctcctgcgacagcagtccagtctccacagaacaattggcccctacagcaccccccgagctgaccccagtggtccaggattgctaccatggggatggccagtcctatcgcgggacaagtagtaccacgacaactggcaaaaaatgtcagtcttggtctagcatgaccccgcatcgacaccaaaagacccccgaaaactatcccaatgctgggctgacaatgaactactgtcgtaatccagatgccgataagggtccttggtgtttcacaacggatccatccgtgagatgggagtactgcaatttgaaaaagtgcagcggcaccgaagcttccgtggttgctcctcctcctgttgttctactcccagacgtggagacaccctccgaggaagactgtatgtttggcaacgggaaagggtaccggggtaagcgggctaccacggtgaccgggacaccttgtcaggattgggcagcacaggagccacatcgtcattccattttcacacccgaaacaaaccctagagccggtctggagaagaactactgcaggaatcctgatggcgacgtgggaggcccttggtgctacacaacaaatccgaggaagttgtacgattattgtgacgtgccgcaatgcgccgcgccctcatttgactgtggtaaaccacaagtcgagcctaagaaatgcccgggccgagtagtaggcggatgtgtggcccacccccactcgtggccctggcaggtgtctctaaggacacggttcggcatgcatttctgtggtggaactttgatttctcccgagtgggttctgaccgccgcgcactgcttggagaaatccccccggccctcctcctacaaggtgattctcggcgcacaccaggaggtcaatctcgaacctcacgttcaggagattgaagtttctcgcctcttcctcgaacctacgcgaaaggatatcgctctgctcaagctctcatcccccgctgttattacggacaaagtcattcccgcatgcctgcctagcccaaactacgttgtggcagaccggaccgaatgtttcattacagggtggggggaaacgcaaggcaccttcggtgcagggttgctcaaagaggcccagctcccagttatcgaaaataaggtgtgcaatcgctatgagttcttgaacggcagagtccagagtaccgaactatgtgctggacatctcgcaggcggcacagattcttgtcagggtgactcaggtgggccactcgtctgttttgaaaaagataagtatatcctgcagggtgtgaccagttgggggttagggtgcgcgcggccaaataaacccggcgtgtatgtcagggtgtcgagattcgttacatggatcgagggagttatgaggaacaac

SEQ ID NO: 250934 - DNA, 2430 bp, Artificial Sequence
  Description of Artificial Sequence: Synthetic coding sequence
atggagcacaaagaagtagtgcttcttttgctgctgttcttgaagtccggccagggagagccactcgatgactatgtcaatacccagggcgcctcactgttttctgtgaccaagaaacagctgggtgctggcagcatagaagagtgcgccgccaaatgcgaagaagatgaagaattcacttgtagagcatttcagtatcacagcaaagagcagcagtgtgtgatcatggctgaaaataggaaaagctccataataatcaggatgcgcgacgtcgtgctctttgaaaagaaggtgtatttatctgaatgcaagaccggaaacgggaagaattacagggggacaatgtcaaagactaagaacggcataacttgccagaaatggtcctccactagcccccaccgtcctcggttctccccagcaactcacccaagcgaaggactggaggaaaactactgtcgaaaccctgacaatgatcctcagggtccatggtgttataccacagacccagagaaaagatatgactactgcgatatcttggagtgcgaagaagagtgcatgcattgctcaggtgagaattacgatgggaagattagcaagacaatgagcggtctagaatgtcaagcctgggactcccaaagtccccacgcacatggatacatccccagcaaattcccaaacaaaaatttaaagaaaaactactgtcgtaaccccgaccgggagctcagaccttggtgcttcactacggacccaaacaaacggtgggagttatgcgacattcctagatgtactactcctcctcccagttccggcccgacttatcagtgtctgaaggggactggtgagaactaccgaggaaatgttgcagttacagttagcggccatacgtgtcagcactggtccgcacagactccgcacacccacaatcgaactccggagaacttcccatgtaagaatctggacgagaattactgtaggaatcccgatggcaaacgcgctccatggtgccacacgacgaattcccaggtgcggtgggagtactgcaagatcccatcatgcgattccagtcccgttagtaccgagcagttagcccctactgcaccccccgagctcactcctgtcgtgcaggactgctaccacggcgatgggcaaagctatcggggtacctcctcaacaacaaccacgggaaaaaaatgccagtcttggtcgagtatgaccccccatcgtcatcagaagacacctgaaaactaccccaatgccggattgaccatgaattattgcaggaaccccgatgccgataaggggccatggtgttttactaccgacccctcagtgcgatgggagtattgcaacttgaagaagtgctcgggtacggaggcatctgttgtagcccctcctcctgtggttctgctgccagatgtagaaacaccaagtgaggaggattgcatgtttggaaatgggaaggggtatcgaggaaagcgggcgacaacggtgaccggtacaccatgccaggattgggcggcccaggaaccccaccggcacagtatctttacgccggagacgaatccaagagcaggcctggaaaaaaattactgtaggaatccagacggtgacgttgggggaccatggtgctataccaccaatcctcgcaagctgtacgattactgtgatgtgccgcaatgcgctgccccatctttcgactgcggcaagcctcaggtcgagccgaagaagtgtcctggacgagttgtcgggggatgcgttgcacacccacacagctggccctggcaggtctccttgaggacccggtttggcatgcacttctgtgggggtacgctgatctctccagaatgggttctcactgcagcgcattgcctagagaaatcaccaagaccttcaagctacaaggtgatcctgggtgcgcaccaggaggtcaacctggaacctcacgtccaagaaatcgaagtctcaagactcttcctagaacccaccaggaaagatatcgcgctgctaaaactgtcttcgccggccgtgatcaccgacaaggtcatccccgcgtgtctccccagcccaaactacgtggtcgcagataggacagagtgtttcataacggggtggggggagacccaaggaacctttggggcggggctgctgaaggaggcccagctgcctgtgattgagaataaagtatgcaaccgatacgagttcctgaacggccgagtgcagagtacggagctgtgtgcaggccatcttgccggagggacggacagttgtcagggcgatagcggggggcctcttgtgtgctttgaaaaggacaagtacattcttcagggtgtaacctcatggggccttggatgcgctcggccaaacaagcctggcgtatacgtgagggtttccagattcgtgacctggatcgaaggcgttatgcgaaacaac

SEQ ID NO: 250935 - DNA, 2430 bp, Artificial Sequence
  Description of Artificial Sequence: Synthetic coding sequence
atggagcataaggaagtcgtgctcctcctgcttctattcctcaagtccgggcagggagagccacttgacgactacgtgaatacccagggggcttcattgttttccgttactaaaaaacagctgggagccggatccattgaggaatgtgcggctaaatgcgaagaggatgaagaattcacatgtagagcgttccagtatcatagcaaagaacagcagtgcgtgattatggctgagaataggaagagttcgataatcatccgaatgcgcgacgtagtgctatttgagaaaaaagtgtacctgtcagagtgcaaaactgggaatgggaagaactaccgtggcaccatgagtaagaccaaaaatggcattacttgccagaaatggtcctctacatctccccacaggcccagattcagccctgcaacacatccttctgagggtttggaagagaactactgtcggaatccggacaacgatccacagggcccatggtgttacacaacggatcccgaaaagagatacgactactgtgacatccttgagtgtgaggaggagtgcatgcactgctcaggcgaaaactacgatggaaaaatttcaaagactatgtccggtctcgaatgtcaagcctgggattcccagagcccgcacgctcacgggtatatcccttcaaagtttccgaacaaaaatttgaagaagaattattgccggaatcctgatagagagctccgaccgtggtgtttcactacagaccctaataagaggtgggagttgtgcgacattccgaggtgcacaaccccgcccccgtcttccgggcccacctatcagtgccttaagggcaccggcgagaactacagagggaatgtggccgtaaccgtgtcggggcacacctgtcaacactggtctgcgcaaacccctcatacgcacaacagaacgccagagaactttccctgcaaaaatctcgacgagaactactgcaggaaccccgatggcaagagagcaccttggtgtcatacaaccaattctcaggtacgttgggagtactgtaaaatcccctcttgtgactcctctccagtgagcaccgagcagctagccccgacagcacccccagaactaacgcccgtagtccaggactgttatcatggcgatggccagtcttatcgtgggacttcatcaacgactaccacaggtaagaagtgccagtcttggtcatccatgacgccacataggcatcagaagacacctgagaactaccccaatgccggtctcacaatgaattactgccgaaatccggacgcagacaagggaccatggtgcttcacgacagatccttctgtcaggtgggagtattgtaatctcaagaagtgttctgggactgaagcatctgtggtggcccctccgcctgtggtactgctcccagatgttgaaactccttctgaggaggactgcatgtttggaaatggaaagggctatcgtggcaagagagcaaccacggtgactggaacgccctgtcaagattgggcggcccaggaaccacatcgtcacagcatcttcacaccagaaactaacccacgcgcaggcctggaaaagaactattgtaggaaccctgatggagacgttggcggaccgtggtgttacacaactaacccgcggaaactctacgattattgcgacgtgccccagtgcgccgccccgtccttcgactgtggaaaacctcaggtggagccgaaaaagtgcccagggagagtcgtaggtgggtgtgtggctcatccacattcatggccatggcaagtgtctctgagaacacggttcggtatgcacttctgtggaggtactctgattagccctgaatgggtgcttaccgccgcccattgtctggaaaagtccccgaggccttcaagctacaaagtcatcctgggagcgcaccaagaggtgaacctggagccccacgtacaggaaatcgaagtgagccggctgttcctggaacccaccaggaaagatattgcactcctcaagctgtcatcccccgctgtcattacggacaaggtcatacctgcctgcttaccgtcccctaattatgtcgttgccgatcgcactgagtgcttcatcactgggtggggagagacgcaaggtactttcggggccggccttttaaaggaagcacaactccccgttatcgagaataaagtttgtaaccgctacgagtttctgaacgggcgcgtgcaaagtacagaactctgtgcgggccacttggcgggaggtaccgatagttgtcagggagattctggaggcccacttgtttgtttcgagaaagacaagtacatcttacagggagttaccagctgggggctgggttgtgctaggccaaacaaacccggggtgtacgttagggtgtctaggttcgtgacctggattgaaggagtaatgagaaacaat

SEQ ID NO: 250936 - DNA, 2430 bp, Artificial Sequence
  Description of Artificial Sequence: Synthetic coding sequence
atggagcacaaggaagtagtactcctcctcctgctgttcctgaaatcaggccagggcgaacctctcgatgactacgttaacactcagggagcttcgttgttttccgtgaccaaaaaacaactgggagcggggtccatcgaggaatgcgccgccaagtgtgaggaggatgaggaattcacctgtagagccttccaataccacagcaaggaacagcaatgtgtgatcatggctgaaaaccggaaaagcagcataatcattcggatgcgcgatgtggtgctgttcgagaagaaggtgtatctgagcgagtgcaaaacggggaacggcaagaattacaggggaactatgtcgaaaactaagaatggcattacttgccagaaatggagcagtacttccccacatcgaccgcggttttccccagcaacccacccgtctgagggtctggaagaaaactactgcagaaaccctgacaatgacccgcaaggtccatggtgttacaccactgatcctgaaaagcgatacgattattgtgatatcctcgaatgtgaagaagagtgcatgcattgttcgggagagaattacgacggcaaaatcagcaagactatgtcggggctggaatgtcaagcctgggactcgcagagcccccatgcccacgggtatatcccttccaagtttcctaataagaatctgaaaaagaactactgccgcaatccggaccgcgagctccggccttggtgcttcactactgatccgaataagagatgggaactgtgcgacatcccccgttgtaccactcctcccccgtcgtcaggtccaacctaccaatgcttgaaaggaaccggtgagaactacagggggaacgtggcagtgactgtgtcgggtcatacttgccagcattggtccgctcaaactccacacacccataacagaacccctgaaaacttcccgtgtaagaatctggatgagaattactgcaggaaccctgacgggaagcgcgctccctggtgccacaccactaatagccaggttagatgggagtactgtaaaatcccatcctgtgactcgtcgcccgtctccaccgagcagctggcaccaaccgctccgccggaactcacgcccgtggtgcaagactgctaccacggagacggacagtcctaccgcgggacttcatcgactaccacgaccggaaagaagtgccagagctggtcctcgatgaccccgcaccgacaccagaaaacccctgagaattatcctaacgccggcctcactatgaactactgcaggaatccagatgcagataagggaccgtggtgcttcaccaccgacccaagcgtgcgctgggagtactgcaatttgaagaagtgcagcgggacggaagcgtcagtggtggcgccgccgccggttgtgctcctccctgacgtcgaaactccgtcggaggaagattgcatgttcggaaatggtaagggatatcggggtaaaagagcgaccaccgtcaccggcactccgtgccaggattgggccgcgcaggagccccaccgccattcaatctttaccccagaaacgaaccctagagccgggctcgagaaaaactactgtcgaaaccctgatggcgatgttgggggaccatggtgctataccaccaacccgcggaagctctacgactactgcgacgtgccgcaatgcgctgcgccgtcatttgactgcggaaaaccccaggtggaaccaaagaagtgccccggacgggtcgtggggggttgtgtcgcccacccgcattcatggccatggcaagtgtcgctgcggacccgcttcggaatgcacttctgtggaggcactcttatcagccccgagtgggtcctgaccgccgcacactgcctggaaaagagccctcgcccgtcgagctacaaggtgatcctgggtgcccatcaggaggtcaatctcgagccgcatgtgcaggaaatcgaggtgtctaggcttttcctcgaaccaactcgcaaggacatcgcgctcttgaaactctcatcgcccgcggtcatcacggataaggtcattcctgcgtgcctgccaagcccaaactacgtggtggcagacaggacggagtgcttcatcaccggctggggagaaacccagggaactttcggcgccggtctgctgaaggaggcccagctccccgtgatcgaaaacaaagtttgtaaccgatatgaattccttaacgggcgcgtccaatcaaccgagttgtgcgctggccacctcgctggcggaacggattcgtgccagggcgactcaggcggccccctggtctgcttcgaaaaggacaagtacattctgcagggtgtcacctcatggggcctgggctgcgcacgcccaaacaagccgggagtctacgtgagggtgtcccgctttgtgacttggatcgaaggggtaatgcggaacaac

SEQ ID NO: 250937 - DNA, 2430 bp, Artificial Sequence
  Description of Artificial Sequence: Synthetic coding sequence
atggagcataaggaggttgttcttctcctgctccttttccttaagagcggacaaggggaacctctcgacgattacgtgaacactcaaggcgcatccctcttcagcgtcacgaagaagcaactcggagcaggctcgattgaggaatgcgcggcaaaatgcgaggaagatgaagaattcacttgtcgagcgtttcagtaccattccaaggaacaacagtgcgtgataatggcagagaaccgcaagtcatccatcatcatcagaatgcgcgatgtggtgttgtttgaaaagaaagtgtacctctccgagtgcaagactggtaatggtaagaattacaggggaactatgtcgaaaactaagaatggtattacttgtcagaagtggtcgtcgaccagccctcaccggccccggttttcccctgccacccatccatccgaaggacttgaggaaaactattgcagaaatccagataacgacccccaaggaccatggtgttacaccaccgatcctgaaaagcgttacgattactgtgatatacttgagtgcgaagaagagtgtatgcattgttccggagagaattacgatggaaaaatcagcaaaaccatgtccggactcgagtgtcaggcatgggactcgcagtctcctcatgcccatgggtacattccttccaagttcccaaacaagaatcttaagaaaaactactgtaggaacccggatagagaactgaggccctggtgctttactactgacccaaacaagaggtgggagctgtgcgacattcctcgctgtactactccacccccttcaagcggacccacctatcagtgtctcaagggtactggagaaaactaccggggaaatgtggcagtgaccgtgtcagggcacacctgccaacattggtcggcacaaaccccccatacccacaacaggacgcctgaaaactttccctgcaagaaccttgacgagaactactgtagaaaccctgacggaaagagagctccttggtgtcatacgaccaatagccaggtccgttgggagtactgcaagattccttcatgcgacagctcccccgtgtcaaccgaacaactggcaccaacggcaccaccagaacttactccagtggtgcaggattgttaccacggagacggacagtcataccggggtacgtcatcgaccaccaccaccggcaagaaatgtcaatcatggtcctccatgactcctcatagacatcaaaagactcccgaaaactaccctaacgctggccttaccatgaactactgtcggaatcctgatgccgataaggggccttggtgtttcaccactgacccaagcgtacgctgggaatactgtaacctcaaaaagtgctctggtactgaggcctccgtggtggcaccacctcctgtcgtgctcctccccgatgtcgagactccatccgaagaagattgtatgtttggaaatgggaaggggtaccgtggtaaaagagccactactgtcaccggaacgccctgtcaagactgggctgcgcaggaaccacacaggcatagcatctttactccagagactaacccccgcgcaggtctggaaaagaactattgtaggaaccctgacggggacgtgggtggaccttggtgttacactacgaacccacgaaaattgtacgactactgcgacgtgccacaatgtgccgcaccatcctttgactgtggaaagcctcaagtggagccaaagaagtgtcccggtcgcgtggttggaggttgtgtggcgcacccacattcgtggccctggcaggtgagccttagaacgcgctttggtatgcatttttgtgggggaactctgattagcccagaatgggtgctcaccgcagcccactgtcttgaaaagtcgccacggccttcctcgtacaaggtgattctgggcgctcatcaagaggtcaaccttgagccacacgtgcaagaaattgaggtgtcacggctttttcttgaacctacccgcaaggatatagcgcttttgaaactgtcctcgcctgccgtgattaccgataaggtgatccctgcgtgtctgccttcaccaaattacgtggtggcagatcgcaccgaatgctttatcaccggatggggcgaaacccaaggaaccttcggtgccggtctgcttaaagaggcgcagctgcccgtcatcgaaaacaaggtgtgtaaccggtacgaattccttaacggccgcgtgcaatctaccgaactttgtgcaggccatcttgcaggtggcactgactcatgtcagggggattccggaggacccctggtctgttttgagaaggacaagtacatcctgcaaggagtgacttcctggggacttgggtgtgcaagaccgaacaagcctggagtgtacgtgcgagtctcgcgtttcgtgacctggattgaaggggtgatgcggaacaac

SEQ ID NO: 250938 - DNA, 2430 bp, Artificial Sequence
  Description of Artificial Sequence: Synthetic coding sequence
atggagcataaagaggtcgtgctcctactgttgttatttcttaagtcaggtcaaggagaaccacttgatgattatgttaatacgcagggcgcatctctgttttccgtgactaaaaaacaattaggggcaggctcaattgaagaatgtgctgcaaaatgtgaggaagatgaagaattcacgtgccgtgcgtttcaatatcatagcaaagaacagcaatgcgtcatcatggctgaaaacagaaagtccagtatcataattcgcatgcgggacgtggtgctgtttgagaaaaaggtttacctgtccgaatgcaaaacaggaaatggtaaaaactacagaggaacgatgagtaaaacaaaaaatggaataacgtgtcaaaaatggtcttcgacatctccgcaccgcccaagattttcgccggcaactcatcctagcgaaggcctggaagaaaactactgcagaaatccagataacgatccgcagggaccatggtgttacacgacggatcctgaaaaaaggtacgactactgcgatatattagaatgcgaggaagagtgcatgcactgctcaggagagaattatgatgggaagattagtaaaacaatgtcaggcttagaatgccaagcctgggactcccagtcacctcatgcccatggttatatcccctcaaaatttccgaataaaaatctgaaaaaaaactattgtagaaatccggatcgcgagctacgtccgtggtgctttacaactgatccaaacaaaagatgggaactgtgtgacatccctcgttgtacgacgcctccgccgtctagcggacctacttatcaatgtttgaagggaacgggagagaattatcgcggcaacgtagcagtcactgtatccggtcatacttgccagcattggtctgctcaaacacctcacactcataatcgtacccccgagaactttccctgcaaaaatctggatgaaaactactgtcgtaaccctgacgggaagagggcaccgtggtgtcatacaacaaattctcaggttcgttgggaatattgcaaaataccgagctgcgatagctcacctgtatcaacagaacaattagccccgacggcgccacccgaactgacccctgtcgtccaggattgttaccacggcgacggacaaagctaccgtggcacgtcctcaacaacgacgacagggaaaaaatgtcagagctggagctcgatgacaccacatcgccatcaaaaaactcctgagaattatccaaacgcgggtctgactatgaactattgtcggaatccggatgctgacaaaggcccatggtgttttacaacagatccgtcagtgcgttgggaatattgtaatctgaaaaaatgcagcggcaccgaggcctctgttgtcgcgcctccacctgttgtgcttcttcctgacgtggaaactccgtctgaggaagactgtatgtttggaaatggaaaagggtatcgaggcaagcgcgcgaccacagtgacgggcacgccatgccaagattgggccgcacaggaaccgcatcgccatagcatcttcacaccggaaacaaatccacgcgccggtctggaaaagaattactgtcgtaacccggacggagatgtgggcggcccttggtgctatacaaccaatcctcgcaaattgtatgactattgtgacgttccacaatgcgccgcaccgtcatttgattgtggcaaacctcaggtcgagccgaaaaagtgccccggccgcgtcgtcggcggctgtgtggctcacccacattcatggccatggcaagtctcactgcgtactcgttttggcatgcacttttgcggtggcacattaatttcgccggaatgggtcttaacagcagcccattgcctggaaaagtctccgcgccctagttcctataaagtcatcctgggagcacatcaggaagttaatctcgagcctcatgtgcaagaaatagaagtgtctcgattatttcttgaaccgacgagaaaggatattgcactgctgaaattatcctcccccgcggttataacagataaggtgataccagcgtgtctgccgtcaccgaattatgttgtggcggatcgcacggaatgctttattacgggatggggagaaacacaaggcacgtttggtgcaggtcttttaaaggaggctcaattgccggtcatcgagaacaaagtttgcaatcggtatgaatttcttaacggccgcgttcagtcaacagaactttgcgcaggtcaccttgccggcggtacagattcgtgtcagggcgattcaggtggcccattagtttgtttcgaaaaggataagtacatactgcagggagtgacgtcatgggggttaggctgcgcccgtcccaataaaccaggagtatatgtaagagtgagccgctttgtgacgtggatcgagggagtcatgcgcaataat

SEQ ID NO: 250939 - DNA, 2430 bp, Artificial Sequence
  Description of Artificial Sequence: Synthetic coding sequence
atggagcataaggaggtggttctactcttactcctttttctgaaatctggccagggtgaacccctggacgactatgtgaacacccagggagcaagcctgttttctgtgaccaagaaacaactgggcgctgggtcgatcgaagagtgtgcagccaagtgcgaggaggatgaggaatttacatgccgggcatttcagtaccactccaaagagcagcagtgtgtgatcatggccgagaatcggaaatcctccataatcatccggatgagggatgtcgtcctctttgagaaaaaagtttacttgagcgaatgtaagacaggcaacggcaaaaattatcgagggacaatgagcaagacaaaaaacggaatcacctgccagaaatggtcgtctaccagcccgcacagacctcgcttcagtccagccacccatccttctgagggcctcgaggaaaactactgcagaaatcccgataacgacccccaaggtccttggtgctacaccactgatccagagaagcgatacgattactgcgacattttagagtgcgaggaggagtgcatgcactgtagtggcgagaactacgatggcaagatatccaagacgatgagcggtctggaatgtcaagcttgggattcacagagcccccatgctcacggatacataccatctaagtttcctaataagaatctgaagaagaactattgtcggaacccagacagagagctacggccttggtgttttactactgacccaaataaacggtgggagttgtgcgatatccctcggtgtaccacccctcctccttcatctgggccaacttaccagtgccttaaaggcaccggggaaaattatagggggaatgtagctgtcactgttagcggacacacttgccaacattggtcagcccagacccctcacacacacaatcgcaccccagaaaattttccttgtaagaacctggatgaaaattattgccgtaaccccgacgggaagagggcaccatggtgtcatactaccaactcccaggtgcggtgggaatattgcaagatccccagctgcgacagctcacctgtctctacagagcagctggcccctacagccccccctgaactgacccccgtggttcaggactgctatcacggtgacggccagagttatcgcggtacctcatctaccactactaccggtaaaaagtgccaaagctggagctcaatgaccccgcacaggcaccagaaaactccggagaattatcccaatgctgggttgacaatgaactattgtcgaaatccggacgccgacaaaggtccctggtgcttcacaacagatccatcagtccgatgggaatactgtaatttgaagaagtgcagcgggacagaggcctccgttgtcgctccgccgccggtcgtacttctgccagacgtggagactccatcggaagaggattgtatgttcggaaatggcaagggataccgcggcaagagagccactactgtgactggaacgccctgccaggattgggcagcgcaagaaccccatcgacattctattttcacacctgagactaacccccgggcaggactggagaaaaactactgtagaaaccccgatggagacgtgggcggtccctggtgttacaccacgaaccctcgaaaactctacgactactgcgacgttccccagtgcgccgctcccagctttgactgtggaaaaccccaggttgagcctaagaaatgtcctggcagagtggtcgggggatgcgttgcccatccccatagttggccatggcaagttagtttgcgcaccaggtttggaatgcatttttgcgggggcactcttatctcaccggaatgggttctcacagccgcgcattgtcttgagaaatcacctcgtccgtcttcctacaaggtgatcctcggtgcccaccaggaggtaaacttggaaccccatgttcaggaaatagaggtaagcagactctttttggaacccactagaaaggatattgcgcttcttaaattgtcttcaccggccgtgattactgacaaagtgattcccgcttgtctcccatcacctaattatgtcgtcgctgatagaactgagtgtttcataaccggttggggcgaaacacagggcacctttggcgctggcctgctgaaagaggcccagctgccagtgattgaaaataaagtgtgcaacagatatgaatttctgaacgggcgggtgcagtctactgagctgtgcgcgggacacctggcaggaggaactgactcttgccagggtgactctggaggaccccttgtgtgtttcgagaaagacaagtatatcctgcagggggtgacgtcctgggggctagggtgcgccagaccaaacaagcctggtgtctacgttagagtttctaggtttgtcacctggatagagggggtgatgcgcaacaat

SEQ ID NO: 250940 - DNA, 2430 bp, Artificial Sequence
  Description of Artificial Sequence: Synthetic coding sequence
atggagcataaggaagtggtattgctgttactgctatttctgaagagtgggcagggggagccactggacgattacgtaaatactcagggggcttcactgttctctgtcaccaaaaagcagctcggggctgggtctatcgaggagtgtgcggcgaaatgtgaggaggacgaggagttcacgtgtcgcgcctttcagtaccactccaaggagcaacagtgtgtgattatggctgaaaaccgcaaatcctccattatcatccggatgcgggacgtggtcttgtttgaaaagaaggtctacctcagcgagtgcaaaactggcaacgggaagaattatagaggaaccatgagcaagacgaaaaatggaattacttgtcagaaatggagcagtacatcgcctcacagacctcgtttctcccccgccacacatccaagcgagggcttggaagagaactactgtagaaatcccgacaatgacccccagggtccttggtgttataccacggacccagagaaacgctacgattattgtgacattttggaatgtgaggaggaatgtatgcattgcagtggggagaactatgacgggaaaatttccaagactatgtcgggtctagagtgccaggcatgggactctcagtccccccatgcccacgggtatataccttccaagttccccaataagaacctcaagaagaactactgcagaaatcctgaccgagagctccgcccatggtgtttcaccaccgaccctaataagcggtgggagttatgtgatatacccagatgcaccacacctcctcctagctcagggcccacctatcagtgtctcaaagggacgggcgaaaattatagaggtaacgtggccgtgacggtgagcggccacacatgccagcattggtcagcccagaccccacacacacacaatagaactcctgagaacttcccatgtaagaacctggatgaaaattactgccgaaatccagacgggaaacgcgctccttggtgtcatacaaccaattctcaggttagatgggaatattgcaagattccctcttgcgattctagccccgtctctaccgagcagctggccccaaccgcaccacccgaactgactcctgtcgtgcaggactgctaccacggagacggtcagtcataccggggcacctctagcacaaccacaactggaaaaaagtgccaatcttggtctagcatgactccgcaccgccaccaaaagacccccgaaaactaccctaacgcaggccttacaatgaactactgtaggaatccagatgccgacaaggggccctggtgtttcaccaccgaccctagcgttcggtgggaatactgcaatctgaagaaatgcagtgggacggaagcatcagtagttgccccaccaccggtggtgctactgccggacgtggagacaccgtcagaggaggattgtatgttcgggaacgggaagggttacagaggcaaacgggctacaaccgtgaccggtacaccatgccaggactgggctgcacaggagcctcaccgtcattccatattcactccagaaaccaatcctcgtgctggactggagaaaaactactgtcgcaatccagatggtgatgtaggcggcccctggtgttatactaccaatccaagaaagctgtacgattactgcgacgttccgcagtgtgcggcaccgtccttcgactgtggtaagccccaggtggaacccaagaagtgccccggccgggtggtcgggggatgcgttgcgcatcctcactcctggccgtggcaagtttccttgcgaacaaggtttgggatgcatttctgtggcgggacattgatctctccggagtgggtgttgactgctgcccattgcctggagaagagcccacgaccatctagttataaagttatactcggcgctcaccaggaagtcaatctggagcctcatgtgcaggagattgaagtgtctcgcctctttctggagccaacacggaaggacatcgccctgctcaaactctcgtccccagcagtgattacggacaaggtaattccagcgtgtttaccatctccgaattacgtggtggcagaccggacagagtgtttcatcactggctggggtgaaactcagggaacttttggggcaggcctgctaaaagaagcccagctcccggtcatagaaaataaggtgtgcaatcgatacgagttccttaatgggcgagtgcaaagcacagaactttgtgcaggacacctcgcagggggcactgactcttgtcagggggattctggaggtccacttgtgtgttttgagaaggacaagtatattctgcagggtgttacctcttgggggttaggctgtgcacggcccaataaaccaggggtgtatgtgagagtgtcacgcttcgttacctggatcgagggcgtcatgcgaaacaac

SEQ ID NO: 250941 - DNA, 2430 bp, Artificial Sequence
  Description of Artificial Sequence: Synthetic coding sequence
atggaacacaaggaggtagttttgctcttgctgctgttcctgaaatccggacagggcgaaccccttgatgactatgtgaacacgcagggggccagtctgttttcagtgacaaagaaacagctcggagccggcagcatagaggagtgtgcagccaagtgtgaagaggatgaagagtttacatgcagggcttttcaataccacagtaaagaacagcagtgtgtaatcatggcagaaaaccgaaagtcatctatcattattaggatgcgcgatgtggtgctgttcgagaaaaaagtttatctcagcgagtgcaagacaggcaacggcaagaattatagaggcacgatgtctaaaaccaagaacgggataacatgccagaagtggagctcaacatctccccatcgccctagattcagcccagccacacatccctccgagggtttggaagagaattactgcaggaatccagacaacgacccccagggcccatggtgttacactacagacccggaaaagaggtacgattactgcgacattctggagtgcgaggaggagtgcatgcattgttcaggcgagaactacgacgggaagataagcaagaccatgtccggtctggagtgtcaggcctgggacagccaaagcccacacgctcacggctatatcccctcaaaatttcctaataagaacctcaagaaaaactactgccggaaccctgacagggagctgcgcccttggtgttttacgactgatccaaataaacggtgggagctgtgtgacattccaaggtgcacaactccaccaccctccagtgggccgacctaccagtgcttgaaaggaactggcgagaactaccggggaaacgtcgcagtcaccgtcagtggccacacgtgtcagcattggtcagctcagaccccgcacactcataatcggacccctgagaattttccctgtaagaatctggatgagaactactgcaggaaccctgatgggaagagagcaccctggtgtcatacaactaacagccaagttaggtgggaatattgtaagatcccaagctgcgactcttctccagtgagtactgaacaacttgctccaacggcccctccagagttgactcctgtggtgcaggactgctaccatggcgacgggcaaagttaccgcgggacaagctcaaccacaacaaccggtaaaaagtgtcagtcctggtctagcatgacaccacaccggcaccaaaagactccagagaactatcccaacgcaggactgaccatgaactactgtagaaacccagacgcagacaaaggtccctggtgctttacaaccgacccttccgtgcggtgggagtactgcaatctcaagaaatgctcaggcaccgaggccagtgtagtagctccccctccggtggtcctgctgccagacgtggagaccccctctgaggaggattgcatgtttgggaacggcaagggctatcggggcaagcgggctactaccgtaactggtacgccatgccaagattgggctgcccaggagccccaccgacacagtatcttcactccagaaacaaaccctcgcgccggactggaaaagaattactgccgcaacccggatggagatgtaggagggccctggtgctacacgaccaacccaaggaaactttatgactactgtgacgtccctcaatgcgcagccccgtcctttgattgcgggaaaccacaggtcgagcccaaaaagtgtccggggagagtggttggcggttgtgtggctcacccccactcctggccctggcaagtttccctgaggacccgattcgggatgcatttctgcggtgggactcttatcagccctgagtgggttttgactgctgcgcactgtctggagaagtcacccagaccaagctcctacaaggtcattcttggcgcccaccaggaggtcaacctcgagccccatgttcaggagatcgaagtaagccggctgtttctcgagcccacacgcaaggacatagcattgctgaagctttccagcccggcagtgattacggataaggtaatacctgcctgcctgccgagccccaactacgtggtcgccgacagaacggaatgcttcattactggctggggcgagacacagggcacatttggcgccgggctgctcaaagaagcgcagttgcccgttatcgagaataaagtgtgtaacaggtacgaattcctcaatggaagggtgcaaagcacggaactgtgtgccggccaccttgctgggggaaccgactcatgtcaaggtgactctggaggacccctggtctgttttgaaaaagacaagtacattctgcagggtgttaccagctggggcttgggctgcgcgcgcccaaacaagcctggtgtgtacgttcgagtttctcgattcgttacatggattgaaggcgtcatgagaaataat

SEQ ID NO: 250942 - DNA, 2430 bp, Artificial Sequence
  Description of Artificial Sequence: Synthetic coding sequence
atggagcataaggaagtggtgctgctcttgctgctgtttcttaagtcgggtcaaggagagcctcttgacgattacgtcaatactcagggcgcttcattgttttcagtcactaagaagcagcttggcgccggcagcattgaagagtgtgcagccaagtgtgaagaagatgaagaatttacgtgcagggcattccagtaccactcgaaagaacagcagtgtgtcattatggcagaaaaccggaaatcgagcattatcattcgtatgagagatgtcgtgctgtttgaaaagaaggtctatctttcggaatgtaagaccggaaatggaaaaaactaccggggaaccatgagcaaaactaagaatgggattacctgccaaaagtggtcctcgactagccctcatagaccaaggtttagcccagccacccaccctagcgaaggacttgaggagaactactgtcgtaatcctgataacgatccacaagggccctggtgttacacgaccgatccagaaaagcgctacgactattgtgatatcctcgaatgtgaagaagaatgcatgcactgttcgggtgaaaactacgacggcaagatcagcaagactatgtcgggccttgagtgccaagcgtgggattcgcagagcccccatgctcacggttacattccttccaagtttcctaataagaacctgaagaaaaactactgccggaaccccgacagagaactcagaccatggtgctttaccaccgaccctaacaaacgatgggaactctgcgatatccctagatgcaccaccccgccaccatcttcaggacctacctaccagtgcctcaaagggaccggagagaactaccgtgggaatgtggccgtgaccgtcagcggacatacctgtcagcattggtccgctcagactccacacacgcacaatcgcacgcccgaaaactttccttgcaagaacctggatgaaaactactgtcgaaacccagatggtaagagagcaccgtggtgtcacaccaccaacagccaagtacgttgggagtactgcaaaattccgtcctgcgattcctcaccagtgtctaccgaacaactggccccaacggcgccccctgagcttactccagtggtgcaagattgttaccatggcgacgggcaatcgtatcgaggcacctcgtcgactactacgaccggtaagaagtgtcaatcctggtcgtcgatgaccccacatcggcatcagaaaacgcctgagaactacccaaacgcaggacttaccatgaattactgccggaatcctgacgctgataaggggccctggtgctttactaccgatccatcggttcgctgggagtattgtaacctcaaaaagtgttcgggaaccgaagcctcggtggtggcacccccaccagtcgtgctcctgccggatgtggagactccgtcggaagaggattgcatgtttggtaacggcaagggatacagaggtaaacgcgcgacgaccgtcaccggaactccatgtcaggactgggccgcacaagaaccccataggcactccatattcacccctgaaactaacccacgggcaggtcttgaaaagaactattgtagaaatcctgatggagatgtcggtggtccttggtgctacactaccaacccacggaagctctacgattactgtgacgtgccccaatgcgcagccccgagctttgattgcggaaaaccccaggtcgaacctaagaagtgccctggtagagtggtgggcggctgtgtggcacatcctcatagctggccgtggcaagtgtcgctgagaacccggtttggaatgcatttttgtggaggaactctgatttcgcctgaatgggtgctgacggcagcacactgtcttgagaagagccctcgccctagcagctacaaggtcattctcggcgcccaccaggaagtgaatctcgagccgcacgtgcaagagattgaggtgtcgcggctgtttttggaaccgacccgaaaagacatcgcgctcctcaagctctcatcccccgccgtgattactgacaaggtgatcccggcatgtctgccatcgcctaactacgtcgtggcagatagaacggaatgtttcataaccgggtggggagaaacccaaggtacctttggtgccgggttgctgaaggaggcgcagcttcccgtgatagaaaacaaggtctgtaacaggtacgaatttctgaatgggcgcgtgcagagcaccgagctgtgcgcaggccaccttgctggcggtaccgattcatgtcagggtgatagcggagggcctctggtttgttttgaaaaagataagtacattctgcaaggagtgactagctgggggctcggttgtgctcgaccaaacaagcctggagtctacgtgagggtatcgagattcgtcacctggatcgaaggagtgatgcgcaataac

SEQ ID NO: 250943 - DNA, 2430 bp, Artificial Sequence
  Description of Artificial Sequence: Synthetic coding sequence
atggagcataaggaggtggtactgctccttcttctgtttctcaaaagcgggcaaggagaacccctggacgattacgtgaacacccaaggcgcatcgctttttagcgtgactaagaaacaactcggggctggctcgattgaggaatgtgcggcaaaatgtgaagaggatgaagagttcacctgtagggcattccagtaccattcgaaagaacaacaatgtgtgataatggcggaaaaccgtaagagctccataatcatccgaatgcgggatgtcgttctgttcgaaaagaaggtgtacctttccgaatgtaagactggaaatggcaagaactaccggggaacgatgtcaaagacgaaaaatggaattacctgccagaagtggtccagcacgtcaccccatcggcccagatttagccccgcaacccatccaagcgaagggctggaggaaaactactgccgcaacccggataatgatcctcagggtccatggtgctacactaccgatccagagaaaaggtacgattactgtgatatccttgaatgtgaggaggaatgtatgcattgttcaggcgagaactacgacggaaagatctcgaaaaccatgtcaggacttgaatgccaggcatgggattctcagagcccccatgctcacggttacattccttccaaattcccaaataagaaccttaagaaaaactactgtcgtaatccagacagggaactccgtccttggtgttttactacggacccaaataagagatgggaactctgtgatattccaaggtgcactacccctcccccatcctccggtcctacttaccagtgcctgaagggaaccggtgaaaactacagaggaaacgtcgcggtcacggtgtcgggccacacctgtcagcattggagcgcacagacccctcatactcacaacaggactcccgaaaacttcccctgcaaaaacttggatgaaaactattgtaggaaccctgacggtaaacgcgccccgtggtgtcacacgacgaattcgcaggtccgttgggagtactgtaagattcccagctgtgattcgtcgccagtgtcgaccgaacagcttgcgcctactgctccccccgagctgactccggtcgtgcaagattgctaccacggtgatgggcaatcatatcgagggactagctcgactacgactactggtaaaaagtgtcagagctggtccagtatgaccccacatagacatcaaaagacccctgagaactatcccaatgccggtctgaccatgaactattgccggaacccagacgcagacaaggggccgtggtgtttcaccaccgatccgtcagtgcgttgggaatactgtaacctgaagaaatgttcaggtactgaagcaagcgtggtcgcacctccacctgtcgtccttctgcctgatgtggagactccatcggaagaagattgcatgttcggcaacggtaaaggataccgggggaagcgagccactacggtgaccggtactccgtgtcaagattgggctgcacaagaacctcataggcactctatcttcactcctgaaactaatcctcgcgcgggattggaaaagaactactgcaggaacccagatggcgacgtgggagggccctggtgctataccactaacccaagaaagctgtatgattactgtgacgtgcctcaatgtgctgcaccatcatttgactgcgggaaaccacaggtcgaaccgaagaaatgccccgggagagtcgtcggaggttgtgtggcgcaccctcactcctggccctggcaagtgtccctgcggacccgctttggaatgcatttttgtggtggtaccctgatctcaccagaatgggtgcttaccgcagcgcactgtcttgaaaagtcgccacgaccttcatcgtacaaggttattcttggcgcgcatcaagaagtgaaccttgagccacatgtgcaggaaattgaagtctcgcggctgttcctcgagcctaccaggaaggacattgcactgctgaaactgtccagccctgcggtgattactgataaggtgatccccgcatgccttccatcccctaattacgtcgttgcagatcgaactgagtgcttcattactgggtggggtgagacgcaaggaacttttggcgcagggctccttaaagaagcccagctgccagtgattgaaaacaaagtgtgtaatcggtacgagtttctcaacggtagagtgcaatccaccgagctgtgtgcaggccatctcgcagggggcaccgattcgtgccagggtgattccggtggtcctttggtgtgctttgagaaagataagtatattctccagggagtgacttcctggggtttgggctgcgcccgtccaaataagccgggtgtctacgtgagggtgtcgcgttttgtgacttggattgaaggtgtgatgcgcaacaac

SEQ ID NO: 250944 - DNA, 2430 bp, Artificial Sequence
  Description of Artificial Sequence: Synthetic coding sequence
atggaacataaagaggttgtactacttcttcttcttttccttaaaagtggacagggtgagccgctcgatgattatgtgaatacccaaggggcctccttgtttagcgttaccaagaagcaattaggagctggcagtatcgaggagtgcgccgccaaatgcgaagaggacgaggaattcacctgcagggccttccaatatcattccaaagagcaacagtgcgtgattatggcggaaaacaggaaatcctcaattattatccgtatgagggatgttgtattgttcgagaagaaggtatacctttcagaatgcaagaccgggaacgggaagaattacagaggaaccatgagcaaaactaagaacggaataacatgtcaaaagtggtcctccacatccccccatcgcccaagattttcaccagctactcacccgtccgagggtcttgaagagaactactgccggaatcctgataacgatccacagggtccttggtgttacaccactgatccagagaagaggtatgattattgtgatatccttgaatgcgaggaggagtgcatgcattgcagtggtgagaattatgacggcaaaatttcaaagactatgtctggcttggagtgccaggcttgggactcccagtcaccgcatgcccacggttatattccctccaaatttcctaacaagaacttgaaaaagaattattgtagaaatccagacagagagttgcgcccgtggtgctttactactgatccgaacaaaagatgggaactttgtgacattccaaggtgtaccaccccccctccttcttcaggtccaacttaccagtgtttgaaaggaacaggagagaattatagaggtaacgtcgctgtcacagtttctggtcatacctgccaacactggtccgctcaaactccacatactcacaaccgtacccctgaaaacttcccatgtaaaaatctggacgaaaactattgtagaaaccctgatggaaaacgagcaccgtggtgccatacaacaaactctcaggtacgttgggagtactgtaagattcctagctgtgattccagtcctgttagtacggagcaactcgcacctacagcccctccagagcttaccccagtggttcaggattgctatcacggtgacggccaaagctatcgaggcaccagcagcacgacaaccactggaaaaaagtgccaaagttggtcatccatgactccccatagacatcagaagacgccagagaactatccgaacgctggattgacaatgaattattgcagaaacccagatgccgataaaggaccatggtgctttaccacagatccatctgttcggtgggagtactgcaatctcaaaaaatgctcggggactgaagcgtctgttgttgccccccctcctgtcgtgttgcttccagacgtcgagaccccgtccgaagaagactgcatgtttggcaatggtaaggggtaccgtgggaaaagggctactactgtaactgggacaccatgtcaagattgggctgcacaagagcctcatcgccacagtattttcactccagagaccaatcctagagcagggctcgagaaaaactattgtaggaacccagatggcgacgtgggaggtccatggtgttatacaacgaacccacgtaagttgtatgactattgtgatgttcctcaatgtgccgctccgagctttgactgcggtaagccgcaggtggaacctaaaaaatgcccaggacgagttgtcgggggatgcgttgcacatccacattcctggccatggcaggtttcacttagaactcgtttcggcatgcatttctgtggtggtactctaatttcaccggagtgggtcctcacagcagctcattgtcttgagaagtctccaagaccatctagctataaggtgatcttgggtgcacaccaagaagtcaatttggaacctcacgttcaagaaatcgaggttagtaggctgttccttgaaccaactcgtaaagatattgctttgttaaagttatcgagtcccgccgtgattaccgataaggtgatccctgcttgccttccctctcccaattacgtcgttgcagaccgaaccgaatgttttataacaggttggggagaaacccaagggactttcggggccggtcttctgaaagaagcacaattgcccgttattgaaaataaagtatgtaataggtatgaattccttaacggtcgtgtccagagcaccgaactctgtgcaggacatcttgctggcggaacagattcgtgtcagggcgactccggcggtcctctagtctgtttcgaaaaggataagtacatacttcagggagtcactagctggggcctagggtgtgcacgaccaaacaagcctggtgtttatgtacgtgtgtctcgatttgttacttggatcgaaggtgttatgcggaacaat

SEQ ID NO: 250945 - DNA, 2430 bp, Artificial Sequence
  Description of Artificial Sequence: Synthetic coding sequence
atggaacacaaagaggttgtgctgcttctgctgctgtttcttaaatcggggcagggagagccactggatgattacgtcaacactcagggcgcatccctcttttcggtgactaagaagcaactgggcgcaggatccattgaagaatgtgcagctaaatgtgaggaagatgaggaatttacgtgtcgggctttccagtaccattcgaaggagcagcaatgtgtgatcatggccgaaaatcgcaagtcctcgattatcatacggatgcgggatgtggtgctttttgaaaagaaagtctacctttcggagtgcaagactgggaacggaaaaaactacagaggtaccatgtcaaagacgaagaatggaataacttgtcaaaaatggtctagcaccagccctcatagaccacggttttcgccagcgactcatccctccgaaggactggaagagaactattgtagaaaccctgataatgacccccaaggcccttggtgttacactaccgatcccgaaaagcgatatgactactgtgatattcttgagtgtgaggaagagtgtatgcactgctcgggcgagaactacgacgggaaaatctccaagactatgtctggtttggaatgtcaagcatgggactcccagtctccacatgcacatggatacattccctctaagttccctaacaaaaatctcaaaaagaattactgtaggaaccctgatagggaactgcgaccttggtgctttactactgatcccaacaagcggtgggagctgtgcgatattccacgttgtaccacgcctcctccttccagcgggccaacctaccaatgtctcaaggggacgggggagaattacagaggtaacgtcgcggtcactgtgagcggacacacttgtcaacattggtccgcccaaacccctcatacccacaatcgaacgccagaaaacttcccatgcaagaaccttgatgagaattactgccgcaatcctgacggcaagcgcgcaccttggtgtcataccactaactctcaagttcgctgggaatactgtaagatccccagctgcgactcatcgccggtgtcaaccgaacagctcgcgcctaccgcacctccagaattgaccccagtggtgcaggattgctatcatggtgatggacaatcatacagaggaacctcttcaactaccaccactggtaagaagtgccagtcatggtcatcaatgacccctcacagacaccagaaaactccagagaactaccccaatgcgggacttactatgaactattgccgcaatccagatgccgacaagggtccctggtgttttacgaccgacccctcagtgagatgggaatactgcaatcttaagaaatgctccggtaccgaagcatcggttgtggcccctcccccggtggtgcttctgcccgatgtggaaacgccatccgaagaagattgtatgtttggaaatggaaaagggtatagagggaagcgggccactactgtgactgggaccccttgtcaagattgggcagcccaggagccacataggcattcaattttcactccagagacgaacccacgtgcaggactcgaaaagaactactgtcggaaccccgatggagacgtcggtggcccttggtgctacactacgaacccgcgtaagctgtacgactactgcgacgtcccgcaatgtgcagccccttcgtttgactgtggaaaacctcaggtggaaccaaagaaatgcccaggtagagtggtcggaggatgcgtggcccatcctcattcctggccttggcaagtctcccttcgcaccagattcggcatgcacttttgcggtggtactctcatatctcctgagtgggtgctgaccgcagcgcattgtttggagaaaagcccccgaccgtcatcgtacaaggtgatcctcggagcgcaccaggaggtgaacttggaaccccacgtccaggagatcgaagtgtcgagactgttcctcgaaccaaccagaaaggacattgcccttctgaagctgtcgtcacccgcagtgattaccgataaggtgattccagcatgtctcccatcacctaattacgttgtcgctgacagaactgaatgttttatcactggttggggtgaaactcagggaaccttcggagccgggctgttgaaggaggcacaacttcctgttatcgaaaacaaggtgtgtaaccgttacgagttcctcaacggcagggtgcagagcaccgaactttgtgcaggtcatcttgccgggggtactgactcatgtcaaggtgactccggaggaccacttgtgtgcttcgaaaaagataagtacattctgcaaggagtgacttcgtggggcctcggttgcgcacgaccaaataagccaggagtctacgtccgtgtttctaggtttgtgacttggattgaaggagtcatgcgcaataac

SEQ ID NO: 250946 - DNA, 2430 bp, Artificial Sequence
  Description of Artificial Sequence: Synthetic coding sequence
atggagcacaaagaagtagtgttgttgctgctcctgtttctcaaatcaggtcagggtgagccgctggacgactacgttaacacccagggtgcgagcctcttcagcgtgacgaagaaacagctgggtgccggcagtatcgaagaatgcgccgccaagtgtgaagaagacgaggagttcacttgtcgcgcattccagtaccactcaaaggagcagcaatgcgtcattatggcggaaaaccgcaaatcctctattattatacgcatgagggacgtcgtgctgttcgagaagaaggtctacctgagcgagtgtaagaccggtaacggaaaaaactataggggaacgatgagtaagacgaaaaacggaatcacttgccagaagtggtcctccacgtcaccacacagacctagattcagtcccgccacacaccccagcgaaggcctggaagagaactactgtcgcaatccggacaacgatcctcaaggtccctggtgttatactactgatcctgagaaaagatatgattattgcgatattcttgagtgcgaggaggaatgtatgcactgttctggtgagaattacgacggcaaaatctctaagaccatgagcggccttgagtgccaggcgtgggacagccaatcacctcacgcacatggatatattccttcaaaattcccgaataagaatctgaagaagaattactgcaggaaccctgatcgcgagctgcgcccctggtgcttcaccactgacccgaataaacgctgggaactctgcgacattccgagatgcacaaccccccccccatcttcaggacctacctaccagtgtctgaagggaacaggagagaactaccgcggtaacgtagccgttaccgtgtccggccacacatgccagcactggagtgcccagacccctcatacccataatcgcacacccgaaaactttccatgtaagaatttggatgaaaactactgtcgcaacccagatggtaagagggccccttggtgtcacacaaccaatagccaggtgcgctgggagtactgcaagataccctcatgtgactctagtccggtctctaccgagcagctcgccccgaccgcacctccggagcttacccccgtggtgcaagattgctaccacggtgacggacagtcctaccgcggaacgtcttctacaacaactaccggcaagaagtgtcaaagctggtcctcaatgacaccacatcgccatcagaaaacgccagagaattacccaaacgccggtctgaccatgaactactgtcgcaatccggacgcggacaaaggcccctggtgctttaccaccgaccctagcgttaggtgggagtactgcaacctcaagaagtgcagcggtaccgaagcttctgtagttgcacctcctcccgttgtgctcctccccgacgtggaaacgccttcagaggaggactgtatgtttggtaacggtaaaggttatagaggaaagagagccaccacagtcactggaacaccatgccaggattgggccgcgcaggaaccccacagacactctattttcactccggagactaaccccagagctggcctggaaaagaactattgcaggaaccccgacggagatgtgggaggtccctggtgctacaccaccaatcctcgcaaattgtatgactactgtgatgttccccagtgtgccgctccttctttcgattgtggtaaaccccaggtagaaccaaagaagtgccccggacgcgtggtgggaggctgcgttgcccacccccactcatggccttggcaggtgtctctcagaacacgcttcggcatgcatttttgcggtggcaccctgatcagtccagagtgggtcctgacagccgcgcactgccttgaaaagagtccaaggccatcatcctacaaggttatactgggagcccaccaggaggtcaacctggaaccgcacgtgcaggaaattgaagtgtccaggctgtttctggagccaactaggaaagatattgccctcctgaaactgagttcccctgcagttataactgacaaggtaattcctgcctgtctgccaagccccaactacgtggtggccgacaggactgagtgttttatcactggctggggagagacccagggtaccttcggtgcaggcctcctgaaggaagcccagctgccagtgatagagaacaaggtctgcaacaggtacgagttcctgaacggcagggtgcaatctactgagctttgtgcgggccatcttgctggtggtaccgattcatgccagggtgacagtggaggtccactggtttgcttcgagaaggacaagtacatcctgcagggtgtcacatcctggggcctcggctgcgcaagaccaaacaagcccggagtttatgtaagggttagcaggtttgtgacatggatagagggagttatgaggaacaac

SEQ ID NO: 250947 - DNA, 2430 bp, Artificial Sequence
  Description of Artificial Sequence: Synthetic coding sequence
atggagcacaaagaagtagtgctccttctcctattgttcttgaaaagtggacagggagaaccacttgacgattacgttaatacacagggcgcatccttgttcagcgtgacgaagaaacagttgggagctggtagcatcgaagagtgcgctgcgaagtgtgaagaagacgaggaattcacctgcagggcgtttcaataccatagtaaagagcagcagtgtgtgatcatggcagaaaacagaaagagctccattataatccgcatgagagatgtggtgctctttgagaaaaaggtctatcttagtgaatgtaagacaggaaatggcaaaaactaccggggcacgatgtctaagacaaaaaacggcattacatgccagaagtggtctagcaccagcccccaccgccccaggttcagcccagccacccatcctagcgaggggctggaggagaactactgcagaaaccccgacaacgatccccaaggcccttggtgctataccacagatcctgaaaaaaggtatgattactgcgatatactcgagtgcgaggaagaatgcatgcattgcagcggagagaactatgacggaaaaatctctaagactatgtctggattagagtgccaggcctgggactctcaatcacctcatgctcacggatatatcccttctaagttccccaacaagaatctgaaaaaaaattactgccgcaacccggaccgggaacttaggccctggtgctttacaacagaccctaataagaggtgggagttgtgcgatatcccacgctgtaccacacctcccccgtcttctggtcctacatatcaatgcctgaaaggaaccggcgagaattaccggggtaacgtggccgtgactgtgagcggacacacctgtcagcattggagtgcccagactccgcacacgcacaatcgcacaccagaaaacttcccctgcaaaaatctcgacgagaactactgcagaaatccagatggcaaaagggctccatggtgccatactacaaacagtcaagttcgctgggagtactgtaaaataccaagctgcgacagctctccagtgagcacagagcagctcgcaccgaccgcacctcctgaacttacccctgtagtgcaggactgctatcatggtgatggtcagtcctaccgcggaactagttcaaccaccaccaccgggaagaaatgccagtcatggtcaagcatgacccctcaccggcatcagaaaactccggaaaattatcctaacgcagggcttacaatgaactattgtagaaacccagatgcagacaaaggcccatggtgcttcacaacagacccgagcgtgcggtgggaatactgcaacttgaagaaatgcagcggaaccgaggccagcgttgtggcacctccaccagtggtcctccttccagacgtggaaaccccatccgaggaagactgtatgttcggcaacgggaaggggtatcgcggtaaaagggctactactgttactggaactccctgccaagattgggcagcccaggaacctcaccggcactctatattcacccctgaaaccaatccacgcgctgggctcgagaagaattactgccggaaccctgacggtgatgtgggcggaccttggtgctacacaacaaaccctcgtaaactttatgattactgtgacgtgcctcagtgtgctgcacccagcttcgattgcggcaagccacaagtggaacctaagaagtgccctggcagagtggtggggggatgcgttgcccaccctcactcttggccatggcaggttagcctcaggaccagatttggaatgcacttttgcggaggtacactgatcagtcctgaatgggtactcactgctgctcactgcctggagaaaagtccgcgccctagcagctataaggttatcttgggagcgcatcaggaagtcaacctcgaacctcatgtgcaagagatcgaggtgagcaggctgtttcttgagcccactaggaaagacatcgctctgcttaagctgtcttctcctgcagtgatcacagacaaagtgattcccgcctgcctaccttctccaaactatgtagtggccgataggaccgaatgcttcatcaccggatggggtgaaacacagggcacatttggcgcaggattgctgaaagaagctcaattgccagtcatagagaacaaggtctgcaacaggtacgagtttctgaatggtagagttcaaagcaccgagttgtgcgccggccatctcgcaggtggaactgacagctgtcagggtgactctggggggcctcttgtctgtttcgagaaggacaagtacatcctgcagggcgtcactagctggggcttgggatgtgcccgcccaaacaaaccgggcgtctacgtgagggtgtcccgttttgtgacctggatcgagggcgttatgaggaacaac

SEQ ID NO: 250948 - DNA, 2430 bp, Artificial Sequence
  Description of Artificial Sequence: Synthetic coding sequence
atggagcacaaggaggtcgtactactgttgctgctctttctcaagtcaggtcagggagaacccctggatgactatgtgaacacacagggggcctcactcttttctgttaccaaaaaacagctcggagctgggtccatcgaagaatgtgctgccaaatgcgaggaggacgaggagttcacttgcagagctttccaataccacagcaaagaacagcagtgcgtgatcatggccgaaaaccgcaaaagctccatcatcatcagaatgagagatgtagtgctgttcgaaaagaaggtgtatcttagcgaatgcaaaaccggaaatgggaaaaactaccggggcaccatgtcaaagacaaagaatggaatcacctgtcaaaaatggtccagtacctccccccatcggccgcgcttcagcccagcaacacacccgagcgagggattggaagagaactactgtcgtaaccctgacaacgacccacaaggaccctggtgctatacaactgacccagaaaaacgctacgactactgcgacattctggaatgcgaggaggagtgcatgcactgcagtggcgagaactatgatggtaagatcagtaaaaccatgtcggggctcgagtgccaggcttgggattctcagtcgccacacgcacacgggtacatcccatctaagttccccaataagaacctgaagaagaactactgtaggaatcccgaccgagagcttaggccctggtgcttcaccacagatccaaacaagcggtgggaactctgcgacatccctcgctgtactacaccacctcctagctccggtcctacttaccagtgcctcaaaggaaccggcgagaattaccggggtaatgtagccgtgacagtcagcgggcacacttgccaacactggtcagctcagacgccccacacgcataaccggacccccgagaattttccgtgtaaaaatctggatgagaactattgccgaaatccggacggaaaacgggcgccatggtgccacactacaaatagtcaagtgcgatgggagtattgtaaaatcccttcctgtgacagttctcctgtttctaccgaacagttagctcccaccgccccgccagaactgacccccgtggtgcaagactgttaccacggcgacggccaatcatatagagggacatcgagcacaactacaaccggcaaaaaatgccagtcgtggagctcaatgacaccacacaggcaccaaaagacaccggaaaattatccgaacgcaggcctcactatgaactattgtcgtaaccctgatgccgacaagggtccgtggtgtttcaccaccgatccatcagtcagatgggagtactgtaacctgaagaaatgttccggcaccgaggcttctgtcgtggcccccccgcccgtggttctcctgcctgacgtggagacccctagcgaggaagactgtatgttcggcaacggcaagggatacagaggaaaaagagccaccaccgtgactggtaccccctgccaggattgggctgcccaggaaccccatagacattctatcttcacgcccgagaccaacccccgtgccgggttagagaagaactactgccgcaaccctgatggtgacgttggtggaccctggtgctataccaccaaccctcgcaagctgtatgactactgcgatgttccacagtgcgcagccccttcattcgattgtggaaagcctcaggtagaaccaaagaagtgtcctggtcgagtcgtcggcggctgcgtggcccatccccactcttggccttggcaggtgtcactgcgaaccagattcgggatgcacttttgcgggggcacactcatctcaccagagtgggtgctcaccgccgctcactgcctcgagaaatcccctcggccaagttcttacaaagtaattctcggggcacatcaggaagtaaacctcgaacctcatgtgcaagagattgaggtatcaagactcttccttgaacctacacgtaaggatatcgccctcctgaaactgtcctcgccggctgtcataaccgataaggtgattcctgcctgccttccctccccaaactacgttgtagcagatcgaactgaatgtttcattaccggctggggagaaacacaggggacattcggagccggtctgttgaaggaagcacaactgccagtcatcgagaacaaagtctgcaaccggtatgagttcctgaatgggcgggtgcaatctacagagctgtgcgctgggcatctggccgggggaaccgattcttgccaaggcgattctggaggtcctctggtatgctttgagaaggataaatacattctccagggggtcacttcctggggcctgggctgcgctcgacctaacaagcccggagtatacgtgagagtgtcccgatttgtcacatggattgaaggagtgatgaggaacaat

SEQ ID NO: 250949 - DNA, 2430 bp, Artificial Sequence
  Description of Artificial Sequence: Synthetic coding sequence
atggagcataaggaagtggtcctgcttttgctcctgtttctcaagtcgggacaaggggaacctcttgatgattatgtgaatactcaaggggcctccctgttctcagtgactaaaaagcaactcggtgccggaagcatcgaagagtgtgcagcaaaatgcgaagaggacgaagagtttacctgtagagctttccagtaccactccaaggaacaacaatgcgtgattatggccgaaaacaggaaatcgagcatcattatccgaatgagagacgtggtgctcttcgagaagaaagtctacctttcggaatgtaagaccggcaacggaaagaactataggggaaccatgagcaagaccaaaaacggcattacctgccaaaagtggagctcaacctcgccccatagaccaaggttttccccggcaactcacccttccgagggtcttgaagaaaactattgtcgcaaccccgataacgatcctcagggcccatggtgctataccaccgatccagaaaagagatacgattactgcgacatcctcgaatgcgaggaagagtgtatgcattgttcgggagagaactacgacggaaagatatctaaaacgatgtcagggctcgagtgccaggcatgggattcacaatcgccgcacgcccacggctacataccgagcaaatttccaaacaaaaaccttaagaagaactactgtagaaaccctgatcgggagctcaggccgtggtgttttaccacggaccccaacaagcggtgggaactctgcgatattcctcgctgcaccacccctccgccatcatccggccctacttaccagtgtcttaagggtactggagagaattacaggggcaacgtggcagtgactgtgtcaggccacacttgccaacattggtcggcacagaccccccatacccataaccgtactccagagaacttcccttgcaagaatctggatgaaaactactgcaggaaccccgatggtaagagagccccttggtgtcataccactaattcccaagttcgctgggaatactgtaagattccatcgtgtgatagcagcccggtcagcaccgaacagctggcgccaactgcaccacccgagctcaccccggtggtgcaagattgttaccatggagatggtcaaagctaccgcggaacttcgagcactaccactaccggaaagaaatgtcaatcctggtcaagcatgacgcctcacagacaccaaaaaactccagaaaactatccaaacgcaggactcaccatgaattactgtcgtaatccagacgcagacaagggaccctggtgctttaccactgacccatcggtgcggtgggagtactgtaacctgaaaaagtgttccggtactgaagcatccgtggtcgcgccgccgcctgtggtgctcctgcctgatgtggaaactccgagcgaggaggattgcatgtttggtaatggtaagggatacagggggaagcgtgccactaccgtgactggcaccccctgtcaagactgggcagctcaggaaccacatcgccatagcatctttactcccgaaaccaacccaagagccggtctggagaagaattactgtagaaatcccgacggtgacgtcggcggaccctggtgttatacgaccaatccaaggaagttgtacgattattgcgacgtgccccaatgtgctgccccaagttttgattgcggaaagccccaggtcgaaccgaaaaagtgtccaggacgggtggtgggcggatgtgtggcccacccacactcgtggccttggcaagtgagcctgcgcacccgattcgggatgcacttctgtgggggaaccctcatctcgcctgagtgggtcctgaccgcggcacattgtcttgaaaaatcccctcgccctagttcatacaaggtcatactgggtgctcaccaggaggttaacctggagcctcatgtacaggaaattgaagtgtccagactttttctggaaccaactcggaaagacatagccctgcttaaactttccagcccagcagtgatcaccgataaggtgatacctgcctgcttgccatcaccaaattacgtcgtcgccgacaggactgagtgtttcataactggttggggagaaacccaagggactttcggtgctggacttctgaaagaagcacagctgccagtcattgaaaacaaggtgtgtaacagatacgagtttctgaatggacgggtgcaatcgaccgaactttgcgccggacacctggcgggtggaactgattcctgtcaaggagattccggtggaccactcgtgtgttttgagaaggataagtacatccttcagggagtgacgtcgtgggggctgggttgtgcccggcccaacaagcctggtgtgtatgtgagagtgagcagattcgtgacttggatcgaaggtgtcatgaggaacaac

SEQ ID NO: 250950 - DNA, 2430 bp, Artificial Sequence
  Description of Artificial Sequence: Synthetic coding sequence
atggagcacaaggaggtggtgctgctcctgctgctgttcctgaagtccggacagggtgagccgctcgatgactacgtgaacacccagggcgcctcgctgttcagcgtgaccaagaagcaactgggagccggatccatcgaggagtgcgccgccaagtgcgaagaggacgaggaattcacttgccgggcctttcaataccactcgaaggaacagcagtgcgtgattatggccgaaaatagaaagtcctcaatcattatacgtatgcgggacgttgtgctgtttgagaaaaaagtgtacctgagcgaatgcaagaccggcaacggaaaaaactacaggggaaccatgtcgaaaactaagaatggaatcacttgtcagaagtggtcgagcactagcccccataggccacggttctcacctgccacccatccttcggaaggactcgaggagaactactgcaggaaccccgacaatgatccacaggggccctggtgttacactaccgacccggagaagcggtacgactactgcgacatcctggaatgcgaagaagaatgcatgcactgttccggcgagaattacgacggaaagatctcgaaaaccatgtccggcctcgagtgtcaagcctgggactcacagtcaccacatgcacatggctacattccctcgaagtttccaaacaagaacctcaagaaaaactattgcagaaaccccgatcgcgagctcagaccttggtgttttactacggatcctaacaagcggtgggagctgtgcgatatcccgcgctgtactacgcctccgccgagctcagggcccacctaccagtgcctcaagggaaccggagaaaactaccgcggtaacgtcgcggtgaccgttagcggacacacgtgccagcattggtctgcccagacgccacacacccacaacaggacccccgagaatttcccgtgtaagaatctcgacgagaactattgtagaaatccagacggaaaacgagctccttggtgccataccaccaattcccaggtccgctgggaatactgcaagatcccgtcgtgcgattccagtccggtgtcgaccgagcagctggcaccgacggctccgcccgaactgaccccagtggtgcaggactgctaccatggcgatggacagtcctaccgcggaacttcgagcactactaccaccggtaagaagtgccagagctggtcaagcatgactccacaccgtcatcaaaagactccggagaactacccaaacgcagggctcaccatgaattactgccggaatcccgatgcggataagggaccgtggtgctttaccaccgatccgtcggtaaggtgggagtactgtaacctgaagaagtgctcgggaactgaagcgagcgtcgtggcaccgccgccggtcgtgctgctcccggacgtggaaaccccgtcggaagaagattgcatgttcggcaatgggaagggctaccggggcaaacgcgccaccaccgttacgggtactccatgccaggattgggcagcacaggaacctcatcggcactccatcttcacgccggaaaccaatccaagagcaggactcgagaagaattactgcagaaaccctgatggcgacgtggggggaccctggtgctataccactaatccacggaaactgtacgattactgtgacgtgcctcaatgcgctgcaccatcattcgattgcggcaagccacaggtggagccaaagaaatgcccgggaagagtggtcggtggctgcgtggcccatcctcattcttggccttggcaagtttcactgcggactagattcggaatgcacttctgcggaggcacgcttatttcaccggagtgggtgcttacggcagcgcactgcctggagaaaagcccgcggccgagctcatacaaggtgatcctgggtgcccatcaggaggtgaacctggaaccacatgtgcaggagattgaggtgtcgaggctcttcctggaaccaactcgcaaagacatcgcgttgctcaaactgtcgtcacctgccgtgatcaccgataaagtcatcccagcctgcctgccctcgccgaactacgtggtggccgaccggaccgaatgtttcatcaccggatggggtgagactcaggggacgtttggagcaggactcttgaaagaggcccagctccctgtgattgagaataaagtgtgcaatcgctatgagtttctgaatggacgagtgcagtcaaccgagttgtgcgcaggccaccttgcgggaggcactgacagctgccagggagattccggaggcccgctggtctgtttcgagaaagacaagtacatccttcagggagtgacttcgtggggcctgggctgtgcgcgcccaaacaagcctggggtctacgtgcgggtgtccagattcgtcacttggatcgagggcgtgatgcgcaataat

SEQ ID NO: 250951 - DNA, 2430 bp, Artificial Sequence
  Description of Artificial Sequence: Synthetic coding sequence
atggaacataaggaagtcgtccttcttcttctgctgttcttgaagagcggccaaggcgagccgctggacgattacgttaacacccaaggcgccagcttgttcagcgtgaccaagaagcagctgggtgcaggttccatcgaagaatgcgcggcaaagtgtgaagaggatgaagaatttacttgtcgcgccttccaataccattcaaaggaacaacagtgcgtcattatggcagaaaatagaaagtcgtcaatcattattcggatgagagacgtggtgctgtttgaaaagaaggtgtacctgagcgagtgtaagaccggtaatggcaaaaactacagaggtactatgtccaagaccaagaatggaattacctgtcaaaagtggtcctcaaccagcccacaccggccacgcttttcaccagcaacccatcctagtgaagggctggaagagaactattgcagaaaccctgataatgatccacaaggcccatggtgctacactaccgatcccgaaaagagatacgactattgcgatatcctcgaatgcgaagaagaatgtatgcattgctcaggggaaaactacgatgggaagataagcaaaaccatgtcaggacttgaatgtcaagcatgggacagccagtcgccacatgcacacggttacataccctccaaatttcctaacaagaatctcaagaaaaactactgcaggaacccagatcgggaacttcggccttggtgtttcactactgacccgaataaacgttgggaactttgtgatataccacggtgcaccactccaccaccgtcgagcggacctacctaccagtgtctgaagggaactggtgaaaactatcgcggaaatgtcgcagtcacggtgagcggacatacttgccaacactggtccgctcagaccccacatacgcacaaccgcactccggagaactttccctgcaagaacctggatgagaactactgtagaaacccagacggtaagagagcaccgtggtgccatactaccaacagccaggtccgttgggagtactgtaagatcccttcctgtgatagctcacccgtctcgacggagcaactggcacctactgcacccccagaacttaccccagttgtgcaagattgctaccatggggacggacagtcctaccgcgggacttcatcgaccaccactaccggaaagaagtgtcaatcgtggagctctatgaccccccatcgacatcaaaaaaccccagaaaactacccaaacgccggactgaccatgaactactgtcggaatccagacgctgacaaggggccctggtgttttactactgatccttccgtccggtgggaatactgcaacttgaagaagtgctccggtaccgaggcgagcgtcgtggcacctccacccgtggttttgctcccagacgtggaaactccttcagaggaggattgtatgtttggcaatggaaagggataccgggggaagagggcaactacggtgactggtactccttgtcaagactgggccgcacaagagccacacaggcattcgattttcactccggaaaccaatcctagggcgggactggaaaagaactattgccgtaatcctgacggggatgtgggtggcccatggtgttatacgaccaatccgcggaaactttacgactactgtgatgtgcctcagtgtgcggcaccttccttcgactgtggaaaacctcaggtggagccgaagaaatgcccaggacgagtggtggggggatgcgtcgcccatcctcactcctggccttggcaagtgagcctgcggactcggttcgggatgcacttttgtggaggaactcttattagccctgaatgggtcctgactgcggcacattgcctcgagaaatccccacgcccctcatcgtacaaagtgattcttggggcacaccaggaggttaaccttgaaccacatgtgcaggaaattgaggtgtcgcgccttttcctggagccaacccggaaggatattgctctgcttaaactttcgtcccctgctgtgattactgataaagtcattccagcctgcctgccttcacctaactacgtggtggccgatcgtactgaatgctttatcactggatggggcgaaactcagggtacttttggcgcaggtttgcttaaggaagcacaactgccagtaatcgagaataaggtgtgtaaccggtatgaatttctgaacggcagagtccaatccaccgaactttgcgcgggtcatcttgcaggaggcactgatagctgccagggtgactccggagggccacttgtgtgctttgaaaaagacaagtacattctccaaggtgtgacctcctgggggctcgggtgtgcgcggcctaacaaacctggggtgtacgtgcgagtgagccggttcgtgacgtggattgaaggtgtcatgaggaacaac

SEQ ID NO: 250952 - DNA, 2430 bp, Artificial Sequence
  Description of Artificial Sequence: Synthetic coding sequence
atggagcacaaggaagttgtgctgcttctgcttctgttcctgaagtccggacaaggcgaaccgctcgatgattacgtcaacactcaaggtgcatcgcttttttcggtcaccaaaaagcaactcggagcagggtccatcgaagaatgtgcagcaaagtgcgaagaggatgaagaatttacttgtagagcgttccaataccactcaaaggagcagcaatgtgtgattatggcagaaaacagaaagtcgtcgatcatcattcgcatgcgcgatgttgtgctgtttgagaaaaaagtgtacctctccgaatgcaagaccggtaacggaaaaaactataggggaacgatgagcaagactaaaaacggaattacctgccaaaagtggtcaagcacctcccctcatagaccgcggttttcgcctgcgacccatccatccgagggtttggaagagaactattgtcgaaacccagataatgacccccaaggaccctggtgttacacgacggatcccgagaagaggtatgattactgtgacattcttgagtgtgaagaggagtgcatgcattgttccggtgagaattacgatggaaaaatctccaaaactatgtcggggctcgaatgccaagcatgggattcacaaagcccgcacgcacatggatacatcccttccaagtttcccaataagaacctgaagaagaactactgtaggaatcccgatcgagaacttcgcccttggtgcttcacgaccgatcctaacaaacggtgggaactttgtgatatcccaagatgtaccacgcctcccccatcctcagggccgacttaccaatgcctgaaaggtactggagaaaactaccgtggaaacgtggcggtgaccgtgagcggacacacttgtcaacactggtcggcccagactccacacacccataatcgtactccagaaaactttccgtgtaagaatctggacgaaaactactgtcggaaccctgacgggaaaagggcaccatggtgtcacactaccaactcacaagtgagatgggaatactgcaaaattccaagctgtgactcctctcctgtgagtaccgaacagctcgcccctaccgccccgcctgaacttactccggtagtccaagattgttaccacggcgacggacagagctacagaggaacctcatcgactactaccactgggaagaagtgccagagctggtcctcgatgacccctcataggcatcagaaaacccctgaaaactacccgaacgcaggccttacgatgaattactgcaggaacccagacgcagataaagggccttggtgttttaccaccgatcctagcgtgaggtgggagtactgcaatctgaagaagtgttcgggaactgaggcgagcgtggtggcaccacctcctgtggtgctgctgccagatgtggagactcctagcgaggaggattgcatgtttgggaatggtaagggataccgcggcaagcgcgcgacgactgtgactgggacgccgtgccaggattgggcagcccaagagcctcaccgtcatagcattttcacgccagaaactaaccctcgcgcaggactggaaaagaactactgcagaaatcccgatggcgatgtcggcggaccgtggtgttatactaccaaccctcggaaactttacgactactgcgatgtgccacaatgtgcagcaccatcatttgactgtggtaagccccaggtcgagcctaagaagtgcccagggcgtgtcgtcgggggatgtgtggcacatcctcactcctggccatggcaggtcagtctccgtaccagatttgggatgcatttttgtggaggaaccctcatctcgccggaatgggtgctgaccgcagcacactgtctggagaagtcacctcgcccatcgtcttacaaggtcattctgggggcacaccaggaagtgaacctcgagcctcatgtgcaggagatagaagtgtccagactcttcctggaacccacccgaaaggacattgctcttctcaaactctccagccccgccgtgataaccgataaagtgattcctgcgtgtttgccaagcccgaactacgtggtggcagaccgtactgaatgcttcattaccggatggggggaaacgcagggaacctttggtgcaggtctgttgaaggaagcacagcttccagtcattgagaataaggtgtgcaatcgttacgagtttcttaatggtcgagtccagtccacggaactttgtgcaggacatcttgcgggtgggaccgattcttgtcagggcgattcgggaggtcctctggtctgctttgagaaagataagtacattctgcaaggcgtgacctcctggggactgggatgtgcacggccaaataagccaggagtgtacgtccgcgtgagccggtttgtcacctggatcgaaggcgtcatgcgtaataac

SEQ ID NO: 250953 - DNA, 2430 bp, Artificial Sequence
  Description of Artificial Sequence: Synthetic coding sequence
atggagcacaaggaagtggtgcttctccttcttctgttcctcaaatcgggccagggagagccacttgacgattacgtcaacacccaaggcgcatcgctcttctccgtgaccaaaaagcagctgggagcaggatcgatcgaagagtgtgccgcgaaatgtgaagaggatgaagaatttacttgtcgggcctttcaataccattccaaggaacagcaatgtgtgattatggcggagaaccggaaatcctccatcatcattaggatgcgggacgtcgttctgtttgaaaagaaggtgtacctttctgaatgcaaaaccggaaacggaaaaaactacagagggacgatgtccaagaccaagaatgggatcacttgtcaaaagtggtcgtcgacgtctcctcaccggcctcgcttttccccagccactcatccgagtgaaggcctggaggagaactattgcagaaaccctgacaacgaccctcaggggccctggtgttacacgaccgatcccgaaaagcggtatgactactgtgacatccttgaatgcgaggaggaatgtatgcactgtagcggggagaattacgatggcaagattagcaaaacgatgtcgggtctggaatgccaagcatgggattcacaatctccacatgcacacggttacatccctagcaagttccctaacaagaacttgaaaaagaattactgtcgcaacccagacagagaactcagaccatggtgttttactaccgatcctaacaaacgatgggaactgtgtgatattccaagatgcacgaccccacctccctcctcaggtccgacttaccaatgtcttaagggtaccggtgaaaactaccggggtaatgtggccgtgaccgtgtcgggacacacctgtcagcattggtcagctcaaactccgcatactcacaatagaaccccagagaatttcccgtgcaagaatcttgatgagaactactgtcgtaacccagatggcaaaagagcaccttggtgtcacaccactaattcgcaggtgcgttgggaatactgcaaaattccatcttgtgattcctcgccagtctcgactgagcagctcgctccaaccgcacccccggaactcacccctgtggtgcaggattgctaccatggagacggacaaagttacagaggaacctcaagcacgactactaccggaaaaaagtgtcaatcctggtcctccatgaccccccatagacatcaaaagactccagaaaactatccaaatgccggactgaccatgaactactgcagaaatcccgatgccgacaaaggtccttggtgctttaccacggatccttcggtgcgctgggaatattgtaatctgaagaagtgttccggcactgaagcatcagtcgtcgccccacctcctgtagtgctgctgccggatgttgaaacccctagcgaggaagattgtatgtttggcaatggcaaaggctatcggggtaaacgggcaaccaccgtgacggggactccttgccaagactgggcagcacaggaaccccaccggcattcgatctttactccagagacgaatccgcgcgcgggactggagaagaactactgtagaaacccagatggagacgttggaggcccatggtgttacaccacgaatccacggaagctgtacgactactgtgatgttccgcaatgtgcagcaccctcgtttgactgcggaaagccccaggtggaacccaagaaatgtcctggaagagtggtgggcggttgcgtggcccatcctcactcgtggccttggcaggtgtccctgaggacccgattcggtatgcatttttgcggtggaacccttatttcaccagagtgggtgctcactgccgcccattgtctcgagaagtccccaagacctagctcatacaaggtgatcttgggcgcccaccaggaggtgaaccttgagcctcatgtgcaggagattgaagtctcacggcttttcctggaacctactagaaaggacattgcactgctgaaactttcgtcccccgcagttataaccgacaaagtgatccctgcgtgcctcccttcgccgaattatgtggtggcagatcgcactgagtgttttatcactggatggggggaaactcaagggaccttcggggcaggccttcttaaggaggcacagctgcctgtgattgaaaacaaggtctgtaatagatacgaatttctgaacggacgcgtgcaatccaccgagctctgtgcaggccacctggccggaggtactgatagctgtcagggagatagtggtgggcctcttgtgtgcttcgaaaaggataagtacatcctgcagggagtgacttcatgggggctgggttgtgcacgaccgaacaagcccggtgtgtacgtgcgcgtgtcccgctttgtgacttggatagaaggagtgatgcgtaataac

SEQ ID NO: 250954 - DNA, 2430 bp, Artificial Sequence
  Description of Artificial Sequence: Synthetic coding sequence
atggagcacaaggaagttgttctactgctactcttgttccttaagtcaggtcagggtgaacctctggacgactatgtcaatacacagggggcatcacttttctccgttaccaaaaaacagctgggcgccggaagtatcgaggagtgtgctgctaagtgcgaggaggatgaagagtttacttgtcgtgcttttcagtaccattcaaaggaacagcagtgcgtcattatggccgaaaacagaaagagctccatcatcatcaggatgagggacgtagtgctgtttgagaagaaagtgtatttgtctgaatgcaagacagggaatgggaagaactatcgaggcacgatgagtaaaaccaagaacggaataacttgtcaaaagtggtcatcaacatcccctcatcgaccgcggttctcccctgcaacgcatcctagcgaaggcttggaggagaactactgtagaaatcccgacaatgatccacaggggccctggtgctatacaacagatcctgagaagcggtacgactactgtgacattctagagtgcgaagaggaatgcatgcactgctctggcgaaaactacgacggtaagattagtaagactatgtcggggctggagtgccaggcttgggactctcagtccccgcacgcacatgggtacatcccgagtaagtttcccaataagaatctgaagaaaaactattgtagaaacccagacagggagctacgcccgtggtgctttacaactgatcccaacaaaagatgggaattgtgcgatatcccacgctgtaccacacccccaccttcttctgggcccacttatcagtgtcttaaaggcacgggggaaaattatagaggaaatgtcgctgtgactgtgtcaggccacacctgtcaacactggtccgctcaaactccccacacccataataggacccctgaaaactttccatgcaaaaatctggacgagaattattgccggaacccagacggaaagcgagccccatggtgccacacaacgaatagccaggtccgctgggaatattgtaagattccctcatgtgatagctctccagtctcaaccgagcagctggcacctacggcgcctcccgaacttactccagtggtgcaggattgttaccatggggacggccagagctaccgaggaacttcatctaccactaccacggggaagaagtgtcagtcatggagcagtatgaccccgcaccgccaccagaagacccccgaaaactaccccaacgctggccttactatgaactactgtcgtaacccggacgccgacaaaggcccctggtgcttcacgacagacccaagtgtgagatgggagtactgcaatctgaagaagtgcagtggaacggaggctagcgtggtggccccaccacccgtcgttctgctacccgatgtggaaaccccaagcgaggaggattgcatgttcggcaacgggaagggctaccggggtaagcgcgccaccacagtgacgggtactccatgccaagactgggccgcccaagagcctcacaggcatagcatcttcacacccgagactaatcctagagccgggctcgagaaaaactactgcaggaatcccgatggggatgtgggtgggccttggtgttatacgaccaaccctagaaagttatatgactactgtgacgtgcctcagtgcgcagccccctcatttgattgtgggaagccccaagtggaacccaaaaagtgccctggacgggtcgtgggcgggtgcgtcgctcatccacacagctggccatggcaggtatcgctgaggacacggtttggcatgcatttttgtggggggaccctgatcagtccggagtgggtactaacagctgcacattgcctggagaaaagccctcgtccatcatcctataaggtgatacttggggcacaccaagaggtcaaccttgaaccccacgtacaggagatcgaggtgtcccgattattcctcgagccaaccaggaaggatattgccctgctcaagctttctagtccggctgttatcaccgataaggtcattcctgcatgcctgccttcccctaattacgtggtggctgatcggacagaatgctttattacaggttggggcgagacacagggaacattcggggcaggcctgttaaaagaggcacaactccccgtcatagagaacaaggtatgtaaccggtacgagtttctgaatgggcgcgttcaatctacagagctgtgtgccggccatctggccgggggtacagattcatgtcagggagattccggtggccctttggtgtgctttgagaaggacaaatacatcctccagggggtcacctcctggggactgggatgtgcccgccctaataaacccggggtgtacgtgcgggtttctcggttcgtgacttggatcgagggcgtaatgaggaacaat

SEQ ID NO: 250955 - DNA, 2430 bp, Artificial Sequence
  Description of Artificial Sequence: Synthetic coding sequence
atggagcacaaggaagtggtgctgttgctcctcctgtttttaaaaagtggacaaggtgagccactggatgactatgtgaacacacagggagctagcctgtttagcgtcaccaaaaaacaactgggcgccggttctatagaagagtgtgccgcaaagtgcgaagaagatgaagagttcacctgccgcgctttccaatatcacagtaaggaacagcagtgtgtgatcatggcggagaataggaaatcatccatcataattagaatgagggatgtggtgttattcgagaaaaaagtctacctctctgaatgtaaaacaggaaacggtaagaactacagggggaccatgtcaaagactaaaaacggcatcacctgccaaaaatggtctagtactagccctcataggccccgcttcagcccagcgacgcatccttcggaaggtctggaggagaattattgcagaaatcctgacaacgacccccagggcccttggtgctatacaactgatccagagaagagatatgattattgcgatatacttgagtgcgaggaggagtgcatgcactgttcaggagaaaattacgatggcaagatttcaaaaaccatgagtggtctggaatgtcaggcttgggactcacagtccccccacgctcatgggtatatccccagcaagttcccaaacaagaatctcaaaaagaattactgtagaaatccagatagggaactacgcccctggtgcttcactactgatcccaataaaaggtgggaactctgtgacataccgcgctgcaccacacctccgccatcatctgggcccacataccaatgtcttaagggtacaggtgaaaattatcgagggaacgtggccgtgaccgtgagtgggcacacttgccagcactggagtgcccaaacccctcatacacataatagaaccccggagaacttcccctgcaaaaatcttgacgaaaactactgcagaaacccagacggaaagagagctccatggtgtcacacaacgaatagccaggtgagatgggaatattgtaagatcccatcatgcgatagtagccccgtatcaacagagcagttagcccccaccgctcctcccgagctgacacctgtggtgcaggattgttatcatggggacgggcagtcctatagagggacctctagcacaacgacgaccggaaagaaatgtcaatcctggtcttcaatgacgccccataggcaccagaaaacccccgagaactatccgaacgcaggactgaccatgaattactgtcgaaacccagacgctgacaaggggccttggtgtttcacaaccgatccctccgtgcggtgggaatactgcaatctgaagaagtgtagtggtactgaggcctccgtggtggcgccccctccagtcgtgttactgcctgacgtggaaacaccctccgaggaagactgcatgtttgggaacggaaagggatacagaggaaagcgggcgacaaccgttaccggcacgccctgccaggactgggcagcacaggaacctcataggcattctattttcacgcccgagaccaacccacgcgccgggttggagaagaattattgtcgcaaccctgatggggatgtgggagggccttggtgttataccaccaatccgcgcaagctgtacgattattgtgacgtgcctcagtgcgctgcccctagttttgattgcgggaagccccaagtggagcccaagaagtgcccgggaagagttgtggggggatgcgttgcccacccccactcgtggccttggcaggtgagtctccgcactcggttcggtatgcacttctgtggtggcactctgatctcaccagaatgggtcttaaccgcagcccactgcctggaaaagtcacctcgcccatccagctacaaagtgatcctgggagcacatcaggaggttaatctcgaacctcatgtgcaggaaattgaggtaagccgcttgtttcttgaacccaccagaaaagatattgcactgctgaagctttcctctcccgcggtgatcacggacaaagtcatccccgcctgtctgccatcaccaaactatgtggttgctgatcgcaccgagtgctttattactgggtggggggagacacagggtacatttggtgccggtctattgaaagaggctcagctgccggtaatcgagaataaagtctgtaatcgttacgaatttctgaatggtcgggtccagtccacagaactgtgcgcggggcacctcgctggggggacggatagctgccagggcgacagcggaggtcctctagtttgcttcgaaaaagataaatacatacttcagggtgttacctcatggggcctcggctgtgcaaggcccaataagccaggcgtatacgtacgcgtcagccgcttcgtgacgtggattgagggcgttatgaggaataac

SEQ ID NO: 250956 - DNA, 2430 bp, Artificial Sequence
  Description of Artificial Sequence: Synthetic coding sequence
atggagcacaaggaagtggttttgctgctgctgttattcctgaagagcggccagggcgagcccctggatgactacgttaatacacagggtgcatctctgttctccgtgaccaagaagcagctcggggccggctccatagaagagtgcgccgcaaagtgcgaagaggatgaagagtttacgtgtcgcgcctttcagtatcactccaaagaacagcaatgtgtcatcatggcggagaacaggaagagctctatcataatccgcatgagggacgtggtattattcgagaagaaagtgtatctcagcgagtgtaaaaccggaaacggaaagaactaccgaggaactatgagcaagacaaaaaatggtataacctgtcaaaagtggagttccacttcacctcatcggccccgcttctcaccagccacccatccctccgaaggacttgaagagaattactgccgcaacccggataacgacccacaggggccgtggtgttacaccaccgaccccgagaagaggtacgattattgtgatatcctcgagtgtgaggaggagtgcatgcactgctctggtgagaattacgatggaaagatatccaagacaatgagtggactggagtgccaggcctgggacagccagtcaccacacgctcacggttatattccgagtaagttcccgaataagaatcttaagaagaactactgcaggaaccccgaccgtgaactccgcccttggtgcttcaccacggatcccaacaaaaggtgggagctgtgtgatatcccaagatgcaccactccacctcctagctccggcccaacctaccaatgcttgaagggcacgggtgagaattatagggggaacgtggcggtgactgtcagtggccatacctgccaacactggagcgcccagacacctcatacccacaatcggacccccgagaacttcccctgtaagaatctcgacgaaaactattgtcgcaaccctgatggtaaacgcgcgccttggtgtcacactaccaacagccaggtccgctgggagtactgtaagatcccaagctgcgattcttcgccggtttctaccgagcagctggcacccactgccccacccgagctgacccccgtcgttcaggattgttaccacggggatggacaatcgtaccgcggcactagttccacgacgacaacaggcaagaaatgtcagtcatggagtagtatgacccctcacaggcatcagaaaacgccagagaattaccccaatgctggccttaccatgaattactgcaggaaccctgatgcagataaggggccttggtgtttcaccacagatccctctgttcgctgggagtattgtaacctcaagaagtgtagcggtacagaagccagcgtcgtcgcgcccccaccagtcgtccttcttcctgacgtggagaccccctccgaggaagactgcatgtttggcaatggcaagggttatcgtggaaagcgagccacaacagtcacgggcacgccgtgtcaagactgggctgctcaggaaccccatcgccatagtatctttactccagaaactaatccaagagcaggactggagaagaactattgccggaatccggacggggacgtggggggaccttggtgctatactactaatccccgaaaactatatgattactgcgatgtgccccagtgtgcagctcccagcttcgattgcggcaaaccacaggttgaaccgaagaagtgtccaggtagagtggtgggcggctgtgtcgctcaccctcactcttggccatggcaagtgagccttcggacaagatttggcatgcatttttgtggtgggaccttaatttcacccgagtgggttttaaccgccgcgcactgcctggagaagagtccccggcccagcagttacaaggtaatcctaggggcccaccaggaggtgaacctggaaccacacgtgcaggagatcgaggtgagtcgattgttcttggagcccaccaggaaagatatcgccttgctcaaactgtcatctcctgccgtgattacagataaagtcatccccgcctgccttccctctccgaattacgttgtggccgatcggacagagtgttttatcaccggttggggggagacccaggggacctttggagctgggcttcttaaagaggcccagctgcccgtcattgagaacaaagtgtgcaaccggtatgaattcctcaacggtagagtgcagtcaaccgagttgtgtgccggtcatttggccgggggcactgattcgtgccagggtgactcaggcggtccgctggtgtgcttcgaaaaagataagtatattttacagggggtgaccagctggggcctggggtgcgcaagaccgaacaaaccgggcgtatatgtgcgggtgtccagatttgttacatggattgaaggagtgatgcgcaacaac

SEQ ID NO: 250957 - DNA, 2430 bp, Artificial Sequence
  Description of Artificial Sequence: Synthetic coding sequence
atggagcataaggaagtggtgctgctgctactactgttcctaaagtccgggcagggcgagccccttgatgattacgtgaatacacagggggcttctctattctctgtgaccaaaaaacagctcggcgccggcagtatcgaggagtgcgccgccaagtgtgaggaggatgaggagttcacctgtagggccttccagtatcattcaaaggagcagcagtgcgtcatcatggcagaaaacaggaaatcttctattatcatcaggatgagagacgtggtgctgttcgaaaagaaggtgtacctgtctgaatgcaagacaggcaatgggaaaaactaccgcggaaccatgtccaaaacaaaaaatggcatcacatgccagaagtggtcctctactagtccacacaggcctcggttcagtcccgccacccacccttccgagggcctggaggagaattattgtaggaatcctgataatgacccccagggcccttggtgctatactacagacccggaaaaacgctacgattattgtgacattttggagtgcgaggaggagtgcatgcactgctcaggggagaattatgatggaaaaatatctaagactatgagcggtctcgagtgtcaggcatgggactctcagagcccccatgcccacggctacatcccttctaagttccctaacaagaatttaaagaagaattactgccgaaaccccgatagggagttgagaccatggtgtttcactacagacccaaacaagaggtgggaactgtgcgacatcccccgttgcaccacccctcccccaagcagtgggcccacataccagtgtctcaagggaaccggcgagaattaccgggggaacgtagccgtgaccgtgtctggccatacatgccagcattggagcgcacagactccacacacccacaatcggacccccgagaatttcccatgcaagaatctggatgaaaactactgcagaaacccagatggaaagcgcgcaccctggtgccacacaaccaatagccaggtgcgatgggaatactgcaagattcctagctgtgatagttctcccgtgtccaccgagcagctcgctcctactgctccccccgagctgacacctgtggttcaggattgttatcacggagacggccagtcctatcggggcacttccagcaccaccacaacagggaaaaaatgccagagttggagtagcatgacaccccatcgccaccagaagacccctgagaattatccaaacgctggcctcactatgaactattgtcgaaatcctgatgcagacaaaggcccatggtgttttacaaccgatccttccgtacggtgggaatactgcaacctcaaaaagtgttcaggtactgaggcttccgtggtagcaccgccccctgtggttctgttacctgatgtcgagactccatccgaggaggactgtatgtttgggaatggtaaaggctaccgtgggaagagagccacaactgttacaggcaccccatgccaggactgggccgcccaagaaccccataggcatagtatctttacccccgagaccaaccccagagccgggctggaaaaaaactactgccggaatcctgatggcgatgtcggcggtccttggtgttacaccaccaatccacggaaactgtatgattattgcgatgtcccacagtgtgcagctcctagcttcgattgtggaaaaccacaggtcgaaccaaaaaaatgtcctggtcgcgtggtgggcggctgcgtcgcacatcctcactcttggccatggcaagtgagtctgaggacacggtttggtatgcacttctgcggcgggacactgatctctcctgagtgggtattgacagctgctcattgcctggaaaagtcaccacgccctagctcatataaggtaattttgggcgcccatcaggaagtgaatctggagccccacgttcaagagattgaagtatccaggctgttcttagaacctactcgcaaagacatagcattactaaaattatcctccccggccgtgattacagataaggtgatcccagcctgtctgccttccccaaactacgtggtcgccgaccgaacagaatgtttcatcacaggctggggggagacccaaggcacctttggggccggcctgctgaaggaagctcagctgccagttatagagaacaaagtgtgtaacaggtacgaatttctaaatggcagggtccagtccaccgaactgtgtgccgggcaccttgcaggcggcaccgactcctgccaaggcgacagcggcggcccactggtgtgttttgagaaggacaaatatattttacagggtgtcacttcctggggtctcggttgtgctcggccaaataagcctggagtttacgtacgcgtgtcacgatttgtgacatggatagaaggggttatgaggaataat

SEQ ID NO: 250958 - DNA, 2430 bp, Artificial Sequence
  Description of Artificial Sequence: Synthetic coding sequence
atggagcacaaggaggtggttctgcttctattgcttttcttaaagtctggtcagggtgaacctctcgacgattatgtcaacacacagggcgcaagcctttttagcgtgactaagaagcagcttggtgccggttccatcgaggaatgtgccgcaaagtgtgaggaagatgaggagttcacctgcagagctttccagtaccattctaaggaacagcaatgcgtcatcatggctgagaaccgtaagtccagtattataattagaatgagggatgtagtcctgttcgagaaaaaggtctatttgtctgagtgtaagacaggtaacggcaaaaattaccgaggaactatgagcaagacaaaaaacgggatcacttgtcagaagtggtcctccacgagcccccataggccccgtttctcccccgccacacacccgagtgaaggtcttgaggagaattattgccgtaatcctgacaacgatccccagggtccatggtgttataccactgatccagaaaaacggtacgattattgcgatattctcgagtgcgaggaggaatgcatgcattgttccggtgagaactatgacgggaaaatttctaagacaatgtcagggctggaatgccaggcatgggactcacagagtccacatgctcacggctatattccatcgaagttccccaacaagaacctgaagaagaactactgccggaacccagatagggagcttcgtccgtggtgtttcacaactgaccccaataaaagatgggaactctgcgatatacctcgatgcacgaccccccctccatctagcggtccgacataccaatgccttaaaggaacgggtgagaattaccgaggaaatgttgctgtaactgtaagtggtcacacgtgccagcactggtcggcacagactccccatacacacaacagaacccccgagaacttcccgtgcaagaacctcgacgaaaactactgtcgaaaccccgatggaaagagggccccgtggtgtcatacgacgaactctcaagttcgttgggaatactgtaagattccgtcatgcgacagctcgcccgtttccacggaacagttggcccctaccgcaccacccgagcttactccagtggtccaggattgctatcatggcgatggacagtcatacagaggcaccagttccacaactactacgggcaagaagtgccagagctggtcgtctatgaccccccaccgtcaccaaaagacgccggaaaattatcctaatgccggactgacgatgaactactgtagaaacccagatgctgacaaaggcccgtggtgcttcactaccgacccttcggtacgttgggagtattgcaaccttaaaaagtgctccggtacagaagccagtgttgtggcacccccgcccgtcgtactgctcccggatgtcgagactccaagtgaagaagactgcatgtttggtaatgggaaaggatacagaggaaagagagccaccaccgttaccggtaccccctgccaagactgggctgcgcaagagcctcataggcactcaatttttacaccagagaccaatccccgggcaggcctcgagaagaactactgtcggaaccctgacggagacgttggaggaccgtggtgttatacgacgaacccacgaaagctctacgattattgtgatgttcctcaatgcgcggccccatcgtttgactgcggaaagcctcaggtcgagccaaagaagtgccctggtcgagtcgtcggtggatgtgtcgcgcatccacattcttggccctggcaagtgtcgctccgcacacgcttcggtatgcacttttgcgggggaacactcatcagtcctgaatgggtgctaaccgcagcccattgcttggaaaagagtccacgaccttcctcttacaaagtgattcttggtgctcatcaggaagtaaacctggagccacacgtacaggagattgaagtgagtcgtttgtttctcgagcccaccagaaaagacatcgctctcctgaaactctcttctcctgccgttatcaccgacaaggttataccagcgtgtctcccgagcccaaactatgtggtcgcggaccgtacagaatgtttcattaccggatggggagagacccagggcacattcggagctggtctcctcaaagaagcgcagttgcccgtgatcgagaacaaggtttgcaatcgttacgaatttctaaatggtcgagtccaatcaactgagctatgcgctgggcacttggcgggtggtaccgactcttgccagggagactcggggggccctttagtatgtttcgagaaagacaagtacatcttacaaggtgtcacgtcctggggactcgggtgcgcacgcccaaataaaccaggagtgtatgtccgggtgagtcgatttgtgacctggatcgaaggtgtgatgcgtaacaac

SEQ ID NO: 250959 - DNA, 2430 bp, Artificial Sequence
  Description of Artificial Sequence: Synthetic coding sequence
atggaacataaggaggttgtgttactacttctccttttcctgaagtcggggcaaggggagcccttagatgattacgttaatacacaaggtgcttctcttttctctgtgactaagaagcaactgggagcaggctcgattgaagaatgcgcagctaaatgtgaagaggatgaagagttcacttgtagagctttccagtaccacagtaaggaacaacaatgcgtaatcatggcagagaaccgtaaaagttcgataattatcagaatgcgagatgttgtactattcgaaaaaaaggtctatttgagtgagtgcaagacaggaaatggcaaaaactatagaggaacgatgtctaaaacaaaaaatggaattacttgccaaaagtggtcttcaacgagtcctcatagacctcgtttttcaccagcaactcacccgagtgaaggtctggaagaaaattactgtcggaatccagataacgatccgcaaggtccatggtgctatacgacagatccagaaaagcgatacgattactgcgacattttggagtgcgaagaagagtgcatgcactgttctggtgagaattacgatggaaagatttcaaaaaccatgtctgggttggagtgccaagcgtgggattctcaatcaccacatgcccatggatatataccatctaaattcccaaataaaaacctcaagaagaattactgccggaatcctgatcgagaactccgcccatggtgctttactactgacccaaacaagcgatgggaactctgtgatattccacgatgtacaactccaccaccttcaagtggaccaacataccagtgtcttaagggaacgggggaaaattatagaggaaatgtcgctgtgacagtcagtggacatacctgtcagcattggtcggcccaaacgccacatacccacaacagaacaccggagaactttccatgcaaaaatctcgatgagaattactgccgtaatcccgatggaaagcgtgcaccatggtgtcataccacaaattcgcaagtgagatgggaatattgtaaaattccgagctgcgactcgagtcctgtttctacagaacagcttgctccgacggccccaccggagctgacccctgtggtacaagactgttaccacggtgacggtcagtcgtatcgtggtacaagttcaaccacgacaactggtaaaaagtgccaatcttggtcatctatgactccacatcggcatcaaaaaacccctgagaattaccccaatgctggattgacaatgaattattgtcgaaatccagatgcagacaaaggaccgtggtgctttaccaccgacccgtctgtacgttgggagtattgcaatctaaagaagtgctcaggaacggaggcatcggttgtggcacccccaccagtcgtcctccttccagacgtagagactccttcggaggaagattgtatgtttggaaacggtaagggatacagaggtaaacgtgctacaacagtcactggaacgccgtgtcaagattgggccgcacaggaaccacatcgtcattctattttcacgccggaaacaaatcctcgggcagggctcgaaaaaaactattgtcgtaatccagatggagacgttggtggcccatggtgttataccactaacccacgtaagctttatgattactgtgatgtgccccaatgcgccgccccatctttcgattgtggaaagcctcaggtcgaaccgaaaaaatgcccaggacgagtggttggaggctgtgtagcacatccacacagttggccatggcaggtttctttacgtacccgttttggtatgcatttctgtggaggaactcttatttctccagaatgggttctgacagcagcacattgccttgaaaaaagcccgcgccctagctcgtataaggtgattctgggagctcaccaggaggtcaatctggagccgcacgttcaagaaatcgaggtatctcgactcttcttggaaccaacccgaaaagacattgccctactaaagctcagttcgccagccgttattacagataaagttattccagcttgtctcccatcgcctaattatgtggttgcggatcgcactgaatgcttcataacaggatggggggaaacacagggtacattcggggcaggattgctgaaagaggcacaattgccagtcatagagaataaggtttgcaatcgttatgagttccttaatggaagagttcagagtacggaactttgcgctggtcatttagccggagggacagattcgtgtcagggagattcagggggtccgttggtctgctttgaaaaggataagtatattctgcagggagtgacgtcatggggactgggatgtgcgcgacccaataagccgggagtgtatgttcgggtgtcaagatttgtaacttggatcgaaggtgtgatgagaaataac

SEQ ID NO: 250960 - DNA, 2430 bp, Artificial Sequence
  Description of Artificial Sequence: Synthetic coding sequence
atggagcataaagaagtggtgctgcttcttctcctgtttctgaagtctggacagggagaaccgctggatgattacgtgaacacccaaggggcatcgctcttttcggtgaccaaaaaacaactgggagcaggaagcatcgaagagtgtgcagcgaaatgtgaagaggacgaagaattcacctgtcgcgcattccagtaccacagcaaggaacaacagtgtgtgattatggccgaaaatagaaagtcgagtatcataattcggatgcgggatgttgtgctttttgagaaaaaggtgtacctctccgagtgtaagactggaaacggtaagaattaccggggtactatgtcaaagactaagaacggaataacgtgtcagaaatggtcgtccacttcgccacatagaccaaggttttcacccgcaactcatccttctgagggacttgaggaaaactactgccgtaatcctgacaacgatccgcaaggtccttggtgctacacgactgatcctgaaaaacgatacgattattgtgatatcttggaatgtgaggaagaatgtatgcactgttccggcgaaaactacgatggcaagatttcaaagaccatgtcaggactggagtgtcaggcatgggatagtcaaagcccccatgcccatggatacattcctagcaagttccccaacaagaacctcaagaagaattactgccgcaacccagatcgtgagctcagaccatggtgtttcaccactgaccctaataagaggtgggaactttgcgatatcccaaggtgcactacccctcccccttcgagcggtcctacctaccagtgtctgaagggtaccggcgagaattatcggggtaacgtcgcagttaccgtgtcgggtcatacgtgccagcattggagcgctcagactcctcacactcacaaccgcaccccggaaaactttccgtgcaagaatctggacgagaactactgtagaaaccccgatggcaagagagcgccatggtgtcatactactaactcccaggtccgctgggaatactgtaagattccatcgtgtgattcgtcacccgtgtcgacggagcaacttgctcctaccgcacctcctgagcttacccccgtcgtgcaagattgctaccacggagatggacaatcctacagagggacctccagcaccactaccactggaaagaagtgtcagtcctggtcctccatgaccccacatagacaccaaaagaccccagaaaactacccaaacgcagggcttactatgaactactgtcgcaacccagacgcagataagggaccctggtgttttaccaccgacccgtcagtacggtgggaatattgcaatcttaagaaatgctcgggtactgaagccagcgtggtggctccgccaccagtcgtgctgcttccagacgtcgagactccctcggaagaagattgcatgtttggcaacggcaaagggtaccggggtaaaagggcgaccaccgtaacgggcaccccttgccaagactgggccgcacaagagcctcatcgccattcaatctttacccctgaaaccaatcctcgcgcaggtctggaaaagaattactgtcgaaatcctgacggagatgtcggaggaccttggtgttacaccactaacccacggaagttgtacgattactgtgatgtgccacaatgtgcagcaccgagcttcgactgcgggaagccgcaagtggagcctaagaaatgccctggccgtgttgtcggtgggtgcgtagctcacccccattcatggccatggcaggtgtcacttaggactcgatttgggatgcacttctgtgggggcacgctgatctccccggaatgggtgcttactgcagcccattgtcttgagaaaagcccgaggccatcttcgtacaaagtgattctcggcgcccatcaggaagtgaatctggaacctcacgtgcaagagatcgaagtctccagattgtttctcgaaccaacgcgtaaggacatcgcactgcttaaactgagctcacctgcggtgataactgataaagtgattcctgcctgtctcccatcgcccaattacgtcgtcgcggacagaaccgaatgtttcattaccggttggggagaaacccagggaacttttggcgcgggactgttgaaggaagctcaactccccgtaattgagaacaaggtatgtaaccgctatgaatttctgaacggtcgggtgcaaagcactgagttgtgcgccgggcaccttgcaggaggaaccgactcatgccaaggagactcgggtggtcccctggtgtgtttcgaaaaggacaagtacattctgcagggcgtgacttcttggggcctcggttgcgcaagacctaacaaaccgggagtctacgtccgagtgtccagatttgtgacgtggattgaaggagtgatgcggaataat

SEQ ID NO: 250961 - DNA, 2430 bp, Artificial Sequence
  Description of Artificial Sequence: Synthetic coding sequence
atggagcacaaggaagtggtcctgcttctcctcctgtttctgaagtcgggacagggcgaacccctggatgattacgtgaatacccagggcgcctcactgttctcggtgactaaaaagcaactgggagccgggtcaatcgaggaatgcgccgctaagtgtgaggaagatgaggaatttacttgccgagcgttccagtatcactctaaagaacagcagtgcgtgatcatggccgagaaccgcaagtcctcgatcattatccgaatgagagacgtcgtcctgtttgagaagaaggtctatctgtcagaatgcaagactggaaacggcaagaactacaggggtactatgtccaaaaccaaaaacggaatcacttgccagaagtggtcgtcaacttcacctcatagacctcggttctcccccgcaactcatccttcagagggactcgaggagaactactgcaggaatccggacaacgacccacaagggccttggtgttacacgactgatccggaaaagaggtacgactattgcgatatcctggaatgcgaggaggagtgcatgcattgcagcggggaaaactacgacggaaagatctcgaaaaccatgtcgggactggagtgccaagcatgggacagccagtcacctcacgcccacgggtacattccctcaaagtttccgaacaaaaacctcaaaaagaactattgccgcaatccagaccgggaactgaggccctggtgtttcactaccgacccaaataagcggtgggaactctgcgacatcccgcggtgcaccactccgccgccctccagcggaccgacctatcaatgccttaaaggtacgggcgaaaactacagaggtaacgtcgccgtgactgtgtccggccatacttgtcagcattggagcgcacaaactccgcatacgcacaacagaacgccggagaatttcccatgtaaaaacttggacgagaattactgcaggaacccggacggaaaacgggctccctggtgccataccacgaattctcaagtgcggtgggaatactgtaagatcccaagctgtgacagctcacctgtgtcgactgagcaactggcgccaactgccccgccggagctcaccccggtggtgcaggactgctaccacggagatggtcagtcgtacagaggcacctccagcactaccaccaccggtaagaaatgtcagtcatggtcctcaatgaccccacatagacaccagaaaacgccggaaaactaccctaacgcaggcctgaccatgaattactgtcgcaatcctgacgctgacaaaggtccgtggtgctttaccaccgacccttctgtgcgctgggaatactgcaatctcaagaaatgcagcggaactgaagcatcggtggttgcgccgccgcctgttgttttgctccctgatgtggaaaccccttcagaggaagattgcatgttcgggaacggaaaggggtaccgtggaaaacgggcgacgactgtgactgggactccctgccaggactgggccgcccaggagcctcaccgccactccattttcaccccggaaaccaacccacgggcgggactcgagaagaactactgccggaacccagatggcgacgtgggtgggccttggtgctatactaccaatcccagaaagctgtacgattactgcgatgtcccgcagtgcgcggcaccgtcgttcgactgcgggaagcctcaggtggaacctaagaagtgccctggacgggtcgttggaggatgcgtggcgcacccgcactcatggccttggcaggtgtcactgagaacccgtttcggcatgcacttttgtgggggcacccttatcagcccagaatgggtgcttactgcagcccactgcctcgagaagtccccgcggccgagcagctacaaggtgatactgggcgcgcaccaagaagtgaatctcgagccgcacgtgcaagaaattgaagtctcccgcctgttcctggaaccaacccggaaggatatcgcactgctcaagctgtcctcacccgccgtgatcactgacaaggtcatcccagcctgcctcccatccccaaactacgtggtggctgaccggaccgagtgtttcatcacgggttggggtgagacgcagggcactttcggcgctggactgctgaaggaagcgcagttgcctgtcattgagaacaaggtgtgtaaccggtacgagtttctgaatggtcgcgtgcaaagcaccgagctctgtgctggacacctcgctgggggcactgattcctgccaaggagattccggcggaccgcttgtctgtttcgaaaaagataagtatatcctccaaggagtgacttcgtggggactcggttgcgcccgccctaataagccaggagtctacgtgcgcgtgagccgcttcgtcacctggatagaaggcgtgatgagaaataac

SEQ ID NO: 250962 - DNA, 2430 bp, Artificial Sequence
  Description of Artificial Sequence: Synthetic coding sequence
atggagcacaaggaagtcgtgcttctcttgctcctgttcctgaaaagcggacaaggggaaccacttgacgactacgtgaatacccagggggcgtcgctcttctcagtaactaagaagcaactcggggccggttctatcgaggaatgcgcagcgaagtgtgaagaagatgaggagttcacctgcagggcgtttcagtaccattccaaagagcaacagtgcgtgatcatggcggagaaccgcaagtcgtcgatcatcatccgaatgcgcgacgtcgtcttgttcgagaagaaggtgtacctgtcagaatgcaaaactggaaatggcaagaattaccggggaactatgagcaaaaccaagaacggaataacctgccaaaagtggtctagtaccagcccccacaggccccgcttctcgcccgccactcacccgtccgagggactggaagaaaactactgccgtaatccagataacgatccgcagggaccatggtgttacaccactgaccctgaaaaaagatatgattactgcgacatcctggaatgcgaggaggaatgcatgcactgttcgggggagaactacgacggcaagatcagtaagactatgagcgggctggaatgccaggcgtgggactcgcaatccccgcacgctcatggatacatcccaagcaagttcccgaacaaaaatctgaagaaaaactactgtcggaacccggaccgggaactccgcccgtggtgcttcactactgaccccaataaacgctgggagctgtgcgatatccctcgttgtactaccccgcctccctcctctggtccaacttaccagtgcctgaaagggaccggcgaaaactatcgcggtaatgtggcagttaccgtgtcgggccacacctgccaacactggtcagctcagaccccacatactcataacaggactccagaaaacttcccgtgcaagaacctcgatgagaactattgccgaaacccggacggtaagcgcgcaccgtggtgtcacaccaccaacagccaagtgaggtgggaatactgcaagatcccatcatgcgattctagcccagtgtccacggaacagctggctccgacggcgccacctgaactcaccccggtcgtgcaagactgctaccatggcgacggtcagtcgtaccggggaacgagcagcaccacgaccaccggcaagaagtgtcagtcgtggtcgtcgatgaccccgcacagacatcagaaaactccggaaaactacccgaacgccggattgaccatgaattactgccggaatcccgacgccgacaaaggaccgtggtgtttcaccaccgatccatcagtgcgatgggagtactgcaatctgaaaaagtgctcgggaaccgaggcctccgtggtcgcgcctccgccggtagtgctcctccctgacgtcgaaaccccttcagaggaggattgtatgtttggaaatggaaagggatatcgcggaaaaagagctacgactgtgacgggaaccccttgccaggactgggccgcccaggaaccgcaccgccattccatcttcactccagagactaacccacgcgccggcctggaaaagaactactgtaggaacccggacggggatgtgggcggaccgtggtgctatactactaatccgcggaagctgtacgactactgcgatgtcccacagtgcgcagccccttcgttcgattgcggcaagccgcaggtggaacccaagaagtgtccgggtcgggtggtcgggggttgtgtggcgcacccacatagttggccgtggcaagtgtccctcagaacccggtttggcatgcacttctgtggcggaactctcataagcccggaatgggtcctgaccgcagctcattgtctggagaagagccctcggccgagctcatacaaagtcattcttggagcacatcaggaggtcaacctcgaaccgcacgtgcaggaaatcgaggtttcccggctgtttcttgaaccaactcgcaaggatattgcacttctcaagctgtccagcccggccgtgatcaccgacaaggtgatcccggcatgcctcccctcccctaactacgtggtcgccgatcgaactgagtgctttatcaccggatggggagagactcaagggaccttcggagccggactcctgaaagaagcccagctgcctgtgatcgaaaacaaggtgtgcaatcggtacgaattcctcaacggaagagtgcagagcaccgagctttgcgcgggtcacctggccggcggcactgactcctgtcaaggggacagcggaggaccgctggtttgcttcgagaaagataagtacattttgcaaggggtgacttcgtggggactgggatgcgctagacccaataagcccggggtttacgtgcgcgtctcacgttttgtaacctggattgaaggcgtgatgcgcaacaat

SEQ ID NO: 250963 - DNA, 2430 bp, Artificial Sequence
  Description of Artificial Sequence: Synthetic coding sequence
atggaacataaggaagtcgtcctgcttctcctgctcttcctgaagtccggccaaggcgaacctctggacgattacgtcaacacccaaggtgcctcactcttttcagttactaaaaagcagctcggcgccgggtcgatcgaagaatgcgcagctaagtgtgaggaggatgaggagttcacttgccgggcattccagtaccattccaaagagcagcagtgcgtgattatggcagaaaatcgtaagtcgagcatcatcataaggatgcgggacgtggtgctctttgagaagaaggtctatctctcagagtgcaaaactggaaacgggaaaaactaccggggcacgatgtccaaaactaagaatggaatcacctgccaaaagtggtcgagcacttcccctcataggccacggttcagcccggccacccacccctcggaaggtctggaggaaaattactgcagaaatccggacaacgaccctcaaggaccatggtgttataccacggacccagagaagagatacgattattgtgacatcctggaatgtgaggaagaatgtatgcactgttcgggagagaactacgacggaaagatttccaagactatgtctggcctcgaatgccaagcatgggacagccagagcccgcacgcacatggctacattccgtccaagttccctaacaaaaatctgaagaagaattactgccgcaatcctgatcgagaactccggccttggtgcttcaccactgacccgaacaagcggtgggagctgtgtgatatcccgcgatgcaccactccgcctccttcttcagggccgacttaccaatgtttgaagggtacgggagaaaattacaggggaaacgtggcagtgactgtctcgggacacacctgtcagcactggtcggcccagaccccacacacccataaccgcacccccgaaaatttcccatgtaagaacctggacgagaattattgccggaatcccgatggcaagagagccccgtggtgccacaccactaactcacaggtgcgctgggaatattgcaaaatcccatcatgcgattcgtcgcctgtgtccaccgaacagctggcaccgaccgccccgcccgaattgacgccggtggtgcaagactgctaccatggagacggtcagtcgtatagaggcacctcgagcactaccaccacgggaaagaaatgccagagctggtcgtcgatgactccgcaccgccaccagaaaaccccagaaaactacccgaatgccggactgaccatgaactactgcagaaaccctgatgccgataagggtccgtggtgcttcactacggacccctccgtgaggtgggagtactgcaatttgaagaagtgcagcgggacggaagctagcgtggtggcaccgcccccggtggtgctgctgccggacgtggagactccttcggaagaggactgcatgttcgggaacggaaagggataccgtggaaagagagctactaccgtgaccggtaccccttgccaagattgggcggctcaggagccacaccggcattcaatcttcaccccggaaaccaaccctagagcgggactggaaaagaactactgtcgcaaccctgatggagacgtcgggggcccatggtgctacactactaacccgcggaaactctacgattactgcgacgtgcctcagtgcgccgcgccatcctttgactgtggaaagccccaggtggaaccaaaaaagtgccctgggcgcgtcgtcggcggttgcgtggcccatccacattcatggccgtggcaggtgagcctgcggacccgcttcggcatgcatttctgcggaggaacccttatctctccggaatgggtgctgactgccgcgcactgcctcgagaagtcccctaggccgagctcttacaaggtgatcctcggtgcgcatcaagaggtgaacctggagccacatgtgcaagaaatcgaggtgagccgcctttttctcgagccgactagaaaagacattgcccttctgaagctgtcatcgccagctgtcatcactgacaaagtcatcccagcatgcctcccaagcccaaactatgtcgtcgcggaccggaccgagtgctttatcactggatggggtgaaactcagggtacctttggagcgggtctgctcaaggaggctcagctgcctgtcatagaaaacaaggtgtgcaaccgctatgagttcctgaacggaagggtccagtcaactgaactctgcgcgggacacctggcgggcggaaccgactcgtgccagggagattcgggcggaccgctcgtgtgctttgaaaaggacaagtatatcctgcaaggtgtgacttcgtggggccttggatgtgcacgcccaaacaagccaggagtgtacgtgcgcgtctcgcggttcgtgacctggatcgagggagtgatgaggaataat

SEQ ID NO: 250964 - DNA, 2430 bp, Artificial Sequence
  Description of Artificial Sequence: Synthetic coding sequence
atggagcacaaggaagtggtgcttctgcttctgctcttcttgaagtccggacagggagaacccctcgatgactacgtgaacactcaaggcgcatcactcttctccgtgaccaagaagcaacttggagcgggaagcatcgaggaatgcgcagctaaatgtgaagaagatgaagagttcacttgccgggccttccagtaccattctaaggagcagcagtgcgtgatcatggcggagaatcgaaagtcgtcgatcattatccggatgcgggacgtggtgctgttcgagaagaaagtgtacctgtcggaatgtaagaccggaaatggaaagaattaccggggaaccatgtcgaaaaccaagaacggcattacttgtcaaaagtggtcgtcaacttccccgcaccggcctagattctccccagcaacccatccctccgaaggattggaggagaattactgtcgtaatccagacaacgacccgcagggtccctggtgttacactaccgacccggagaagagatacgattactgcgacatcctggaatgcgaggaagaatgcatgcactgcagcggagagaattacgatggaaagatctccaagaccatgtcgggtctggagtgtcaggcatgggactcacaatctccacatgcgcacggctacatcccgtcaaagtttccgaacaagaatctgaagaaaaactactgcaggaaccctgatcgcgaacttagaccttggtgtttcactacggaccctaataagcggtgggaactgtgcgacatcccgcggtgtactaccccgccgccgtcatccggtccgacctaccagtgcctcaagggaaccggagagaactaccggggaaatgtggctgtgaccgtgtccgggcacacttgccagcactggtcagcgcaaaccccccacacccataatagaacccctgaaaacttcccttgcaagaacttggacgaaaactactgccggaacccagatggaaaacgcgccccttggtgccacaccaccaactcccaggtgcgctgggagtattgtaaaatcccatcatgcgattcatcgccggtgtcaaccgaacaactggcgccgactgcccctccggaactcactccggtggtgcaggattgctatcatggagatggccaatcctaccgtggcacgagctcaactactactaccggcaaaaagtgtcagtcatggtcctctatgacgcctcacagacaccaaaagactccggagaattaccctaatgctggcctcactatgaattactgccgcaacccagacgcagataagggtccgtggtgttttactacggatccatccgttaggtgggagtattgcaatctgaagaagtgctccggtactgaagcgtcggtggtggctccacccccagtcgtgctgctcccggatgttgaaaccccctcagaggaggattgcatgtttggaaacggtaagggataccgcggcaaaagggcgaccaccgtcaccggcacgccatgccaggattgggccgcccaagagccacatcggcatagcatctttactccggaaaccaaccctcgcgctggtctggaaaagaactactgtaggaacccagacggggacgtcggtgggccgtggtgctatactacgaacccgcgcaagctctacgactattgcgatgtgcctcagtgcgcagctccttcgttcgactgcggcaagccgcaggtggagccaaagaagtgcccgggaagagtcgtcggggggtgtgtggcacatccccactcatggccgtggcaagtgagcctgcgcaccaggttcggtatgcacttttgcggaggaaccttgatctcgccggaatgggttctcaccgcggcacactgtttggagaaatcacctcggccgtcgtcgtacaaagtgatcctgggggcgcaccaagaagtcaacctggaaccccatgtgcaggaaatcgaggtgagcaggctgtttctggaaccaaccagaaaggacatcgccctgctcaagctgagctcgccagcagtgatcaccgacaaagtcatcccggcctgcctgcctagcccgaactacgtggtggcggaccgcaccgaatgctttatcaccggatggggcgaaactcagggaacctttggagcaggtctgttgaaggaagcccaactcccggtgatcgagaataaggtttgcaacagatacgagtttctcaacggaagagtgcagtcgaccgagttgtgcgcaggacacctggcaggaggcactgattcgtgccaaggcgactctggaggaccactggtctgctttgaaaaggataagtacatcctccaaggagttacctcgtggggacttggctgcgctcggccaaacaagccaggggtgtacgttcgggtgtcgcggttcgtcacttggatcgaaggcgtgatgagaaacaat

SEQ ID NO: 250965 - DNA, 2430 bp, Artificial Sequence
  Description of Artificial Sequence: Synthetic coding sequence
atggaacataaggaggtggtgctgctgctcctcctcttcctgaagtcgggacaaggggagccactggacgactacgtgaatacccaaggggcctcgcttttttctgtgacgaaaaagcagctgggagctgggtctatcgaagagtgtgccgccaagtgtgaggaagatgaagaattcacgtgcagagcgttccagtaccacagcaaggagcagcaatgtgtcatcatggccgaaaaccgaaaatcatcaatcataatccggatgcgggacgtggtgctgttcgagaagaaggtctatctgagcgaatgcaagaccgggaatgggaagaactaccgcggaacgatgagcaagactaaaaacggaatcacttgtcaaaagtggtcctcaacctccccgcaccgcccgcggtttagccctgcgacccacccctcggaaggactcgaagaaaactattgtcggaacccggataacgatcctcagggtccttggtgctacaccaccgatccagaaaaacgctacgattactgtgacatcttggagtgcgaagaagagtgcatgcattgttccggggagaattacgacggcaagatatccaaaaccatgtcaggacttgagtgtcaggcatgggactcgcagtcccctcatgcccacgggtacattccctcgaagttccccaacaagaatctcaagaaaaactactgcagaaatcccgatcgcgagctgcgcccgtggtgctttaccacggatccaaacaagcgctgggaactgtgtgacatccccaggtgcaccaccccgccgccgtcctctggtccaacctaccagtgccttaaagggactggtgagaattaccgcggaaatgtggcggtgaccgtctctggacatacctgtcaacattggtcagcacagacccctcacactcataaccgcactcccgaaaacttcccatgcaagaacttggatgaaaactactgtcgcaacccggacggaaagagggctccatggtgccacaccaccaacagccaagtgaggtgggagtactgcaagatcccctcgtgtgattcgagcccggtgagcactgagcagctggcaccaaccgcgccccctgagctcactccggtggtgcaggattgctaccacggagacggccagtcgtatcgcggaacttccagcactaccaccaccggaaagaaatgccagtcatggtcgagcatgactccacatcggcaccagaaaactccggagaattacccgaacgcaggactgaccatgaactactgccggaaccctgacgccgataagggaccctggtgtttcactactgacccctcggtccggtgggaatactgtaacctgaaaaagtgcagcggaactgaggcctccgtcgtcgccccgcccccagtggtcctgctgccggacgtcgaaaccccatcagaagaggactgtatgttcggaaacggcaagggataccgcggaaaacgcgccacgaccgtgactggaactccttgccaagattgggcagcacaggaaccccacaggcattcgatcttcaccccagagactaacccgagagccggactcgaaaagaactactgtcggaacccagatggggacgtcggaggaccatggtgctatacgactaatcctagaaaactgtacgactactgcgacgtgcctcagtgcgcagcgccgtccttcgattgcggtaagccccaggtggaacctaagaaatgcccgggacgggtggtagggggttgcgtcgcgcatccgcattcctggccgtggcaggtgtcacttcggactcgattcggtatgcacttctgcgggggaaccctcatctcgccggagtgggtcctcactgcagcgcactgcctcgaaaagagccctcgcccatcaagctataaggtgattctgggagctcaccaggaagtcaacctggagccgcacgtgcaagaaatagaagtctcccgtctctttttggaaccaactaggaaggacatcgctttgcttaagctgagcagtccggctgttatcaccgacaaagtgatccccgcctgcctcccctcaccgaactacgttgtggctgacagaactgaatgcttcatcaccggatggggagaaacccagggcacgtttggagccgggctcctgaaagaggctcaactgccggttatcgagaataaagtgtgcaatcggtacgagtttctgaatggtcgcgtgcagagcactgagctttgcgccgggcacttggcaggtggcaccgactcctgccaaggtgactctggaggacctctcgtttgcttcgagaaagacaagtacattctgcaaggggtcacctcatggggcctcggctgcgcccggccgaataagccaggggtgtacgtgcgggtgtcccggttcgtgacctggatcgaaggagtcatgagaaataac

SEQ ID NO: 250966 - DNA, 2430 bp, Artificial Sequence
  Description of Artificial Sequence: Synthetic coding sequence
atggagcataaggaggtcgtgctgttacttctcttgttcctgaagtccggccagggtgagccactggacgactacgtgaacacacagggcgcctcccttttttcagtcacgaagaaacaacttggcgccggaagtattgaggagtgcgcagccaaatgcgaggaggacgaagagttcacgtgccgtgcattccagtaccattcgaaggaacagcagtgcgtgattatggcagagaatcgcaagagctcaataataattcggatgcgcgatgtagtgctgtttgaaaagaaagtttatctcagcgagtgtaaaaccggcaatggcaagaactaccgtggtacgatgtcgaagaccaagaacggcattacttgccaaaaatggagcagcacatccccccatagaccacgcttcagtcctgcgacccacccaagcgagggcctcgaggagaattattgccggaatccggataatgatccacaaggcccgtggtgctatacaacggaccccgagaagcgttacgactactgtgatatactggagtgcgaagaggaatgcatgcattgtagcggagaaaactacgacggtaaaattagcaagacgatgagcggtttggagtgccaagcttgggacagccaatcgccgcacgcccacggctacatccctagtaagtttccaaacaagaatttgaagaagaactactgtcgtaatcccgatagagagctccggccctggtgttttactacggatccaaataagcgatgggagttgtgcgatatccctcgatgcactacacccccaccctcaagtggtccgacctatcagtgcctaaagggaacgggagagaattaccggggcaacgtggcggtgaccgtgagcggacacacctgtcagcactggagcgcgcagactccacatacccataacaggactccggaaaatttcccgtgcaagaatctggacgaaaattattgccgaaacccagacggcaagcgagcaccgtggtgccacaccacgaatagccaggtgaggtgggagtattgtaagataccatcctgcgactcatccccagtctctaccgagcagctagcgccgaccgctccgcccgagctgaccccggtggtccaggattgctaccatggcgacggtcaaagctatagaggcacgagcagcaccaccacgactggcaagaaatgccaatcctggagcagtatgacaccacatcgtcatcaaaagacaccagaaaattatcccaacgcgggcctgacaatgaattactgcaggaaccccgacgccgacaagggcccgtggtgcttcaccaccgatccctccgtgcgatgggagtattgcaatctcaagaaatgttcgggcaccgaggcctctgtcgtcgcgcccccaccggttgtgctgctgcccgatgtcgaaacaccctccgaggaggactgtatgtttggcaacggtaagggataccgtggaaagcgcgccacgaccgtcaccggcacgccatgtcaggattgggccgcgcaggagccccaccgccactctatcttcacgccggagacgaacccccgcgcgggattggaaaagaactactgccgtaatcccgacggcgacgtcggcggtccgtggtgctatacaacgaatcccaggaaactgtacgactattgcgatgtcccccaatgtgcggcgccatcgtttgactgcgggaagccacaagtcgagccgaaaaagtgtccaggccgcgtggtggggggatgcgtcgcacatcctcattcatggccatggcaggtgagcttacgcacgaggtttggcatgcatttttgtggcggcacgctcatttccccagagtgggtgttgaccgcggcccattgtctggaaaagtcgccccgcccgtcttcctacaaggttatcttgggagcacaccaggaagttaacttggagccacatgttcaggagatcgaagtgagccgcctcttcctggagccgactcgcaaagacatagcgctattgaagttgtccagcccggcggtgattactgataaggtcattcctgcatgcttgccctcgcccaattacgtggtggcggatcggactgagtgtttcataaccggctggggagaaactcagggtacgttcggcgcgggactgctgaaggaagcgcaactgcccgtgattgagaacaaggtgtgtaatcgctatgagttcctaaatggccgtgtgcagagcacggaattgtgcgcgggccacttggcaggcggtaccgatagctgtcagggcgattcggggggtcccctcgtatgctttgaaaaggataagtatatcctgcaaggagttacatcgtggggcctgggctgcgcacgcccaaacaagcccggtgtgtacgtgcgggtctcgcgcttcgtgacatggatagaaggtgtcatgaggaacaac

SEQ ID NO: 250967 - DNA, 2430 bp, Artificial Sequence
  Description of Artificial Sequence: Synthetic coding sequence
atggaacacaaagaggtcgtgctgctgctgctcctgtttctcaaaagcggacaaggagaaccactcgacgattacgtgaatactcagggtgcaagcctcttctcggttaccaagaaacagttgggagctggcagcatcgaagaatgtgcggccaaatgcgaggaggacgaggagttcacttgccgcgcattccagtaccactccaaggaacagcaatgcgtcattatggcagaaaacaggaaatcgtctatcatcattagaatgcgggacgtggttctcttcgaaaagaaggtctacttgtcggagtgcaagaccggaaatggcaagaactacagaggcaccatgtcgaaaactaagaacggcattacctgccagaaatggtcgagcacgtcccctcataggccgcggttctcaccggctactcacccgtcggagggactcgaagagaattactgtcggaaccccgataatgacccacagggaccgtggtgctacactactgacccggaaaaacgctacgattactgcgatatcctcgagtgcgaagaggaatgtatgcactgtagcggagagaattacgatggtaagatctcgaaaactatgtcgggtctggaatgtcaagcctgggactcgcagtcgccccacgcccacggatacatcccttcgaagttccctaacaagaatctcaaaaagaactactgccggaacccggaccgggaacttcgcccgtggtgtttcactaccgacccgaacaagcgctgggaactgtgcgacatcccccggtgtaccacgcctccaccatccagcgggccaacctaccagtgtctgaaaggaactggagagaactaccggggaaatgtcgcagtcactgtgagcggacatacgtgccagcattggtcagctcagaccccgcatacccacaaccggactcccgaaaacttcccgtgcaaaaacttggacgaaaactattgccggaatccggatggcaagcgggccccttggtgtcacactaccaatagccaggtgcggtgggagtattgtaaaatcccgagctgtgattcatcaccggtgtcaaccgaacaactcgcccccactgcaccccccgagctgaccccggtcgtgcaagactgctaccatggggacggtcagtcctaccggggaacctcgtcaaccaccactaccgggaagaagtgtcagtcatggtcgtcaatgacccctcatcggcaccagaaaacgccggagaactatccgaacgctgggctgactatgaattactgcagaaatccggacgccgacaagggtccatggtgttttaccaccgacccctccgtgcggtgggaatattgcaaccttaagaagtgttcgggtactgaagcctccgtcgtggccccgccgccggtggtgctgcttccagatgtggaaaccccctccgaagaggactgcatgtttgggaacggaaaggggtacaggggtaagcgggcgaccactgtcaccgggactccctgccaagattgggccgcgcaagaaccccatcggcattcaattttcactccggaaactaacccccgggccggactggagaaaaactattgtcggaatcctgatggagatgtgggaggaccgtggtgttataccaccaatccgaggaagctctacgattattgcgacgttccacagtgcgcggccccttcgtttgactgcggaaagcctcaagtagaacccaagaagtgcccaggacgcgtggtgggagggtgcgtcgcgcatccccacagctggccatggcaggtgtccctgagaactaggtttgggatgcatttctgcggaggaactttgatcagtccagagtgggtgctgaccgccgcccactgtctggaaaagtcccctcggccatcaagctacaaggtgatcttgggggcgcaccaagaagtgaatctggagcctcacgtgcaggagatcgaggtgtcgcggctcttcctggaaccaacccgcaaggatattgccctgttgaagctctcgtccccggccgtgatcaccgacaaggtgatcccggcctgcctgccatctccgaattacgtggtcgccgatcggactgagtgcttcatcactggatggggagagacgcaaggtactttcggtgcgggcctgctgaaggaggcacagctgccagtgattgagaataaggtgtgtaaccgctacgaattccttaacggaagggtacaatctaccgaattgtgtgctggtcacctcgcaggaggcaccgatagctgccagggagattcgggaggaccgctggtgtgctttgagaaggacaagtacatcctgcagggagtgacgtcctgggggctcggatgcgctagaccaaacaaacctggcgtgtacgtgcgcgtctcgcgattcgtgacgtggatcgaaggcgtcatgcgcaacaac

SEQ ID NO: 250968 - DNA, 2430 bp, Artificial Sequence
  Description of Artificial Sequence: Synthetic coding sequence
atggaacacaaggaagtggtgctgctcctgctcctcttcctgaagtcagggcagggggagcctctggacgattacgtcaatacccaaggtgcctcgctcttcagcgtgactaagaagcagctgggagcaggatccatcgaggagtgcgccgcgaaatgcgaagaggatgaagaattcacgtgccgagcgttccaataccactccaaggaacaacaatgcgtgattatggccgagaatcggaagtcgtcgatcataattcggatgcgcgacgtggtgctgtttgagaagaaggtgtatctctcggagtgcaaaaccggaaacggaaagaattaccgcgggaccatgagcaaaaccaagaatggtatcacttgccaaaaatggagcagtacttccccgcatcgcccaaggttctcgccggcaacgcatccgagcgagggacttgaagagaattactgtagaaacccagataacgatccccagggaccctggtgctacactaccgaccctgaaaagagatacgactactgcgatattcttgaatgcgaagaagaatgcatgcactgtagcggcgagaactacgacggtaagatttccaagactatgagcggtctggaatgtcaggcatgggactcgcagtccccgcacgcgcacggatacatcccttcaaagttccctaacaagaatctgaaaaagaactattgccggaatccggatcgggaactgcgtccatggtgttttactaccgaccccaacaaaagatgggagctctgcgacattcccaggtgcactactcctccaccaagctccggccctacctatcaatgcttgaagggcacgggtgagaactatagaggaaacgtggctgtgacggtgtcggggcatacctgccaacactggtcagcacagactccgcatactcacaaccggactccagagaacttcccttgtaaaaaccttgacgagaactactgtcgcaatccggatggaaagagagctccctggtgtcataccaccaactcacaggtccgctgggagtactgtaagatcccgagctgtgactcgtcacccgtgtccacggaacagctggctccaaccgctccgccagaactgactccggtagtccaggattgctaccatggtgatggacagtcctaccgggggacctcgtccaccaccactaccgggaagaagtgccaatcatggtcgtccatgaccccgcatagacaccaaaagaccccggaaaactacccgaacgcgggactcaccatgaactattgtcgaaacccagatgccgataagggcccttggtgcttcacgactgatccatcggtgcggtgggaatattgcaacctgaaaaagtgttctgggactgaagcgtccgtggtggccccgccaccggttgtcctgctgcctgacgtcgagactccgtcagaggaggactgcatgttcggaaatggaaaaggatacagagggaagcgggccactacggtgactggaactccgtgccaagactgggcagcccaagaaccacatcgacactctatcttcaccccggagactaacccgcgcgctggactcgagaaaaactactgccgaaatccggacggagacgtcggaggcccgtggtgctacaccaccaaccctcgcaagctctatgactactgtgacgtgcctcagtgcgcggcaccgagtttcgattgcggaaagccgcaagtcgagccaaagaagtgcccaggcagggtggttgggggctgcgtggcccaccctcattcgtggccatggcaggtgtcgcttagaacccgctttggaatgcacttttgcggcggtaccttgatctcgcccgagtgggtgttgaccgccgcacattgcctcgaaaagtccccaaggccatcgtcctacaaagtgatcctgggcgcccaccaagaagtgaacctggaaccgcatgttcaggagatcgaagtgagccggctctttctggagcctactcggaaagacatcgcactcctgaagttgagctctcccgctgtgatcacggataaggtgatcccggcctgtctgccgagcccaaactacgtggtcgccgaccggactgagtgttttatcaccggatggggagaaacccaagggactttcggagcgggcttgctcaaagaagcccagctgcccgtcattgagaataaagtgtgcaaccgctacgaattcctgaacggaagggtccagtccacggaactgtgcgcaggccatctggccggagggactgactcatgccaaggggactcaggcggcccgctggtctgcttcgaaaaggacaagtacattttgcagggagtcacgtcctggggactgggatgcgcacggccgaataagccgggagtctatgtaagggtatcgagattcgtgacctggatcgaaggagtgatgcggaacaat

SEQ ID NO: 250969 - DNA, 2430 bp, Artificial Sequence
  Description of Artificial Sequence: Synthetic coding sequence
atggaacataaagaagttgttctactacttttacttttccttaaatcaggacaaggagaacctttagatgattatgttaatacacaaggagctagtcttttttctgttacaaaaaaacaacttggtgcaggaagtattgaagaatgtgcagctaaatgtgaagaagatgaagaattcacatgtagagctttccaatatcattcaaaggaacaacaatgtgttattatggcagaaaatcgaaagtcatcaataattattagaatgagagatgtagttttatttgaaaaaaaggtttacttatcagaatgtaaaactggtaatggaaaaaattatagagggacaatgtcaaaaactaaaaatggaattacatgtcaaaaatggtcttcaacatcaccacatagaccaagattttcaccagcaactcatccatcagaaggtcttgaagaaaactattgtcgtaacccagacaatgatccacaaggaccttggtgttatactacagatccagaaaaaagatatgattattgtgatattttagaatgtgaagaagaatgtatgcactgttcaggagagaactatgacggaaaaatttctaaaactatgagtggattagaatgtcaagcatgggattcacaatcacctcatgctcatggatacattccaagtaaatttcctaataagaatttaaaaaaaaattattgtagaaatccagatagggaacttagaccatggtgttttactacagatccaaataaaagatgggaattatgtgatattccaagatgtactacacctcctccatcatctgggccaacttatcaatgtttaaaaggaacaggggagaattaccgaggaaatgtagcagttactgtttcaggacatacatgtcaacattggtcagctcaaacaccacatactcataatcgaactccagaaaattttccatgtaagaatttagatgaaaattattgtcgtaacccagatggaaaaagagctccatggtgtcatacgacaaacagtcaagttagatgggaatattgtaaaattccaagttgtgatagttcaccagtatcaaccgaacaattagctccaacagcaccaccagaattaacaccagtagtacaagattgttatcacggtgacggtcaatcttatcgaggaacatctagtactacaacaactggaaaaaaatgtcaatcttggtcatctatgacacctcatcgtcatcaaaaaactccagaaaattatccaaatgctggattgacaatgaattattgtagaaatccagatgcagataaaggaccatggtgttttacaacagatccatcagttcgttgggaatactgtaatttaaaaaaatgttcaggaactgaagcatctgttgttgcaccacctccagttgttttattaccagacgttgaaacaccaagtgaagaagattgtatgtttggaaatggaaaaggatatagaggaaagagagctactacagttactggtactccatgtcaagattgggctgcacaagaaccacatagacactcaatatttactccagaaactaatccaagagctggacttgaaaaaaattattgtagaaatccagacggagatgtaggtggtccatggtgttatacaacaaatccaagaaaattatacgattattgtgatgttccacaatgtgcagctccatcatttgactgtggtaaaccacaagttgaacctaaaaaatgtccagggagagttgtaggaggatgtgttgctcatccacattcatggccatggcaagttagtctcagaactagattcggaatgcatttctgtggagggacattaataagtccagaatgggttcttactgctgcacattgtttagaaaagagtccaagaccttcttcttataaagtaatattaggtgcacatcaagaagttaatttagaaccacacgttcaagaaatagaggtatctagattatttttagaaccaaccagaaaagatattgctcttttaaaactaagtagtccagcagttattactgataaagtaattccagcttgcttaccatccccaaattatgtagtagcagatagaacagaatgtttcattactggatggggagaaactcaaggaacatttggagcaggattacttaaggaggcacaacttcctgttattgaaaataaggtttgtaatagatatgaattcttaaatggacgtgttcaatcaacagagctttgtgcaggtcatttagcaggaggaacagattcatgtcaaggagatagtggtggaccacttgtatgttttgaaaaagataaatatattttacaaggagtaacatcctggggactaggttgtgcaagaccaaacaaacctggagtatatgtaagagttagtagatttgtcacttggatagaaggagttatgagaaataat

SEQ ID NO: 250970 - DNA, 2430 bp, Artificial Sequence
  Description of Artificial Sequence: Synthetic coding sequence
atggagcacaaggaagtcgtcctgctgctcctgttatttctaaaaagcggccagggcgaacccctggacgactacgtcaacacccagggagcatctctattttcagtcacgaagaagcagttgggcgctggcagcatcgaggaatgcgctgccaaatgcgaggaagacgaggagttcacctgtcgagctttccaataccactccaaagaacagcagtgcgtgatcatggcagagaatagaaagtcctccataattatccgaatgagagatgttgttctgttcgagaaaaaagtctacctgtctgaatgcaagacgggaaacggaaagaactatagaggtacgatgtccaagactaagaatggcataacttgccagaaatggtcctctacctccccccatagaccccggttctcccctgccacccacccatccgaggggttagaggagaactactgtaggaaccccgacaacgaccctcagggaccatggtgctacaccacggatccagagaaacgatacgactactgtgacattctggaatgtgaagaagagtgcatgcattgcagcggagagaactacgacggcaaaattagcaaaaccatgagtgggctggaatgtcaggcttgggatagccagagcccccatgctcacggctacataccaagtaagtttcccaacaaaaatctcaaaaagaactactgcagaaatcccgacagagagctacgaccttggtgcttcacaactgatcctaacaaacgctgggaactttgcgatatacctcggtgtaccacaccacctccttccagcggccccacgtatcagtgccttaaaggcacaggagagaactaccgggggaacgttgccgtcactgtgtcaggtcatacctgtcagcactggagcgcgcaaactccacatacacacaaccgcacaccagaaaactttccttgcaagaatctggatgaaaattattgtcggaaccccgatggcaagcgcgctccttggtgtcacactaccaacagccaggtcagatgggagtactgtaaaattccgagctgcgatagcagccctgtttctactgagcagttggcccccactgcccccccagagcttactcccgttgtccaggactgctatcacggcgatggccaatcctaccgaggaaccagctcgactacaactaccggtaaaaagtgtcagagctggagttctatgacaccccaccgtcatcagaaaacccctgaaaactatcccaacgcaggattgaccatgaactactgtcgtaacccagacgcggacaaaggtccttggtgctttacaaccgacccctccgtccgttgggagtactgcaaccttaagaagtgttccggtactgaggcatcagttgtcgccccacctcccgtggttctgctcccagatgtcgaaacaccaagtgaggaagattgcatgtttggaaacggcaagggatacagggggaagcgagccacaaccgtgactggcacaccttgccaagactgggcagcacaggagcctcacaggcacagtatctttacacctgagacaaatccccgagcaggtctagagaaaaattattgcagaaatccggatggcgacgtgggaggaccttggtgttacaccacgaatccccggaagctgtatgattattgcgatgtgccacagtgtgccgccccttcttttgactgtgggaagccgcaggtagagcccaaaaagtgtcctggcagggttgtcgggggttgcgtggcacaccctcacagttggccatggcaagtgtcccttcgcacgcgctttggaatgcacttttgtggcggtacgctgatctcgcccgagtgggttctgaccgcggcccactgtttggagaagtcacctaggccatcatcgtacaaggttatccttggggcgcaccaggaagttaatcttgagccccacgtgcaggagattgaggtaagtagactctttcttgagcccacacggaaggacattgcgcttttgaagctgagctcacccgccgttatcacagataaagtgatcccggcctgtctaccgtctccaaactatgttgtggccgatagaacggaatgcttcatcacaggatggggggagacccagggaacgtttggcgctgggctgctgaaagaagcccaacttcccgtcatcgagaacaaagtctgtaaccgctacgagtttctcaacggacgcgtgcagagcacagagctgtgcgctgggcatcttgccggaggcacagattcttgtcaaggcgattcaggaggtccgcttgtctgcttcgagaaggataaatacattttacagggcgtaacctcatggggtcttgggtgtgcaaggccaaacaaaccaggagtttatgtaagggtgagcaggtttgtgacatggatcgaaggggtgatgcgcaacaac

SEQ ID NO: 250971 - DNA, 2430 bp, Artificial Sequence
  Description of Artificial Sequence: Synthetic coding sequence
atggaacacaaagaagtagtcctcctgcttctgctgttcttgaaatctggacagggcgaacccctggacgactacgttaatacccagggcgcatctttgttctccgtgactaaaaagcaactgggcgctggctctatcgaagagtgcgctgccaagtgtgaggaagatgaggagttcacatgtagagcttttcagtatcattctaaagagcagcagtgcgtgattatggccgaaaatagaaagagctctatcatcatccgtatgcgcgacgtggtgttgttcgagaagaaagtgtatctcagcgaatgcaaaacaggcaatggtaagaattacaggggcacaatgtctaagacaaagaatggtataacatgccagaaatggtcctccacttcacctcatcgccctcgcttctcacctgcaacacatccaagcgagggcctggaggagaactactgcagaaatcctgacaatgaccctcagggaccctggtgttacaccactgacccagaaaaacgctacgactactgtgatattttggaatgcgaggaggaatgcatgcactgctctggtgagaattatgacggaaaaatcagtaagacaatgagcggactcgaatgtcaagcttgggactctcaaagccctcatgcacacggctacatccccagtaagttccccaacaagaatctgaagaagaactactgcaggaatcccgacagagaattgaggccctggtgtttcactacagaccctaataaacgttgggaactctgtgatatcccccgttgtactacacctccacctagttctggccccacataccaatgcctcaagggcacaggtgaaaactatcgcggaaacgtcgccgtgaccgtgtccggccacacatgccagcactggtccgctcagacccctcatacccataaccgcacccctgagaacttcccttgtaaaaacctggatgaaaactattgcagaaaccccgacggcaagagggccccatggtgccatactacaaactcccaagtccgttgggagtattgtaagatcccctcatgcgatagctctcctgtgagtactgaacagctcgcacctaccgctccacccgagctgacacccgttgtgcaggattgctaccatggagacggtcagtcttaccgtggcacctctagtactacaacaaccggtaagaaatgtcaatcctggtcatccatgactccccatcgtcaccagaagactcccgagaactatccaaacgctggtttgaccatgaactattgtcgcaaccccgacgctgataagggaccttggtgtttcacaacagatcccagcgtacgttgggagtactgcaatttgaagaagtgctcaggtacagaggctagtgtcgtcgctcctccacctgtcgtccttttgcccgacgtggagacccccagtgaagaggattgtatgtttggaaacggcaagggttataggggtaagagggccacaacagtgacaggcaccccctgccaagactgggcagcacaggagccccacaggcattcaatcttcactccagagaccaacccacgtgctggtcttgaaaagaattactgtaggaacccagatggcgacgtgggtggcccatggtgctacacaactaatcccaggaaattgtacgactactgcgacgtgcctcagtgcgctgcaccttccttcgactgcggaaagcctcaggttgagcctaagaagtgccccggaagggtggtcggtggttgcgtcgcccatccacactcatggccttggcaagtttccctgaggacacgttttggcatgcacttctgcggcggcacactgatttcccccgagtgggtcctgaccgccgcccactgcctggagaaaagccctcgccccagttcctataaggtaattctgggtgcccaccaggaagtgaatctcgagccacacgtacaagagatagaggtttctcgtttgttcctggagccaactcgcaaggatatcgctctgctgaagcttagcagtcccgccgtgatcaccgacaaagttatcccagcctgtttgccctccccaaattatgttgtagcagataggacagaatgttttatcaccggctggggagagacacaaggaacattcggtgccggacttttgaaggaggctcaactgcctgtgatcgaaaataaggtgtgtaaccgttacgagttcctgaatggacgcgtgcagtcaacagaactttgcgctggacacctggccggcggtaccgattcatgccagggcgactcaggtggtccccttgtttgcttcgagaaagacaaatacatcttgcaaggtgtcacctcctggggactgggatgcgccagacccaacaagcccggcgtttatgtacgcgttagcaggtttgtaacttggatcgagggagtcatgcgtaataac

SEQ ID NO: 250972 - DNA, 2430 bp, Artificial Sequence
  Description of Artificial Sequence: Synthetic coding sequence
atggagcataaggaggtcgtgctcctccttctgctttttctaaagagcggccagggcgaacccctggatgattatgttaatacgcagggagctagtcttttcagcgtgaccaagaagcaattgggcgctgggtccatcgaagagtgtgcagctaaatgtgaagaagacgaagaatttacatgtagggccttccagtatcactccaaggagcaacagtgtgtgatcatggccgaaaatcgcaagtcctcaattattatccggatgcgtgatgttgttttatttgagaagaaagtgtacttgagtgaatgtaagaccggcaacgggaagaactacaggggtactatgtcaaaaacgaagaacggcatcacgtgtcagaaatggtcctccaccagcccacatcgaccaagattctctcctgcgactcatccgtccgagggactggaggaaaattactgtcgcaaccccgacaatgacccacaaggaccatggtgttatacaaccgatccagagaaacgttacgattactgtgatattctggagtgcgaagaagaatgcatgcattgttcaggggaaaactacgacggaaaaatttctaagacaatgtcgggtttagagtgtcaagcctgggatagccagtctccacacgcccatgggtatatcccctccaaatttcccaacaagaacctgaaaaagaattactgtcgcaatcctgaccgggagctccggccatggtgcttcacgacagaccccaataagcgctgggaactttgcgacattcctagatgcactactccgcctccttcttccggaccgacataccagtgcctgaagggaactggagagaattacaggggcaatgtggcggttactgtgtccggtcacacgtgccagcattggagcgctcagacaccccacacacacaaccgcactccagaaaattttccctgtaaaaacctggacgagaactactgtcgcaatcctgatggaaagagggcaccatggtgccataccactaattcccaagttaggtgggagtattgcaagattccgagctgcgacagttcaccggtgtctaccgagcagctggccccaactgcccctcctgaacttacgcccgtggtgcaggattgctaccatggtgatggccagtcctataggggaactagctccactaccacgacagggaaaaagtgccagagctggtcgtctatgacgccgcaccgacaccagaagactcccgagaactacccgaacgccggcctgactatgaactattgccggaatcccgacgcggacaaggggccgtggtgctttaccactgacccttctgtgaggtgggagtactgcaatctcaaaaaatgttcagggactgaagcttcagtggtagcccctccaccagtcgttttactcccagatgttgagaccccttctgaagaggactgtatgtttggaaacggaaagggctatcggggtaagagagcaacgacggtgacgggtaccccatgtcaagactgggcagcccaagagccacacagacactcaattttcactcctgaaacgaatccccgggccggcttggagaagaattattgccggaacccagacggcgatgtcggcgggccctggtgctatacaaccaaccctcggaaactatacgactactgcgacgtcccccagtgtgccgccccatcattcgactgtggcaaaccacaggtggaaccaaagaagtgtcccgggcgcgtcgttggggggtgcgtggctcatccacactcttggccatggcaggtttcactgcgtactcgatttgggatgcatttttgcggcgggactctaatttctcctgaatgggtgctgaccgcggcccactgtctggagaaatctccaagaccttcaagctataaagtaatactgggcgcgcaccaggaggtgaatctggagccccacgttcaggaaatagaggtgtcccgactgttccttgagccaacccgtaaggatatcgctctgttaaaattgagctctcccgccgtgataacggacaaagtcattcctgcttgtcttccttctcccaattacgtggtggcggacaggaccgaatgcttcatcaccggatggggcgagacccaaggcaccttcggggctggcctgcttaaagaagcccagctccccgtcatcgagaataaagtgtgcaacaggtacgagtttttaaatggccgcgtccagtccactgagctgtgtgctggccacctggccggagggaccgactcatgccagggagattcaggcggaccactggtttgctttgaaaaggataagtacatcctgcagggtgtcacatcgtggggcctggggtgtgcaaggcccaataaacctggagtctatgtgcgcgtgagtaggtttgttacatggatagagggcgtcatgcgaaacaac

SEQ ID NO: 250973 - DNA, 2430 bp, Artificial Sequence
  Description of Artificial Sequence: Synthetic coding sequence
atggagcataaggaggtcgtactgctgctcctcctctttctgaagtccgggcagggcgagcccctggatgattatgtgaatacacaaggcgcctccctgttcagcgttaccaagaagcaactgggtgccggatccatagaggagtgcgcggctaagtgtgaggaagacgaggagttcacttgtcgcgcgttccaataccactcaaaggaacagcagtgcgtgatcatggctgaaaaccggaaaagctctatcattattagaatgcgagacgtcgtgctgttcgaaaagaaggtgtaccttagtgagtgtaagaccgggaatggcaagaactacagaggcacgatgtccaagactaaaaacggaataacgtgtcagaaatggtcatccacgagcccacatcgccctcggttctctccagcaacgcacccctccgagggcctggaggagaactactgcaggaatcccgacaacgacccccagggcccctggtgctacacaaccgaccctgaaaagaggtatgattactgtgatatcctggaatgtgaggaggagtgcatgcactgcagtggggagaattacgatggaaagataagtaagacaatgtctgggctcgagtgccaagcatgggacagccagagcccccatgcacatggctatattccgtccaagttcccgaacaagaatctgaagaagaattattgccgcaacccagaccgagaacttcgaccctggtgtttcacgacagaccccaataagaggtgggaattgtgcgatatccctcgatgcaccacacctcctcccagctctggtcctacctatcagtgcctgaagggcaccggcgagaattatcgaggtaatgtcgcggtcaccgtgtccggccacacctgtcaacactggtccgcccagaccccacacactcacaaccgaactcccgaaaatttcccctgtaaaaaccttgacgagaactactgccggaatccagatggcaagcgagcaccttggtgccacacgaccaattcacaggttcggtgggagtactgtaaaatcccatcctgcgattcatctccagtttcaaccgaacagcttgcccccactgccccccctgagctgaccccagtagtgcaggattgttaccacggagacggacagagctacaggggtaccagtagcacaacaacaaccgggaagaagtgccagtcctggagctccatgactcctcaccggcaccagaagacaccggagaactaccccaacgccggtcttactatgaactattgccgcaatcctgacgcagacaagggaccttggtgctttacgaccgatccttctgtgcgctgggaatactgcaacctgaaaaaatgtagcgggacagaggcatctgtggttgcacccccccccgtcgtcctcctccccgatgtcgagaccccttcagaagaggactgtatgtttgggaatgggaagggatatcggggcaagagagcaacaaccgttacagggacaccgtgccaggactgggcagcacaagagccccaccgccatagcatcttcactcccgagactaacccgcgggccggcctggagaagaactactgtcgaaatcccgacggcgacgtcggggggccctggtgttatactaccaatccacgcaagctctatgattattgcgacgtgccacaatgtgccgctccgtcatttgattgtggaaaaccacaggttgagccaaaaaagtgtccaggtcgcgtcgttggaggatgtgtcgcccatccacactcctggccgtggcaggtgtcattgcgcacccggttcggcatgcatttttgcggaggaaccttgataagccccgaatgggtattgacagccgcccactgtctggagaagtcaccgcggccatctagctataaagtgattctgggagcccatcaggaggttaacctcgagcctcacgtacaagagattgaggtctctcgccttttccttgagccaacacgcaaagacatcgctctcctgaagctcagttcccccgccgtgatcactgataaggtgatcccggcttgtctcccaagtccgaactatgttgtcgccgacaggactgaatgttttatcacaggttggggagagactcagggcacgttcggagctggtctgttgaaagaggctcaactgcctgtgatagagaataaggtgtgcaacaggtatgaattcctgaacggccgagttcagtcaactgagttgtgtgctggacatttggctggcggcaccgattcttgccagggcgactccggaggaccacttgtgtgtttcgaaaaagacaagtacatcctgcagggagttacctcctggggcctgggatgcgccagacccaataagccaggcgtgtacgttcgagttagcagatttgtgacctggattgagggcgtcatgcgaaacaac

SEQ ID NO: 250974 - DNA, 2430 bp, Artificial Sequence
  Description of Artificial Sequence: Synthetic coding sequence
atggagcacaaagaagtggtgctgctgctcttgcttttcctgaagagcggacaaggcgagcctctggatgattatgtgaacacccagggagcctccctcttttccgtaacaaaaaaacagctgggcgcagggtctatagaagagtgcgccgccaaatgcgaagaggatgaggaatttacttgtcgcgctttccagtaccactccaaggagcagcaatgcgttattatggccgagaatcgcaagtcctctattattatcaggatgcgggacgtggtgctctttgaaaaaaaggtgtatctctctgagtgcaagaccggaaatgggaagaattatcgaggaaccatgagtaaaacaaagaacggtatcacctgtcagaagtggagcagcacctctccgcaccgcccccggtttagccccgctacccatccaagcgagggcctggaggagaactactgtcgtaacccagataacgacccccaaggtccttggtgttatacaacggaccctgaaaagcgctatgattactgtgacattctcgagtgtgaagaggagtgtatgcactgtagcggcgagaactacgacggcaaaatctcgaaaacaatgagcggtctcgagtgccaggcgtgggacagtcagtcaccccacgctcacggctacatccctagtaagttccccaacaagaacctgaagaaaaactattgccggaaccctgatagagaattgcgcccttggtgctttactactgaccctaataagagatgggaattgtgtgacatccctagatgcactaccccaccaccatcgagcgggccaacatatcaatgccttaaaggtacaggcgagaactaccgtggaaatgtggcagtcaccgtgagtggccacacttgccagcattggtctgcccagacaccccatacccacaacagaacaccagaaaacttcccctgtaaaaacctggacgaaaattattgtaggaatccagatggaaaacgggcaccctggtgccatacaactaatagtcaggttcgctgggagtactgtaaaattcctagctgcgactcatctcccgttagcaccgagcaactcgcccctacggctccccccgaactgactcctgtggtccaagactgctaccacggggatggacagtcttatcgtggcacttcctccacaaccaccacagggaagaagtgccagagttggagcagcatgactcctcaccgacaccagaagacacctgagaattatccgaacgccggccttacaatgaactattgtcgtaatcccgatgctgacaaggggccttggtgtttcaccacagatccctccgtcaggtgggagtactgcaacctcaagaagtgttcaggcactgaagcatctgtggtagcgcccccgcccgtagtgctgctcccagacgtcgagaccccctccgaagaggattgcatgttcggcaacggcaagggctacaggggcaaaagagctactacggttactgggacaccatgccaggattgggcagcgcaagaaccacacagacacagcatcttcacacccgagaccaatccccgcgctggactcgagaaaaattattgccgaaacccagatggcgacgtcggcggtccttggtgttacacaacaaaccctcgcaagctatacgattattgtgacgtccctcagtgtgcggcccctagttttgactgcggaaagcctcaggttgaacctaagaagtgcccggggagagtcgtgggaggctgtgttgcacacccccatagttggccttggcaagtaagcttaaggacaaggttcggaatgcatttctgtggcggcacgctaataagccctgaatgggtcttaaccgccgcacactgtctggagaagtcgcctaggccttctagttacaaagtcatcctcggcgcccaccaggaggtaaacctggagccccatgtccaggagattgaagtgtccaggctgtttttggagccaacacggaaggacatcgccctgctaaaactgtcctccccagcagtaatcacagataaggtcatccccgcatgtttgcctagccccaattacgtcgtggctgaccggaccgagtgcttcatcacaggatggggtgagactcaggggaccttcggagctgggctgctaaaagaggcacagttgccagtcattgagaataaggtttgcaatcgctacgaattcctgaacggacgcgttcagtccacagagctgtgcgcagggcacttagcgggaggaaccgattcctgtcagggagattctggagggccattggtatgctttgagaaggacaaatacatcctgcaaggggtgaccagctgggggttaggctgcgcacggccaaacaaacccggagtgtacgtccgcgtatcacgcttcgtgacgtggatcgaaggggttatgcgaaacaac

SEQ ID NO: 250975 - DNA, 2430 bp, Artificial Sequence
  Description of Artificial Sequence: Synthetic coding sequence
atggagcacaaggaagtcgttttactgctgttgctctttttgaagtcgggacagggtgagccattggacgactatgtgaatacacagggagcctctctctttagcgtaacaaaaaagcagctgggtgcagggtccattgaggaatgtgccgctaagtgtgaagaggacgaggagtttacctgcagggccttccagtatcactcaaaggaacagcaatgtgtcattatggcggagaataggaagtctagcatcattatccgcatgcgcgacgttgtcctgttcgagaaaaaagtatatttatcagaatgtaaaacagggaacggcaaaaattaccgtggcacgatgtctaagaccaagaatgggattacatgtcagaagtggagttccacatccccgcatcgtccccgattttccccagctacgcaccccagtgaggggcttgaagaaaactactgcaggaaccctgataatgacccgcagggcccatggtgttatactacagatccagagaagcgttatgactactgcgatattctcgagtgtgaggaggagtgcatgcattgcagcggcgaaaactacgatggaaagatctctaagacaatgtcaggcttagagtgccaggcgtgggacagtcagagtcctcatgcccacggttacattccctcaaagtttcccaataaaaatcttaaaaagaactattgtcgcaaccctgatcgggagttgcgaccatggtgtttcaccaccgatccaaataaacgctgggaactttgtgacatcccgcggtgcacgacccctcctccaagctccgggcctacatatcagtgtctcaaaggcaccggagaaaattacaggggcaacgtagctgttaccgtctcaggccatacatgccagcactggagtgctcaaactccacacactcataatcgcacccctgagaactttccatgcaaaaatcttgatgagaactattgccgtaaccccgacggtaagcgggcaccctggtgccacactaccaattcccaggttaggtgggagtattgtaaaatcccctcctgtgacagctctcctgtgtctactgagcaattggctccaaccgccccgccagaactgacccctgttgtgcaagactgctatcacggcgatggacaatcctatagggggacgagctccaccacaaccaccggcaaaaaatgtcagtcttggagctctatgacaccccacagacaccagaaaactcctgagaattacccgaacgccggcctcactatgaattattgtcgtaatcccgatgcggacaagggcccatggtgcttcaccacagacccttctgtcagatgggagtattgcaatctgaagaaatgcagtggcactgaagcatccgtagttgccccaccaccggtggtgctattgcccgacgtggagaccccctcagaggaggattgtatgttcgggaacggaaagggttatcggggaaagcgggctacgactgtgacagggactccctgccaggactgggctgcacaagaacctcacaggcacagtatatttacaccagagaccaatcccagggcgggccttgagaagaattactgccgcaaccccgatggggacgttggcgggccgtggtgctacaccaccaatccacgcaagctctatgattactgcgacgtcccgcagtgtgcagcaccgtcctttgactgcggaaagcctcaagtggagcctaaaaagtgtccgggacgggttgtcggcgggtgcgtggcgcatccacacagttggccatggcaggtgtctctgaggacgcggtttggtatgcatttctgcggagggacgctgatctctccagagtgggttcttaccgcagctcactgcctggaaaagtcgcctcgcccttcttcatataaggtgatcctgggagctcaccaggaggttaatttggagccacacgtacaggaaatcgaggtgtcgcggctgttcctggaacccacacgcaaggacattgcgctcctaaagctaagctctccggctgtaattacagacaaagtcattcctgcctgcctgccaagtccaaattacgttgtagcggacagaactgagtgcttcattactggctggggcgagacacagggaacttttggtgcggggctgctgaaagaagcgcagctcccagttatcgagaataaggtatgcaatcgctatgagtttttgaatggccgcgtgcagagtaccgagctgtgcgcagggcatctagctggaggcactgattcctgccagggtgattccggcgggcccctcgtgtgtttcgaaaaggataagtacatcctgcagggagttactagctggggcttaggatgcgctcgtcccaataagcctggcgtttacgttcgcgtaagcagatttgtcacctggatagaaggcgttatgcgtaataac

SEQ ID NO: 250976 - DNA, 2430 bp, Artificial Sequence
  Description of Artificial Sequence: Synthetic coding sequence
atggaacataaggaagtcgtcctgctcctcctgcttttccttaaatcaggacaaggtgagccacttgacgactacgtcaatacccagggagcctcactgttttcggttaccaagaagcagctgggcgcgggctcgattgaagaatgcgccgccaaatgcgaggaggacgaggagtttacttgtcgcgcgttccagtaccactcgaaagaacaacagtgcgttatcatggccgaaaaccggaagtcaagtatcatcatcagaatgcgcgacgtggtgctgttcgaaaagaaggtgtacctctcagaatgcaagaccggaaatggaaagaactatcgcggcaccatgagcaagaccaagaacggtatcacgtgccaaaagtggagcagtacctcaccgcaccgccctcgcttctctccagcgactcatccatcagaaggcttggaggaaaactactgtcgaaatccggataatgacccgcaaggaccgtggtgctataccactgatcctgagaagcgttacgattactgcgatatactcgaatgcgaagaggagtgtatgcactgctccggtgagaactacgatgggaagatttccaaaactatgtcaggactggaatgccaagcctgggacagccaatcgcctcacgcacatggctacattccgtccaagttcccgaacaagaatctcaagaagaattactgcagaaacccagacagggagcttagaccctggtgctttacgactgatcctaacaagcggtgggaactgtgcgacatcccgagatgcacgacccctccgccttccagcggaccgacttaccagtgcctgaaagggaccggcgagaactaccgaggaaacgtggccgtgactgtgtccggacatacttgtcagcactggagcgcccagaccccacacactcacaatcgcaccccagagaacttcccgtgcaaaaatctcgacgagaactactgcaggaacccggatggcaagagggcgccatggtgccatactacgaattcgcaggtccggtgggaatactgtaagatcccatcatgcgattcaagcccggtatccaccgagcagctcgcacccaccgctccgcccgagctgaccccggtcgtacaggattgctaccatggagacggacagtcctatcgcggtacctccagcaccaccactaccggcaagaaatgccagtcgtggagcagcatgactcctcaccgccaccagaaaacccccgagaactaccccaacgcggggttgactatgaactattgtcggaatccagacgcagataaaggaccttggtgcttcaccaccgacccttccgtgcgctgggaatactgcaacctcaaaaagtgttccggcactgaagcctcggttgtcgcgccacctcccgtggtgctcctccctgacgtggaaaccccgagtgaagaggactgtatgttcggcaacggaaaaggctaccggggaaagagagccactaccgtgaccggaactccttgccaagattgggcggcgcaagaaccacatcgccactcgatcttcaccccagaaactaatccgcgcgcgggactcgaaaagaactactgccgcaacccggacggggacgtcgggggtccctggtgctacactacgaatccgcgcaaactgtacgactactgtgacgtgccgcagtgtgctgccccttcgttcgactgcggaaaaccacaagtggaacctaagaagtgcccaggacgggtagtgggaggttgcgtggctcatccacattcgtggccgtggcaggtgtcactgcggactcgatttggaatgcacttttgcggagggactcttatcagccctgagtgggtgctcaccgcagctcactgtcttgaaaaatcaccaagacccagctcctacaaggtcatcctgggcgcacaccaagaagtgaacttggagccacatgtgcaggaaatcgaggtgtcgagactgttcctggaaccgacccggaaggacatcgctctgctcaagctgtcgtcccctgccgtaatcacggataaagtgatcccagcctgtctcccctcccctaactacgtggtcgctgatcggactgaatgtttcatcacgggttggggcgaaacccagggaacttttggtgccggcctgttgaaggaggctcagctgcctgtgatcgagaataaagtgtgcaacaggtacgagttcctgaatgggcgcgtgcagtcaaccgaattgtgcgccggacacctcgcaggtggaacggattcctgtcaaggagattcaggaggacccctggtctgcttcgagaaggacaaatacatccttcaaggtgtgacgagctgggggctgggatgcgcccggcctaataagccgggcgtgtacgtgagagtttcgcgcttcgtgacttggattgaaggagtgatgcgcaacaac

SEQ ID NO: 250977 - DNA, 2430 bp, Artificial Sequence; identical to SEQ ID NO: 250933
  Description of Artificial Sequence: Synthetic coding sequence

SEQ ID NO: 250978 - DNA, 2430 bp, Artificial Sequence
  Description of Artificial Sequence: Synthetic coding sequence
atggagcataaggaggtggtactccttctactgctctttctgaagtccggtcagggagagcctctggacgattatgtgaacacacagggggccagtcttttcagtgtgactaaaaaacagctgggggccggtagcatagaagaatgcgcagccaagtgcgaagaggacgaagagttcacgtgccgcgcgttccagtaccatagtaaagagcagcaatgtgttatcatggcagagaacagaaagtcttcaatcatcattcgcatgagagacgttgtactcttcgaaaaaaaggtatacctatccgaatgtaagactggtaacgggaagaattacagggggaccatgagcaaaacaaagaatggaatcacctgccagaagtggagctcaacctctccccatagaccccgattcagccccgctacccaccccagcgaggggctagaagaaaactactgtaggaatcccgacaacgacccacagggtccctggtgttataccaccgatccagaaaagcgatatgattattgtgatatcctggaatgtgaggaggagtgtatgcactgtagcggagagaactacgacggcaagattagtaaaacaatgagtggactggaatgtcaggcatgggactctcagtcgcctcatgcccacgggtatataccatccaaatttcccaacaaaaacttaaagaaaaattactgtagaaatcctgacagagaattaagaccctggtgctttacaactgatcccaataagcgatgggagctttgtgatatcccacgatgcacaactccaccgcccagctccggtcctacctatcagtgccttaagggaactggggaaaattacagaggcaatgtggcggtgacagtcagtggccacacttgccaacattggtctgcccagaccccccacacacataacaggactccggagaatttcccctgtaagaacctcgacgagaactactgtagaaaccccgacggtaagagagccccctggtgccacactacaaactcccaggttagatgggaatactgcaagatccctagctgtgatagctccccggtgtctactgagcaattagccccaaccgcaccacccgagctgacaccagtggtacaggattgctatcatggagacgggcaatcttataggggtacctcatcgacgacaacaactggcaaaaagtgtcagtcttggtcttccatgactccacatcggcatcagaaaactccggagaactaccctaatgccggcctcactatgaattactgcaggaatcctgacgctgataaaggaccttggtgcttcacgaccgacccctcagtcaggtgggaatattgcaatctgaaaaaatgtagtggaaccgaagccagtgtcgtggccccccctcctgtagtgctccttcccgatgtggaaacaccttccgaagaagattgtatgttcggaaacggcaaagggtatagaggcaagagggctaccaccgtaacgggcacgccttgccaagattgggcggcacaagagccccacagacacagtatctttacaccagaaacaaatccacgagctggacttgaaaagaattattgtagaaacccagatggcgacgtgggtggtccttggtgttacaccacaaacccaaggaaactgtacgattactgcgacgtgccccagtgtgctgccccaagttttgactgtggcaagccacaggtagaacctaagaagtgcccagggagagtcgtcggggggtgtgtggcccacccccactcatggccatggcaggtgagcctgcgtactaggtttgggatgcatttttgcggcggtacactcatatcacccgagtgggtgctaaccgccgcacactgccttgagaagtccccaagaccttcaagctacaaggtgatcctgggggcccaccaggaggtgaaccttgaaccccacgtgcaggagattgaagtatcccggttgttcctcgagccgacccgaaaggacatcgctttactcaaactgagtagccctgccgtgattacagataaggtgatcccagcatgtctcccgtccccaaattatgtggtggcagacagaacagaatgcttcatcacaggttggggagagactcagggaacattcggggctgggctgcttaaagaagcccagttgccagttattgaaaataaggtctgcaacaggtacgagtttttgaatggccgggtacagtccactgagttatgcgcagggcacctagcaggggggacagactcatgtcagggtgactctggaggtcccctggtctgcttcgaaaaagataaatacattcttcagggcgtgacgagttggggcctgggttgtgcaagacctaacaagcccggggtgtacgtaagagtttctagatttgtgacctggatcgagggagtgatgagaaataat

SEQ ID NO: 250979 - DNA, 2430 bp, Artificial Sequence
  Description of Artificial Sequence: Synthetic coding sequence
atggaacacaaggaggttgtactactgctgctcctgttccttaaaagcggtcagggagaacctttagacgactatgtcaatacccagggggcctcactgttttcagttaccaagaagcagctcggcgccggttcaatcgaggagtgcgcggctaagtgcgaagaggacgaagagtttacttgccgagcttttcagtaccattctaaggaacagcagtgtgttatcatggccgagaacaggaagtccagcataatcatcaggatgagagatgtcgttctctttgagaaaaaggtctacctttcagagtgcaagacggggaatgggaagaactaccggggcactatgtctaagacgaaaaatgggatcacgtgtcaaaaatggtctagcacctcaccacaccgacctcgtttcagccccgcgacccatccatcggaggggttagaggagaattactgtcgcaatcccgataatgacccacagggcccgtggtgttatacgactgaccccgagaagcggtacgattactgcgacattttagagtgcgaggaggaatgtatgcactgtagtggtgagaactatgacgggaaaatctctaagaccatgtccggcttagagtgccaagcctgggactcccagtcaccgcacgcacacggttatattcccagtaaattccctaataagaacctgaagaagaattactgtcgcaatcccgatagggagcttcggccgtggtgcttcacaaccgacccgaataaacggtgggaactgtgcgacatccctagatgtactactcctcccccttcaagcgggccaacttatcaatgcctcaaaggtaccggtgagaactatagagggaatgtggctgtaaccgtgtctgggcacacatgccagcattggagcgcccagactccacacacgcataataggactccggagaatttcccctgtaaaaatctcgatgagaattattgcagaaatcctgacggaaagcgggccccctggtgtcacaccaccaattctcaggtgaggtgggagtattgtaagattccatcttgtgattcttcgcccgtttcaaccgaacagctcgcccccactgcccctcccgagctaactccggtggtccaagattgttaccatggtgatggacagagctaccgaggcacctcatccaccaccacaactggaaaaaaatgtcagtcctggagcagcatgaccccacacaggcatcaaaagaccccagagaactacccgaatgcgggtctaaccatgaattattgcaggaatccggatgctgataaaggcccatggtgctttaccaccgaccctagcgttcggtgggagtactgtaacttgaagaagtgttcaggaacagaagcttccgtcgtggcccccccccccgtcgtgcttttgcctgatgtagaaacacccagcgaagaggattgcatgtttggtaacggaaaaggttacaggggcaagcgcgcgactactgttacagggaccccttgccaggactgggccgcccaggagccacatcgccatagcatctttactcctgagactaatccaagagcggggctggagaagaattactgtcggaatcctgatggcgatgtcggtggtccatggtgctatacaacaaaccctcgcaagctgtacgactactgcgacgttccacagtgtgcggctccctcgttcgattgcggaaagccacaggtggagccaaaaaaatgccctggccgggtcgtgggtggctgtgtggctcatccccactcatggccttggcaggtttctctgaggactagatttgggatgcatttctgtggcgggacgcttatctcaccggagtgggtgctgacggcagctcactgcttggaaaagagcccacgcccatcctcttataaggtcatcctcggcgcccaccaggaagttaacctggagccgcacgtgcaggagatcgaagtgtctagactcttcctggaacccacgcgtaaagacatagctttgttgaagctgtcgagccctgcagtgattacggacaaagtgatacctgcttgcctgccatctcctaactacgtggttgcagatcgcaccgaatgttttatcacaggatggggagagactcagggcacttttggggccgggttgctcaaggaagcccagctaccagtgatagagaacaaggtgtgtaaccggtatgaattccttaatggaagggtccaaagtactgaactgtgcgcaggccatctggccggaggaactgactcttgtcagggtgatagtggagggcccctggtgtgctttgaaaaggataagtacatcctgcagggtgtgactagttgggggctgggatgtgctcgccctaataagcctggcgtgtatgtgcgagtatcaagattcgttacatggattgagggcgttatgcgtaacaat

SEQ ID NO: 250980 - DNA, 2430 bp, Artificial Sequence
  Description of Artificial Sequence: Synthetic coding sequence
atggagcacaaagaggttgtcctattgttactgctgttcttgaagagcgggcagggcgaacccctcgatgattacgttaacactcagggcgcaagccttttttctgtgacaaagaaacagcttggtgccggaagcattgaagaatgcgccgcgaagtgcgaggaggacgaggaatttacttgccgtgccttccagtaccatagtaaagagcagcaatgtgtgatcatggcggaaaacaggaagtcctcaattataatccgcatgcgggatgtggtgctgttcgaaaagaaggtgtatctgagcgagtgcaagaccgggaacgggaagaattaccgggggaccatgagcaaaacaaagaatggtatcacctgtcagaaatggagtagcacctctccccaccggccgagattcagtcccgcgactcaccctagcgaaggcctggaggagaattattgcagaaaccccgacaacgatccacaaggaccctggtgttatacgactgatccagagaagaggtatgactattgtgacatcttggaatgcgaggaggaatgcatgcattgctccggggaaaactacgacggaaagatttcaaagacaatgtccggtctggaatgtcaggcatgggactctcagagcccacatgcacacggatacatcccatccaagtttccaaataagaacctgaaaaaaaactactgccgtaacccagatcgggaactgaggccatggtgctttacgaccgacccaaataagcgctgggaattgtgcgatatacctcggtgcaccacaccaccaccaagtagtggaccgacctatcagtgcctcaagggcactggagaaaattatcgaggaaacgtcgcagtcacggtgagtggccacacttgccaacactggtccgctcagactccgcacacgcataaccggacacccgagaattttccttgtaagaatctcgacgagaattactgccgcaaccctgatggcaagcgggctccatggtgtcacaccacaaatagccaagtcaggtgggaatattgtaaaattccctcctgcgactcctccccagtttccactgaacagcttgcacctactgcaccacccgagttaactccagtagtgcaagactgttatcatggcgacgggcagtcctataggggaacttcaagcactacaacaacagggaaaaaatgtcagtcttggtcatctatgactcctcaccgccatcagaaaacacccgagaactatcctaacgccgggctgaccatgaactactgcagaaatcccgacgctgacaaaggcccctggtgcttcaccacggatcccagcgtgcggtgggagtactgcaacctaaagaaatgttctggcacagaagccagcgtggtagcccctcctccagtggtactgctgcctgatgtcgagactcccagcgaagaagattgtatgttcggaaacgggaaggggtacaggggtaaaagagctactacggtgaccggcaccccatgtcaggattgggcagcccaagaaccccacaggcattccatctttactcccgagacaaacccacgggcaggtcttgaaaaaaattattgcagaaaccccgacggagatgtgggcggcccttggtgctataccaccaatcccagaaagctatatgactactgtgatgtgcctcagtgcgcggctccttcctttgactgcggtaagccacaggtggaaccaaaaaagtgtcccggacgggtcgtaggaggttgcgtggcccacccccatagctggccctggcaggtgagtcttagaactaggtttgggatgcacttttgtggaggtacattaatctccccagagtgggtccttacagctgcacactgtctggagaagagcccaagaccctcaagctacaaggttattttgggcgcccatcaggaggtcaatctagagccacacgtccaagagatcgaggtatctcggctgttcttggaacctacccggaaagacattgctctcctgaagctgtcttctcccgctgtgattacggacaaagtcatcccagcctgtctgccctctcccaattacgtcgtggccgacaggactgagtgctttattaccggatggggagaaacccaaggaacatttggtgctgggttgctaaaggaggcacagctccccgttattgaaaataaggtgtgcaaccggtatgagtttctgaacggaagggtccagtctactgagctatgcgctggccatttggctggagggactgattcttgtcaaggggattccggaggcccactcgtgtgttttgagaaagacaagtatattttgcagggcgttacaagctggggcctaggatgcgcccgccctaataagccaggcgtgtacgtgcgagtgtccagattcgtgacctggattgagggagtgatgcgcaataac

SEQ ID NO: 250981 - DNA, 2430 bp, Artificial Sequence
  Description of Artificial Sequence: Synthetic coding sequence
atggaacacaaagaagtggtcctcctgctgctcctgttcctcaagagtgggcagggcgaaccattagacgactacgtgaacactcagggggctagcctgtttagtgtcacaaagaagcagctcggcgcgggcagcattgaggagtgtgccgcgaaatgtgaggaggacgaagaatttacttgcagggctttccagtaccatagcaaggagcaacagtgtgtgattatggcggaaaatagaaagagttcaatcatcatacggatgcgagatgtcgtgcttttcgagaagaaagtgtatctgtccgagtgcaaaacagggaacgggaagaactaccgcggcaccatgtctaaaactaagaacggaatcacatgccagaagtggtcttccacttcaccccacagacctcgcttcagccccgcaactcacccctccgaagggctggaagaaaattattgccgtaaccccgataatgatccccagggaccctggtgctacactactgaccctgagaaacgctatgactattgcgatattttggagtgcgaggaggagtgcatgcattgttcaggagagaactacgatgggaaaatcagtaaaaccatgtctggtctggagtgccaggcctgggacagccagagtcctcacgcacacggatatatacccagcaagtttcccaacaagaatctgaagaagaattactgcaggaatcctgatcgcgagctccgcccttggtgctttacaactgaccctaataagcgatgggagctgtgtgacataccacggtgtaccacaccccccccgtctagcggacccacgtatcagtgcctcaaagggacaggcgagaactatcgggggaatgtcgccgttaccgtgtcaggccacacatgccagcactggtctgcacagactccccacacacacaatcggactccggagaatttcccttgtaagaaccttgatgagaattattgccgcaatccagatggcaagagagccccatggtgccacactaccaattcccaggtccgctgggagtactgcaagattccgtcttgtgacagctctcctgtgtccactgagcaattagctcccactgcccctcccgaacttactccagtcgtccaggactgctaccatggggacgggcaatcttatcgtgggacctcttctactacgactaccggaaagaaatgccagtcttggagtagcatgacacctcaccggcaccagaaaacgcccgagaactaccccaatgcgggcctgactatgaattattgtcggaatccagacgcggacaaggggccatggtgcttcaccaccgacccctctgttcgatgggagtattgtaatttaaaaaaatgttcaggtaccgaagcgtccgtcgtggctccgccccccgtggtgttgctgccagatgtggaaacgccgtcggaagaggactgcatgtttggcaacggcaagggctatcggggaaagagagccaccactgttaccggaacaccctgccaggactgggccgcgcaagaacctcataggcattcaatctttactcccgagacaaacccccgggctggactggaaaaaaattactgtcggaaccccgacggggacgtaggtggaccgtggtgttataccacaaatccacggaaactttatgattactgtgatgtgccgcagtgtgcagctccgagctttgactgcggaaaaccacaagtcgagccaaagaagtgccccggccgggtggtaggcggatgtgtcgctcacccgcatagttggccctggcaggtctctctgagaactcggttcggcatgcacttctgtgggggaactttgatctccccagaatgggtgctcaccgccgcccactgtctcgaaaagtcgcctcggcctagtagttacaaggtcatcctgggagctcatcaggaagtgaatctagaaccccacgtgcaggagatcgaagtttcgagactgtttctggaaccaactcggaaagacatcgctctcttgaaactgtcatcccccgcggtcatcacggataaggtgattcctgcatgcctgccatccccaaattacgtggttgccgatcgaaccgagtgcttcatcacaggctggggtgagactcagggaacctttggcgccggactcctgaaggaggctcagcttcctgttatagaaaacaaggtctgcaatcgttacgaatttctgaacggccgggtgcagagcactgaattgtgcgcgggacatctagctggaggtacagacagctgccagggtgactccggcggcccactagtgtgctttgagaaagataaatatattctgcagggagttacatcatggggcctgggatgtgccaggcccaataagcccggagtgtatgtgcgcgttagtaggttcgtgacctggatcgagggagttatgcgaaataac

SEQ ID NO: 250982 - DNA, 2430 bp, Artificial Sequence
  Description of Artificial Sequence: Synthetic coding sequence
atggagcacaaagaggtggttctgttgctcctgctgttcctcaaaagtggccagggcgagccgctggatgactatgtgaacacccaaggtgcgtctttgttcagcgtgaccaagaagcaactcggggccggttcaattgaggaatgtgccgccaaatgcgaagaagacgaagaattcacctgtcgagcttttcagtatcactccaaggaacagcaatgtgttatcatggcagagaaccgcaaaagcagcatcatcatccgcatgagggatgtggtgctgttcgagaagaaggtttacctgtccgaatgcaagacggggaatggcaagaattacaggggtacgatgagcaaaacgaagaatggtattacttgtcaaaagtggtctagcacgagccctcaccgcccacgcttctccccagcaacccacccttctgaaggactggaggaaaactactgccgcaatcccgataatgacccccaaggtccgtggtgctacacgaccgatcctgaaaagcgctacgactactgcgacatcctggagtgcgaggaggagtgtatgcactgctccggagaaaattacgatggtaaaatcagcaagaccatgtcaggtctggagtgccaggcctgggatagccagtctccgcatgcgcatggttatatcccatctaagtttccaaataaaaacctgaagaaaaactattgtcgcaacccggacagagagctgcgcccatggtgcttcaccacagacccaaacaaacgttgggaactgtgtgatattccgaggtgtacaacgcctccaccttcgagcggccctacgtaccaatgcctgaagggtaccggtgaaaattatcgtggtaacgttgccgtgacggtctctggacatacttgccagcactggagcgctcagaccccgcatacccacaaccgaactcccgaaaatttcccatgcaaaaatctggacgagaattactgtcgtaatccggatggaaaacgggcgccttggtgtcatactacgaactctcaggtacgctgggagtactgcaagatcccaagctgcgacagctctcccgtgagcaccgagcagctggcaccaacggctcccccggagttgacgccggtcgtccaggactgctatcacggggacggtcagtcatatcgcggaactagctctacgaccacgaccggcaagaaatgccagagctggtctagcatgactcctcaccgccaccagaaaactccagagaactatccaaacgccgggctgacgatgaattattgccgcaatccagacgcagataaaggtccgtggtgtttcacgaccgacccaagcgtgcgctgggaatattgcaatctgaagaagtgtagcggtactgaggcgagcgtcgttgcgccacctccagttgtcctgctcccagatgtggaaaccccatccgaggaggactgcatgttcgggaatggtaagggttaccgtggtaagcgtgctactaccgtcacgggtaccccatgtcaggattgggccgcgcaggaacctcaccgtcatagtatctttactcctgagaccaacccacgagccggcctggaaaaaaattattgccgcaatcccgacggcgatgttggcggtccgtggtgctacaccaccaacccgcgcaagctgtacgattattgcgatgttcctcagtgcgcggcaccaagctttgactgtggtaaaccacaggtggaacccaagaaatgcccaggacgcgtggtggggggatgcgtcgcacatcctcactcctggccatggcaagtgagcctccgcacccgcttcggtatgcacttctgcgggggtacgctgatttctcccgagtgggtcctgacagcagcgcattgcctggagaaatcgccacgacctagctcctacaaagtcatcctgggcgcgcatcaagaagtgaatctggagccacatgtgcaggagatagaggtttcccgcctgttcctggaaccgacccgcaaagatatcgcgctgttgaagctgtccagtcccgccgtcattacggataaagtcattccagcctgtttgccgagcccaaactatgtggtcgccgaccgtaccgaatgtttcattaccggttggggtgaaacgcaaggtacctttggagctggtctgctgaaggaagcccagctgccagttatcgagaacaaggtgtgcaatagatacgagtttctgaacggccgtgtccagagcaccgagctctgcgctggccatttggcaggcggcaccgattcttgtcaaggtgactccggcggtccattagtctgcttcgaaaaggacaagtatattctgcagggtgtcaccagctggggactggggtgcgcacggcccaacaaacccggagtctatgttagggtttcccgcttcgttacgtggattgaaggggttatgcgcaataat

SEQ ID NO: 250983 - DNA, 2430 bp, Artificial Sequence
  Description of Artificial Sequence: Synthetic coding sequence
atggagcacaaagaggtggtgctgctgttgctgctctttctgaagtccggccagggcgaaccgttggacgactacgtcaatactcagggagcgtctctcttctctgtgactaagaagcagctcggcgcaggatccatcgaggaatgcgccgctaagtgcgaggaggacgaggaattcacttgcagagcattccagtaccacagcaaggaacaacagtgtgtcatcatggccgagaaccggaaatcatccatcattatccggatgagagacgtggtgctgttcgaaaagaaggtgtacttgtccgaatgtaagaccggcaacggcaaaaactatcgcgggactatgtcaaagacgaaaaatggaatcacttgccagaagtggtccagcacttcgccgcaccgcccgcgcttctcgcctgccactcacccgtccgaagggctggaagagaactattgccggaatccagacaacgatcctcaaggaccatggtgctacaccaccgacccagaaaagcgctacgattactgcgatatcctcgaatgtgaggaagagtgtatgcactgctccggtgaaaactacgatggaaagatcagcaaaaccatgtccgggctggagtgccaggcatgggattcgcagagcccgcacgcgcacggatacatcccttcaaaattcccgaacaaaaacttgaaaaagaactactgtcgtaacccggacagagagctccgcccttggtgcttcactaccgacccaaacaagagatgggaactttgcgacatcccgagatgtaccactcccccgccaagctctggaccaacttaccagtgtcttaagggcaccggagaaaactatcggggaaatgtggccgtgaccgttagtggacatacctgccaacactggagcgctcagacgccgcatactcataatagaaccccggagaacttcccctgcaagaaccttgatgagaactattgtcgcaatcctgacgggaagcgggcgccttggtgccataccaccaacagccaggtgcgctgggagtactgcaaaattccgtcctgtgacagctcgcccgtctccactgagcaactggctcccaccgcaccacctgagctgacccccgtcgtccaagattgctatcacggtgacggacagagctataggggaacctcatcaacgaccaccacgggaaagaagtgccaatcctggtcctcaatgactccgcatcggcatcagaaaactcccgagaattacccgaacgcggggcttaccatgaactactgcagaaacccggatgccgataagggaccctggtgctttaccactgacccgtccgtgcgctgggaatattgcaacctgaaaaagtgttccggcaccgaggcatccgtggtcgcccctccccctgtggtcctgctgcctgatgtggagactccctcagaagaagattgcatgttcggaaacggtaagggatacaggggaaagagggcgaccaccgtgaccggcaccccctgccaagattgggcagctcaggagccacatcggcactccattttcactcctgaaactaatccgcgggccggtctggagaagaattactgcaggaacccggatggtgacgtgggaggaccgtggtgctacacgaccaacccacgcaagctgtacgactactgcgacgtcccacagtgcgccgccccatcgttcgactgcggaaaaccacaagtggagcccaagaagtgcccgggcagggtcgtaggtggctgtgtggcccatcctcactcatggccgtggcaagtgagtctgcggactagatttggaatgcatttttgcggaggaaccctgatctccccggagtgggtgctgactgccgcccattgcttggaaaaaagcccacgcccgtcgtcgtacaaggtgatcctcggggctcatcaggaagtgaacctggagcctcatgtgcaagaaattgaagtgtcgagattgtttctcgaaccgactcgcaaagacattgctctcctgaagttgtcgtcgccagcggttatcaccgacaaggtgatacctgcctgcctgccttccccgaactacgtggtggcagaccggactgaatgcttcatcactggatggggagaaacccagggcactttcggtgctggcctgctgaaggaggcgcagctgccagtgatcgagaataaggtgtgcaatcgctatgaattcctgaacggacgcgtccagtccacggagctctgtgccggacatttggccggaggcaccgactcttgccagggggattccggtgggccactggtgtgtttcgaaaaggacaagtacattctgcagggcgtcacgtcgtggggactcggatgcgctagaccgaacaagcctggagtctacgtgcgcgtgagccgcttcgtgacgtggatcgagggggtgatgcgcaacaat

SEQ ID NO: 250984 - DNA, 672 bp, Artificial Sequence
  Description of Artificial Sequence: Synthetic coding sequence
atgtcgcggaaaatagaagggttccttctcctgcttctgtttggttatgaggcaaccctcgggttgtctagtaccgaggacgaaggtgaagatccttggtaccagaaggcttgcaagtgtgactgtcagggtggcccaaacgccctgtggtcagccggtgccacttccctcgattgtattcccgaatgtccataccataaacccctgggatttgaaagcggagaagttaccccagatcaaattacctgttcaaaccccgagcagtacgtgggttggtacagctcgtggactgccaacaaagcacgactgaactcccaaggattcggatgtgcgtggctgtcgaagttccaggattcctcccaatggttgcagatcgatttgaaagagattaaagtgatcagcgggattctgactcaaggtagatgtgatattgatgaatggatgaccaagtactccgtgcaatacagaactgacgaacgacttaactggatctactacaaggaccaaaccggaaataacagagtgttctacgggaactcagatagaactagcaccgtgcaaaacctgcttcgcccgcccatcatctctcgattcatcaggctcatcccactgggatggcatgtccggatagcaatccgcatggagcttctcgagtgtgtgagcaagtgtgcg

SEQ ID NO: 250985 - DNA, 672 bp, Artificial Sequence
  Description of Artificial Sequence: Synthetic coding sequence
atgtctaggaaaatcgagggattcttgttgctgttgctgttcggctatgaggctactttgggattgagttctaccgaggacgagggagaagacccctggtatcagaaggcatgtaagtgcgactgtcaaggaggtcccaatgccctgtggagcgctggcgctacatctctcgattgcatacccgagtgtccctatcacaagcccctgggcttcgaatccggagaggtgacccccgaccagattacttgctcaaaccccgagcaatatgtaggatggtattcttcttggacagccaacaaggctcgtctcaatagccaaggtttcggatgcgcttggctctctaaatttcaggactcctcccagtggctccagatcgatctgaaagagattaaggtgatttctggcatcttgacacagggaagatgcgacatcgacgagtggatgaccaaatatagtgttcaataccgcaccgatgagcgtctcaactggatctattacaaggatcagactggcaacaaccgtgtgttttatggcaatagcgatagaacctccacagtgcagaacctgttgagacctcccattatttcccgcttcatacgtctgatccccctgggttggcacgttcgcattgctatcaggatggagttgctcgaatgcgtctccaaatgcgca

SEQ ID NO: 250986 - DNA, 672 bp, Artificial Sequence
  Description of Artificial Sequence: Synthetic coding sequence
atgtcacggaagattgaggggtttctgttgctcttgttgttcggatacgaggcaacgctcgggctctcctctacggaggatgagggggaggacccctggtaccagaaagcctgtaagtgtgattgccaggggggcccaaacgcactgtggtcagcaggggccactagtctggactgtattccagagtgtccttaccacaagcccctgggctttgagtcgggagaagtcacccctgaccagattacttgctctaaccccgagcaatatgttgggtggtactccagctggaccgccaacaaggctagactgaactctcaggggttcgggtgcgcgtggttatcgaaattccaggattcttcacagtggctccagatcgacctgaaggaaattaaggtgatcagcgggatcttgactcagggacggtgtgacatcgacgaatggatgactaagtactctgttcagtaccgaacagatgagagattgaattggatatattacaaagatcagaccgggaataatagagttttttacggaaactctgaccgcactagcaccgtgcagaatctccttagacccccgatcatttctcgatttatacgactaatccccctgggatggcatgtgcgcattgccattaggatggagctactggaatgcgtgtcaaagtgtgct

SEQ ID NO: 250987 - DNA, 672 bp, Artificial Sequence
  Description of Artificial Sequence: Synthetic coding sequence
atgagtcggaaaattgagggatttctgctcctgcttttgttcggatacgaggccaccctggggctcagctcaactgaagatgagggcgaagacccttggtatcagaaagcatgtaagtgtgattgtcagggcggtcctaacgctctgtggtccgctggtgctacaagcctggattgcatcccagagtgtccctaccacaaacctctcggatttgagagtggggaagttacaccagatcagatcacttgttcaaaccctgagcagtatgtgggttggtactcttcttggacagcgaataaagcaagacttaatagccagggattcggctgcgcatggctcagtaaattccaagactcaagccagtggctccagatcgacctcaaagagattaaggtgataagcgggatcctgactcaaggccggtgtgatatcgatgagtggatgaccaaatattccgtgcaatacagaaccgacgaaaggctgaactggatctattacaaggatcagacaggcaacaatagagtgttttatggaaattcagaccggacgtccaccgtccagaatctcctgaggcctcctatcatcagccggttcattcgactgattcctctgggttggcatgtgagaatcgccatcaggatggaactgcttgagtgcgtctctaaatgcgca

SEQ ID NO: 250988 - DNA, 672 bp, Artificial Sequence
  Description of Artificial Sequence: Synthetic coding sequence
atgtctcggaagatcgaaggattcttgctgctccttctgtttggttacgaggcgactctcgggcttagctccactgaggacgaaggagaggatccgtggtaccagaaggcgtgcaagtgcgactgtcaaggcgggccaaacgcactgtggagcgcaggagccacctcactggactgtattccagaatgcccgtatcataaacctctggggtttgaaagtggcgaagtgaccccggatcaaatcacctgtagcaaccctgagcaatacgtgggttggtactcctcttggaccgcgaacaaagccagactcaattcacagggtttcggttgcgcctggttgagcaagttccaggactcatcccagtggttgcagatcgacttgaaggagataaaagtcatcagtggcatcctgactcaaggccgctgcgatatcgatgagtggatgacgaagtactcggtccagtaccgaacggatgaacggctgaattggatctactacaaagaccagaccggcaacaatagagtgttctacggaaactcagaccgcacctcgactgtccaaaacctgctgcggccgcccatcatttccaggttcatcaggctgataccactcgggtggcacgttcgcatcgctattcgtatggaactcctggagtgcgtgagcaagtgcgcc

SEQ ID NO: 250989 - DNA, 672 bp, Artificial Sequence
  Description of Artificial Sequence: Synthetic coding sequence
atgtcgagaaagattgaaggctttctgcttcttctcctgtttggatacgaagccactctgggactctcctcgaccgaagatgaaggggaggacccatggtatcagaaggcctgcaaatgtgattgtcagggcggccctaacgcactttggtccgcaggagctacttcccttgattgtattccagaatgtccttaccacaagccacttggttttgagagcggagaggtcaccccggaccaaattacttgttcaaacccagaacagtacgtgggttggtactcttcgtggactgcaaacaaggcccggctcaacagccagggattcggatgtgcctggctgtcgaagtttcaagattcgagccaatggctccaaatcgacctcaaagaaatcaaggtgatttctggaattctgactcaaggaaggtgtgatattgatgaatggatgaccaagtactccgtgcaataccggactgacgaaagacttaattggatctactacaaggaccaaaccggtaataaccgggtcttttacggaaattcggataggacctcaaccgtgcagaaccttctgcgcccgcctatcattagccggtttattcgcctgattcccctcggttggcacgtgcggatcgctattcggatggaattgctggaatgcgtttcaaagtgtgca

SEQ ID NO: 250990 - DNA, 672 bp, Artificial Sequence
  Description of Artificial Sequence: Synthetic coding sequence
atgtcaaggaagatagaaggcttcctgctgcttctcctgttcggttacgaagccactctgggcctctcgagcactgaggacgagggcgaggacccgtggtaccagaaagcctgtaagtgcgattgtcagggcggaccaaatgcgctctggtccgccggcgcgacctcactcgattgcatcccggaatgcccctaccataagccgctgggtttcgaatccggagaagtgacccctgaccagattacgtgctccaatccggagcaatacgttggatggtactcgtcatggaccgcgaacaaggccagactgaactcgcagggcttcggatgcgcgtggttgtcgaagtttcaagacagctcacagtggctgcagattgacctcaaggagataaaggtgatttcaggcatcctgacccaaggacggtgtgatatcgatgaatggatgaccaagtactctgtccagtaccgcaccgacgaacgcctgaactggatctactacaaggatcagaccggaaacaaccgggtgttctatggaaactcagatcgcacttcgacggtccagaatctgctccggccaccaatcattagccgctttatcaggctgatcccgctcggttggcacgtccgaatcgccatccgcatggagctgctggagtgtgtgtccaaatgtgca

SEQ ID NO: 250991 - DNA, 672 bp, Artificial Sequence
  Description of Artificial Sequence: Synthetic coding sequence
atgtcaaggaagatcgaaggctttctcctcctgctgctgttcggatatgaagctaccctgggtctttcctctacagaggatgaaggggaggacccatggtaccagaaagcatgtaaatgtgactgtcagggaggccccaacgctctgtggagcgccggagcgacttcactcgactgtatcccagagtgcccttaccataaaccactgggctttgagtcaggcgaggtgacaccagatcaaattacctgcagcaaccctgaacagtatgttggttggtacagcagttggacggcaaacaaggcccgactgaactcacagggcttcgggtgcgcatggctttccaagttccaagattcctcgcaatggctccagattgacctcaaagaaattaaagtgattagtggaattttaactcagggacgctgtgacattgatgaatggatgaccaagtactccgtgcagtacagaactgatgagcgcctgaattggatatactacaaggaccaaacaggaaataacagagtgttctatgggaactccgaccgaactagcacagttcagaatttgttgaggcctccaatcatctcccggttcatccgcctgatccctctagggtggcatgtgcgtatcgccattaggatggaactcctggagtgtgtgtctaagtgcgcc

SEQ ID NO: 250992 - DNA, 672 bp, Artificial Sequence
  Description of Artificial Sequence: Synthetic coding sequence
atgtccagaaagatcgaaggattcctgctgttgctgctcttcgggtacgaagcgactctcggactctcgtccactgaggacgaaggggaggacccttggtaccaaaaagcatgcaagtgtgattgtcaaggagggccgaacgcactctggtcagccggtgcaacctcgctggactgtattcctgaatgcccataccacaagccgctgggctttgagtctggagaggtgacccccgatcagattacttgttcgaacccagaacagtacgtgggctggtactcgtcatggacggccaataaggctcgcctgaattcccaagggttcggatgcgcgtggctgagcaaatttcaggactcgtcgcaatggctccaaattgatcttaaagagatcaaggtcatctcaggaatcctgacccaaggacggtgcgatatcgacgagtggatgaccaagtactcagtgcagtacaggacggacgagcgcctgaactggatatactacaaagaccagactggcaacaatcgggtcttttatggaaattctgatcgcacctcgactgtccagaaccttctgaggccgccgattatctctaggttcatccgcctgatcccgctgggatggcatgtgcggatcgccatcagaatggagctgctcgagtgcgtgagcaagtgcgct

SEQ ID NO: 250993 - DNA, 672 bp, Artificial Sequence
  Description of Artificial Sequence: Synthetic coding sequence
atgagtaggaagattgagggcttcctgttgcttttgctattcggctacgaagccaccctcgggttatccagcacagaagacgaaggcgaggatccctggtatcaaaaggcctgtaagtgtgattgccaaggcggcccaaacgcactttggagtgctggagccacatctctggattgtatccctgagtgtccttaccacaaacccctagggtttgaatcaggagaagtgactccggatcagatcacgtgctctaacccggaacagtacgttggttggtattcctcttggactgccaacaaagcacgactcaactcacaagggttcggatgcgcctggctgtctaagtttcaggattcctcacagtggctgcagatcgacctgaaggaaatcaaggtcattagcggaatactgactcaaggccggtgcgacattgatgagtggatgacgaagtactcagtacaatataggaccgatgagaggctgaattggatctactacaaagaccagacaggcaataaccgggtgttttatggcaacagtgataggacaagtaccgtccagaacctgcttcgaccgcccatcatctcacgcttcatccgcctcatcccgctgggctggcatgttaggattgccataagaatggaactcttggagtgtgtgagtaagtgtgcg

SEQ ID NO: 250994 - DNA, 672 bp, Artificial Sequence
  Description of Artificial Sequence: Synthetic coding sequence
atgtcacgcaagatcgaggggtttctgcttctgctcttgttcgggtacgaagctacactggggttgtctagtacagaagatgagggagaggatccatggtaccagaaggcatgtaaatgtgattgccagggcggtccaaacgctctctggagtgccggcgccacctcactggactgcattcccgagtgcccctatcacaagcctttaggctttgaaagcggcgaggtcaccccagatcagatcacctgctctaaccccgagcagtacgtcgggtggtattcctcttggacagcaaataaagcccgtcttaattctcaaggatttggttgcgcatggttgtccaagttccaggactcatcccagtggctgcagatcgatcttaaagagataaaagtcatctcaggaatcctcacacagggacgttgtgatatcgacgagtggatgaccaaatatagtgtacaatatcgtacagatgagcgcctgaattggatctactataaggaccaaacaggcaataatcgggtgttttacggcaactctgacaggacatctaccgtccagaacctgctgcgaccgcctattatctctaggtttattaggctcatcccactgggctggcacgttcggatcgccataaggatggaactgctggagtgtgtatcaaaatgtgca

SEQ ID NO: 250995 - DNA, 672 bp, Artificial Sequence
  Description of Artificial Sequence: Synthetic coding sequence
atgagcagaaagattgaaggattcttgctgttactgctgttcggttacgaggccaccttaggcttgtccagtacggaagacgagggcgaggacccatggtatcagaaggcctgtaagtgtgattgccaaggaggccccaacgccctgtggtccgctggagccacgagcctggactgtatcccagagtgcccctaccacaagccactcggctttgaatccggagaagtgactcccgatcagataacatgttccaatcccgagcagtatgtcggatggtattctagctggacagccaacaaggctcgattgaacagccaggggttcggttgcgcctggctgagcaaatttcaggactcttcacaatggttacagattgacttgaaagaaatcaaagtgatttctgggatcctgacccaaggccgatgtgatatcgacgagtggatgactaaatattccgtccagtatcgaacggatgaaagactcaactggatctattataaagaccagacgggcaacaacagagtcttctatgggaatagtgaccgaacgagcacagtgcagaacctgcttcggccccctatcatctctaggtttattaggctgatccctctcggatggcatgtaagaattgctataagaatggagctgcttgagtgtgtgagtaagtgcgct

SEQ ID NO: 250996 - DNA, 672 bp, Artificial Sequence
  Description of Artificial Sequence: Synthetic coding sequence
atgtcacgaaaaattgagggattcctcctgcttctcttattcgggtatgaagctacattaggactatcaagtactgaagatgaaggggaagatccctggtatcagaaagcttgtaagtgtgattgtcagggaggacccaacgctctttggtctgccggagccacatctctcgactgtattcccgaatgcccttaccataaaccacttggattcgaatctggggaagtcactcctgatcagatcacatgctccaaccctgaacaatatgtaggatggtattcttcctggactgctaataaagctaggctgaactctcaggggtttggatgcgcctggctctctaaatttcaggatagtagtcagtggctccaaattgatttgaaggaaataaaagtaatatctgggatcctcactcagggacgctgcgacatagatgaatggatgacaaaatactcagtccagtaccgaacagatgaacgcctaaactggatatattacaaagatcagacaggaaataatcgggtgttctatggaaacagtgaccggacttctactgtacagaacctgttaagaccaccaatcatatcgaggtttatcagactcatccctttggggtggcacgtccgaatagctataaggatggaattactcgaatgtgtatctaaatgcgct

SEQ ID NO: 250997 - DNA, 672 bp, Artificial Sequence
  Description of Artificial Sequence: Synthetic coding sequence
atgtctcgtaagatagagggttttttgcttctgctcctcttcggttatgaagctactctggggcttagttccacagaggatgaaggcgaagatccttggtaccagaaagcctgcaagtgcgactgtcaggggggcccaaatgcactgtggtcagctggcgctacatccctggactgtatccccgagtgtccttaccacaagcccctgggcttcgaaagcggtgaggtcacacctgatcagatcacctgcagtaatcccgagcagtatgtgggctggtactcctcctggaccgcaaacaaggctaggctcaacagccagggatttggctgcgcttggctcagcaaattccaggatagctcccagtggctgcagattgatctgaaggagattaaagttatctctggtatcctgacccagggcaggtgtgacattgatgaatggatgaccaagtatagtgtgcagtacaggaccgatgaaaggcttaactggatttactataaggatcagactggcaataaccgtgtgttctacgggaactccgatcgaaccagcactgtgcagaatctattaaggccccctattataagccgcttcatcagattgatccccctgggctggcatgtcagaatagccatccgaatggaattgctagaatgcgtgtctaagtgtgct

SEQ ID NO: 250998 - DNA, 672 bp, Artificial Sequence
  Description of Artificial Sequence: Synthetic coding sequence
atgtcgcgcaagatagagggatttctgctgcttcttctgttcggatatgaagctactctcggactctcctcgaccgaggatgagggggaagatccttggtaccagaaggcatgcaagtgcgattgccaaggaggcccgaacgccttgtggagcgccggtgccacgtcgctcgactgtattcctgaatgtccatatcacaaaccattgggctttgaatcaggagaagtgactccagaccagattacctgctcgaaccctgagcaatacgtcggatggtactcctcctggacggcgaacaaggccaggcttaattcgcagggattcgggtgcgcatggctgtctaagtttcaagactcgtcacagtggctccagatcgacctgaaggagatcaaagtgatctccggcatcctgacccagggacggtgtgacatcgacgagtggatgactaaatactcggtgcaatacaggacggatgagcggctgaactggatctactacaaagaccagactggtaacaatagagtgttctacggtaattccgataggacctctactgtgcaaaacctgctccggccccctataatctcaagatttatcagactcatcccgctgggctggcacgtgcgtattgcgatccgcatggagctgttggaatgtgtttccaagtgcgct

SEQ ID NO: 250999 - DNA, 672 bp, Artificial Sequence
  Description of Artificial Sequence: Synthetic coding sequence
atgtcacgaaagatcgagggctttcttttactgctgttattcgggtatgaggccacactgggcctgagctccaccgaggacgagggtgaggacccatggtatcagaaggcctgcaagtgcgactgtcagggcggtcctaacgcactatggtcggccggcgcaaccagtctcgattgcattcctgaatgcccttaccataagccactggggttcgagtcaggggaggtaactcctgatcagataacctgttccaatccggaacaatacgtcggctggtactcttcctggacagccaataaggccaggctgaatagccagggatttggctgcgcatggttatctaagttccaggactcctctcagtggctccaaatcgatctgaaggaaattaaggtaattagtggtatcttgacccaggggaggtgcgacattgacgagtggatgacgaagtattcggtacagtaccgcactgacgagcgacttaactggatctattacaaggatcagaccggaaataacagggtgttctacgggaattctgaccgaacttctactgttcagaaccttctccgaccgccaatcatttccaggttcattcgactaatccctcttggctggcatgtccggatcgctattagaatggaactgctcgagtgcgtcagcaagtgtgcc

SEQ ID NO: 251000 - DNA, 672 bp, Artificial Sequence
  Description of Artificial Sequence: Synthetic coding sequence
atgtcacgcaagattgaaggtttcctgcttctgttgttatttggctacgaggccactcttggtctgagcagcacagaagatgaaggagaagatccgtggtaccagaaggcttgtaaatgcgattgccagggaggtcctaacgcattgtggtctgcaggcgcgacgtctcttgattgtattccagagtgcccctaccataaaccactcggcttcgaatccggagaagtcacgccggaccagatcacctgcagcaatcctgagcaatacgtcggctggtatagcagttggacggcaaataaagcacgcttaaattcacaaggttttggttgtgcatggctttcaaagtttcaggacagctcccagtggttgcagattgatttgaaagagatcaaggtaattagcggtatacttacgcaaggcagatgtgatatcgatgagtggatgacaaaatatagcgtgcaataccggacggacgaaagattgaactggatctattataaggatcagacagggaataatagagtattctatggaaatagcgacagaacgtctacagtgcaaaatttgcttcgcccgccgataattagccgcttcatacgtcttattcctctaggatggcatgtacgtattgccatacgtatggaacttcttgagtgcgttagcaaatgcgca

SEQ ID NO: 251001 - DNA, 672 bp, Artificial Sequence
  Description of Artificial Sequence: Synthetic coding sequence
atgtcaagaaagatcgagggctttcttcttcttctgctgtttggatatgaagcaaccctgggactgtcatccaccgaagatgaaggggaagatccttggtaccaaaaggcatgtaagtgcgattgtcagggcggaccaaacgctttgtggtcagctggagcgaccagcctggactgtattccggagtgtccctaccataaaccacttggatttgagtcgggagaagtgacccctgatcaaattacgtgctcaaaccctgaacaatacgttggttggtactcgtcctggaccgcaaacaaggcacggctgaactcgcagggattcggttgtgcatggctgtccaaattccaggacagctcgcaatggctgcagattgatcttaaagaaatcaaagtgattagcgggatcctcactcaaggccgctgtgatatcgatgaatggatgacgaagtactcggtccagtacagaactgacgaaaggcttaactggatttactacaaggaccaaactggtaataaccgggtcttttacgggaactcggatcgcacttcgaccgtgcagaacctgcttcgccctcccatcatttcgcggttcatccggctgattcctcttgggtggcacgtgcggatcgcaatcaggatggagctgctcgaatgcgtgtctaaatgcgcg

SEQ ID NO: 251002 - DNA, 672 bp, Artificial Sequence
  Description of Artificial Sequence: Synthetic coding sequence
atgagtagaaagattgaaggattccttttattattgttattcggatatgaagctactcttgggttaagtagtacagaagatgaaggtgaagatccttggtatcaaaaggcatgcaaatgtgattgtcaaggagggcctaatgcattatggtcagctggagcaacttctttagattgtattccagaatgtccatatcataaacctttaggatttgaatcaggagaagtgactcctgatcaaattacatgtagtaatcctgaacagtatgttggttggtattcatcatggactgctaacaaagctagattaaattcacaagggtttggttgtgcttggttgtctaaatttcaagattcaagtcaatggttacaaattgacttaaaagaaattaaagttatttctggaattttaactcaaggaagatgtgatatcgatgaatggatgactaaatattcagttcaatatagaacagacgaaagacttaactggatttattataaagatcaaacaggtaataatcgtgtattttatggaaattctgatagaacatcaacagttcaaaatcttttacgacctccaataatttcaagatttattagattaatacctcttggatggcatgttagaattgcaattagaatggagcttcttgaatgtgtttcgaagtgtgct

SEQ ID NO: 251003 - DNA, 672 bp, Artificial Sequence
  Description of Artificial Sequence: Synthetic coding sequence
atgagcagaaagattgaaggctttttgctcctcctgctgttcgggtacgaagcaactctgggactttcgtcgactgaggacgaaggtgaagatccatggtaccaaaaggcttgtaaatgtgattgtcagggcggacctaatgcactgtggtcggccggggcaacgtcgctggattgtattccggaatgcccttaccataagcctcttggatttgaatccggagaggtgaccccggaccagatcacctgcagcaacccagaacaatacgtgggctggtactcgtcttggactgccaacaaggcaagactcaattcccagggtttcgggtgtgcatggcttagcaaatttcaggactcgagccaatggctgcaaattgatctgaaggagattaaggtgatttccggcattcttactcaagggcgctgtgacattgatgagtggatgactaagtacagcgtgcaataccgaactgacgaaagactgaattggatttactacaaggatcagactggaaataaccgagtgttttacggaaactccgataggaccagcacggtgcaaaatctgttgcgacctcccatcatcagccgtttcatccgccttattccactgggttggcatgttagaatcgcaattcgtatggaactgttggaatgcgtttcaaaatgcgca

SEQ ID NO: 251004 - DNA, 672 bp, Artificial Sequence
  Description of Artificial Sequence: Synthetic coding sequence
atgtcccgtaagatcgaggggttcctcctgttgctgctctttggctacgaagccaccttgggactgtcgtccaccgaagatgaaggggaggatccgtggtaccagaaggcttgtaagtgcgactgccaaggcggacctaatgctctgtggagcgccggagctacctcattggactgcatcccggagtgtccttaccacaagccactggggttcgagtcgggagaggtgactccagatcagattacctgctcaaacccagaacaatacgtgggatggtactcgtcatggactgcgaataaggcccggctcaactcccagggattcggatgcgcttggctgtcgaagttccaggactcctcgcagtggttgcagatcgatcttaaagagatcaaggtcatttcaggaatcctgacccagggaaggtgcgacatcgatgaatggatgacgaaatactccgtgcaataccggaccgacgaaagactgaactggatctactataaagaccagaccggaaataaccgggtgttctacggaaacagcgaccgcactagcaccgttcaaaacttgctcaggccgccaatcatctcaagatttatccgcctgatcccgctcggctggcacgtgcgcatcgccattcggatggaactgctggaatgcgtgtccaaatgcgcg

SEQ ID NO: 251005 - DNA, 672 bp, Artificial Sequence
  Description of Artificial Sequence: Synthetic coding sequence
atgagccgtaaaattgaagggttcctgttattgctgctgttcggttatgaggcaacactggggctgagtagcaccgaagacgagggagaagacccctggtatcagaaggcttgtaaatgtgactgtcagggcggtcctaatgccctgtggagtgcaggcgccacttctttggactgtataccagagtgcccatatcataagccccttgggttcgagtccggcgaagtgacaccagaccagattacgtgttcaaaccccgaacagtatgtgggatggtactcatcctggactgcaaacaaggcacgacttaattctcagggtttcggctgcgcatggctctcaaagtttcaagattcctctcagtggctacagatcgacctgaaagaaatcaaagttattagtggaattttgacccagggaagatgcgacatcgatgaatggatgaccaagtacagcgtgcagtatcggacggacgagagacttaattggatctattataaggatcagaccggaaataatagagtgttttacggcaattctgataggacgagcactgttcagaacctgctgcgtccacccataatctcacgatttatccggctgatacctttaggctggcacgtcaggatcgctattaggatggaactcctggagtgtgtgtcaaagtgcgcc

SEQ ID NO: 251006 - DNA, 672 bp, Artificial Sequence
  Description of Artificial Sequence: Synthetic coding sequence
atgtcaagaaagattgaaggttttcttctccttcttctgttcgggtacgaggctacgcttggactgagctccactgaagatgagggtgaagatccttggtaccaaaaggcatgtaagtgcgactgtcagggaggaccaaacgcactgtggtcggcgggcgccaccagcctggactgcattcctgaatgtccataccataaaccccttgggtttgagtcgggtgaagtcactcctgatcagataacctgttcaaaccctgagcaatacgtgggttggtactcgtcgtggaccgcaaacaaggccagactcaattcccaaggatttggttgcgcatggttgtccaagtttcaagattctagtcaatggctgcagattgacctgaaggagattaaggtgattagcggtatcctcacgcaaggcagatgtgatatcgatgagtggatgactaagtacagcgtacaatacagaaccgatgaaagactgaattggatctactataaggaccagaccggcaataaccgagtgttctatggaaattcggatcggaccagcaccgtgcagaacctgttgcgtccccccataatcagcagattcatccggctcatccctcttggctggcacgtgcggattgccatacgaatggaactgcttgagtgcgtgtcaaaatgtgcc

SEQ ID NO: 251007 - DNA, 672 bp, Artificial Sequence
  Description of Artificial Sequence: Synthetic coding sequence
atgagtagaaaaattgaagggttcctgctgctcctcttgtttgggtacgaggccactcttggtctcagctccacggaggacgagggggaagacccctggtaccagaaggcctgcaagtgcgactgtcagggaggtccgaatgccctgtggtccgccggcgcaacctctctggattgcattcctgagtgcccgtatcataagcccctgggatttgagtccggcgaggtaaccccagaccagattacatgctcaaaccctgagcagtatgtgggttggtacagttcctggaccgccaacaaagcccgcttgaactcgcaggggtttggctgtgcctggctgtccaagtttcaggattcgagccagtggctgcagattgatcttaaagagataaaggtgattagcgggatcctaacacaaggacgctgtgacatcgatgaatggatgacaaaatactccgtgcagtacaggacagacgaacggttaaattggatatattataaagaccagaccggcaataaccgagtgttttatgggaacagcgaccgaacaagcaccgtccagaacctgcttagaccaccgatcatctcaaggtttatccggctcatccccctgggatggcatgtccggatcgccattcggatggagcttctggaatgtgtgtctaagtgtgct

SEQ ID NO: 251008 - DNA, 672 bp, Artificial Sequence
  Description of Artificial Sequence: Synthetic coding sequence
atgagcaggaagattgaaggttttcttctgctcctgctgtttggttacgaggcaaccctcggtctttcgagtaccgaggacgagggcgaagatccgtggtaccagaaagcctgcaagtgcgactgtcaaggcggtccgaacgccctttggtcggcaggcgcgacttcactggattgcatcccagagtgtccttaccacaaaccactgggtttcgaatcgggggaggtgactcctgaccagatcacctgttcgaaccctgaacaatatgtgggatggtacagctcatggacggcaaacaaggccagactgaactcccaaggttttggttgtgcatggctttccaaatttcaagatagctcccaatggctgcagattgatctgaaggaaatcaaggtcatctccggaatactcactcaaggtcggtgtgatattgatgaatggatgaccaaatactcggtccagtaccggaccgatgaaagattgaactggatttactacaaagaccagaccggtaataacagagtgttttatggaaattcggataggacgtcaaccgtgcaaaacctccttagaccgcctatcatttcgaggtttattcgcctgattccccttgggtggcatgtccgtatagcaattaggatggaacttcttgaatgcgtgtcgaaatgtgca

SEQ ID NO: 251009 - DNA, 672 bp, Artificial Sequence
  Description of Artificial Sequence: Synthetic coding sequence
atgtctcgcaaaatagagggctttcttcttctcttgctcttcggctacgaagctactctgggtttgtcttcaacagaggacgaaggcgaggatccctggtatcagaaagcctgtaagtgcgattgtcagggtggacccaacgctctttggtcggccggggcaacgtcgctggactgcatcccagagtgcccttatcacaaacctctgggattcgaaagtggtgaggtaacccctgatcagatcacctgttctaatcctgagcagtacgtgggatggtattcctcatggaccgcaaacaaggccaggctcaactcacagggctttggttgtgcgtggctgtcaaagttccaggactccagccagtggttgcagatcgatctgaaagagattaaagtcatcagcgggattctgacccagggcagatgtgatatcgatgaatggatgaccaaatatagcgtgcagtaccggacagacgaacgtttaaactggatatactataaagaccagacagggaataacagggtcttctatggaaactccgataggacctcaaccgtgcagaatctgcttagacccccaattatatcccgttttatcagactcattccactcggatggcacgtgcgcatagcaataagaatggagttgcttgagtgcgtgagtaaatgcgct

SEQ ID NO: 251010 - DNA, 672 bp, Artificial Sequence
  Description of Artificial Sequence: Synthetic coding sequence
atgtcacgcaagatcgaggggtttctgctgctcctgctgttcggatatgaggctaccctcggtttgagcagcactgaagatgaaggcgaggacccttggtaccagaaggcatgtaagtgtgattgccaaggtggaccgaacgctctctggtccgcgggagcaacttcgctggactgcattcctgagtgcccctatcacaagccacttggattcgaatcgggagaagtgacgccggaccaaattacctgctcgaatccagagcagtacgtaggctggtacagcagttggaccgccaacaaggcccggctgaactcacaaggattcgggtgcgcctggctttcaaagttccaggacagctcgcagtggcttcaaattgacctgaaagaaatcaaagtgatcagcggcatcctgacccagggtcgctgcgatatcgatgaatggatgaccaagtattcagtccaataccgaaccgacgagcggctgaattggatctactataaagaccagacgggcaacaacagggtgttctacggtaactcagaccggacttccactgtccaaaacctgctgcgccctcctattatctcacgcttcatcagactcattccattgggctggcatgtgcgcatcgccatcaggatggagctcctggaatgtgtctcgaagtgcgct

SEQ ID NO: 251011 - DNA, 672 bp, Artificial Sequence
  Description of Artificial Sequence: Synthetic coding sequence
atgtcccggaagattgagggcttcctgctcctcctgctgttcggatacgaagcaacactgggcctgagcagcacagaagacgaaggcgaggacccctggtatcagaaagcctgcaagtgtgattgtcagggaggacccaacgcactgtggagcgccggcgctacctctctcgactgcatcccggagtgtccataccataagccgcttggcttcgagtccggggaggttaccccagaccagattacttgctctaaccccgagcagtatgtggggtggtacagcagttggaccgcaaataaggcacgcctcaattcccagggttttggatgtgcctggctgtccaaattccaggactcctcacagtggcttcagatagatctgaaagagataaaggtgataagcggcatccttacccaaggcaggtgcgatatcgacgagtggatgaccaagtacagtgtgcaatataggaccgatgaacgattgaattggatctattacaaagaccaaacggggaacaaccgggtgttctacggaaactcagatcgcaccagcacagtgcagaatttgctccgccctcctataatttccagatttatccgccttatccctctgggctggcacgtaaggatcgcaattcgcatggagctcctggaatgcgtttcaaagtgcgct

SEQ ID NO: 251012 - DNA, 672 bp, Artificial Sequence
  Description of Artificial Sequence: Synthetic coding sequence
atgagccggaagatcgaaggttttctcctcctgctcctgttcggctacgaagccactctgggactgagcagcacggaggacgaaggtgaggacccctggtaccagaaggcctgcaagtgtgattgtcaaggaggcccgaatgcactctggtcagccggcgccacgtccctggattgtatcccagaatgcccataccacaaacctcttggcttcgaatccggagaagtgaccccggaccagatcacttgttccaatccggagcaatatgtcggctggtactccagctggactgccaacaaagctcggctgaatagccaaggcttcggctgcgcttggctttcaaagtttcaagattcgtcccagtggctgcaaatcgacctcaaggagatcaaggtcatctccggcattctgacccagggaagatgcgatatcgacgagtggatgaccaagtactcggttcagtacaggactgatgagcgcctcaattggatctactacaaggaccaaaccggaaacaatcgggtgttctacggaaattccgacaggacttcaacggtccagaacctcttgcggccacctatcatctcgcgctttatccgcctcatcccactcggatggcacgtgagaattgccattagaatggaattgctcgagtgcgtgtcgaaatgtgcg

SEQ ID NO: 251013 - DNA, 672 bp, Artificial Sequence
  Description of Artificial Sequence: Synthetic coding sequence
atgtcaagaaagattgaaggcttcctccttctcctcctatttggatatgaagcaacattagggctgtcatctactgaggacgagggggaagatccatggtatcaaaaggcttgcaaatgcgattgccagggaggacccaatgctctatggtccgctggtgctacatcactggattgtatacctgaatgtccttatcataaacctctgggttttgagtctggagaagttaccccagaccagattacctgcagcaacccggagcagtatgtcggttggtactcttcttggactgccaataaggcccgacttaattcacaaggattcgggtgcgcatggctttctaaattccaagacagcagccaatggttgcaaatcgatcttaaggaaataaaagttattagtggaatattaactcaaggtagatgtgacattgatgaatggatgaccaaatattccgtccagtacaggaccgatgaacgattgaactggatctactacaaggatcaaaccggtaacaatagagttttttacggtaatagtgatcgcacaagtacggtacaaaatctacttaggcctccgattatttcaaggttcattcgactcatccctcttggatggcatgttaggatcgctatcagaatggagcttttggagtgcgtttctaagtgcgct

SEQ ID NO: 251014 - DNA, 672 bp, Artificial Sequence
  Description of Artificial Sequence: Synthetic coding sequence
atgtcgcgaaaaatagaaggttttctactattattactatttggttatgaagcgacgttaggtctatcgtcgacggaagatgaaggtgaagatccgtggtatcaaaaagcgtgtaaatgtgattgtcaaggtggtccgaatgcgttatggtcggcgggtgcgacgtcgttagattgtataccggaatgtccgtatcataaaccgctaggttttgaatcgggtgaagttacgccggatcaaataacgtgttcgaatccggaacaatatgttggttggtattcgtcgtggacggcgaataaagcgcgtttaaattcgcaaggttttggttgtgcgtggctatcgaaatttcaagattcgtcgcaatggttacaaatagatctaaaagaaataaaagtaatatcgggtatactaacgcaaggtcgatgtgatatagatgaatggatgacgaaatattcggtacaatatcgtacggatgaacgtttaaattggatatattataaagatcaaacgggtaataatcgagtattttatggtaattcggatcgaacgtcgacggtacaaaatctactacgtccgccgataatatcgcgatttatacgattaataccgctaggttggcatgttcgtatagcgatacgaatggaactattagaatgtgtatcgaaatgtgcg

SEQ ID NO: 251015 - DNA, 672 bp, Artificial Sequence
  Description of Artificial Sequence: Synthetic coding sequence
atgtctaggaagatcgagggtttcttgctcctcctcttatttggctatgaggcaactttgggtttgtcatcaactgaggatgaaggggaggatccttggtatcagaaggcctgcaagtgcgactgccagggaggaccaaatgctctgtggtctgccggtgccacttcactggattgcatcccagaatgtccttatcacaaaccattggggtttgagtccggcgaggtcacaccggaccagattacatgctcgaacccagagcagtacgtaggctggtacagcagctggacagcaaacaaagctcgtctcaactctcaaggtttcgggtgcgcttggctgtccaagttccaggacagctctcagtggctacagattgacctcaaagagattaaggtcattagcgggatcttaacccagggacgctgcgatatagatgaatggatgacgaaatatagtgtgcagtaccgcaccgacgagagattgaactggatatactataaggaccagactggtaataaccgggtgttttatggaaactcggatcgtacgtctacagtgcagaacctgctacgcccccctattatatctaggttcatccgactgatcccattgggttggcacgttaggattgcaatccggatggagctgttggagtgcgtcagcaaatgtgct

SEQ ID NO: 251016 - DNA, 672 bp, Artificial Sequence
  Description of Artificial Sequence: Synthetic coding sequence
atgtcacggaaaattgagggattcctgctgcttcttctcttcggatacgaggcgaccctgggattgtcatcgacggaagatgagggagaagatccctggtaccagaaggcgtgtaaatgtgattgtcaaggtggtccgaacgctctttggtcggccggcgcaacctccctggattgcatccctgaatgtccatatcataagccactgggcttcgaaagtggtgaagtcacccctgatcagattacttgttccaatccagagcagtatgtcggttggtacagctcctggaccgcaaacaaggccaggctcaactcccagggatttggatgcgcatggctttccaagttccaggattcgtcgcaatggctgcagattgacctgaaggagattaaggtgatatccgggatactcacccagggtcggtgtgacattgacgagtggatgacgaagtacagcgtgcagtacagaaccgacgaacgcttgaactggatctattacaaagatcaaacgggtaacaatcgcgtcttttacggaaacagcgatagaacctcaaccgtccagaacctgctcagaccgccaattatctcacgttttatcaggttgattcctctgggctggcatgtcaggattgcaataaggatggaacttcttgaatgcgtgtcgaagtgtgca

SEQ ID NO: 251017 - DNA, 672 bp, Artificial Sequence
  Description of Artificial Sequence: Synthetic coding sequence
atgagccgtaagatagagggatttctgctcctgctactgtttggctacgaggctacattgggactctcctcaaccgaggatgagggggaggatccatggtaccagaaagcatgtaagtgcgattgccagggaggtccgaacgccctatggtccgcgggcgcaacatcactcgactgtataccagagtgtccttatcataagccccttgggtttgaaagcggagaggtgacccccgaccagattacctgtagcaaccccgaacagtacgtgggctggtacagctcatggactgctaataaagctcgcctcaattcacaggggttcggttgtgcttggcttagcaagtttcaggattcctcccaatggctgcagatagatcttaaggagataaaggtcattagtggtattctaacccaaggtagatgcgatatcgacgaatggatgacgaaatattcagtccaatatagaaccgacgagcgactgaactggatttattataaggaccagacgggtaacaatagggtattctacggcaactccgacagaactagtaccgtgcagaacctcctcagaccccccattattagtcggttcatccggttgatcccactgggatggcatgtccggatcgccatccgtatggaactgctcgagtgcgtcagcaaatgtgca

SEQ ID NO: 251018 - DNA, 672 bp, Artificial Sequence
  Description of Artificial Sequence: Synthetic coding sequence
atgtcacgcaaaattgagggtttcttgctcctcctgctgttcgggtacgaagcaacccttggactgagctctactgaagatgaaggggaggacccctggtaccagaaggcgtgcaagtgcgactgccagggcggaccaaacgccctttggagcgcaggagctacctccctggactgtatcccagagtgcccgtaccataagccattgggcttcgagtctggcgaggtgaccccggaccaaattacttgttccaatccagaacagtacgttgggtggtattcatcgtggaccgccaataaagcccgcttgaactcgcaaggattcggatgtgcctggctgagcaaatttcaggatagcagccagtggctgcagatcgatctcaaagagattaaggtgatctcagggattcttactcaaggtcgctgcgacattgacgagtggatgaccaagtactccgtgcagtaccggaccgacgaacgcctgaattggatctactacaaggatcagactgggaacaaccgggttttctacggaaactcggatagaacttcaaccgtccaaaacctccttcgccccccaatcatcagccgcttcatccgactgatccctctgggatggcacgtcaggatagctatcaggatggaacttctggaatgtgtgtccaagtgcgca

SEQ ID NO: 251019 - DNA, 672 bp, Artificial Sequence
  Description of Artificial Sequence: Synthetic coding sequence
atgtcgcggaagattgaggggttcttgctccttcttcttttcgggtacgaagcaacccttggtctttcctccactgaggatgaaggagaggatccatggtatcaaaaggcctgtaagtgcgactgccaaggtggtccaaatgcgctttggtcagcaggtgcaactagccttgactgtattcccgaatgtccataccataaacctctgggatttgaaagcggagaagtcaccccagatcagatcacctgtagcaaccctgaacaatacgtgggatggtacagcagctggactgccaacaaggcacgcctgaactcgcaaggttttggctgtgcctggctctcgaagttccaggactcgtctcaatggctgcagatcgacctgaaggaaatcaaggtcatctcgggcattctgacccagggaagatgtgatattgatgaatggatgactaaatactcagtgcaataccgtaccgatgagagattgaattggatatactacaaggaccagactggaaacaatagggtgttctacggcaattccgacagaacttcgactgtgcagaaccttcttcggccacccatcatctcgaggtttattcgactgataccactcggttggcatgtgcgaattgcaattagaatggaactgcttgagtgcgtgtctaagtgtgct

SEQ ID NO: 251020 - DNA, 672 bp, Artificial Sequence
  Description of Artificial Sequence: Synthetic coding sequence
atgagccgcaagattgagggattcctgcttctccttctctttgggtacgaagcaaccctgggactgagctcgacggaggacgaaggcgaagatccttggtaccagaaggcatgtaagtgcgattgtcagggagggcccaacgcactctggtccgcaggggcaactagcctggattgtatcccagaatgcccttaccataagccccttgggtttgaatcaggtgaagtgaccccagatcaaatcacttgttcaaaccctgagcaatacgtcggttggtacagctcctggactgcgaataaggctagactgaactcacagggattcggttgtgcctggctgtccaaattccaggattcgtctcaatggcttcagatagatcttaaggaaatcaaggtgatctccggaattctcactcagggccgttgcgacatcgacgagtggatgactaagtactccgtccagtatcggactgacgaaaggctgaattggatctactataaggatcagaccggcaataacagggtgttctacggtaactccgatcggacctcaacggtgcaaaatctgcttagaccgcccattatctcgaggttcattagactcatcccactgggctggcatgtgcgtattgcaattcgaatggagcttctggaatgtgtgtcgaagtgcgca

SEQ ID NO: 251021 - DNA, 672 bp, Artificial Sequence
  Description of Artificial Sequence: Synthetic coding sequence
atgtcccgaaagatagaaggcttcctcctattgctattatttggctatgaggctacactgggcctctcctccactgaggatgaaggtgaggatccgtggtatcagaaggcatgcaagtgcgattgccaaggaggaccgaatgccctctggagtgccggagctacgtcgttggattgcatacccgagtgcccctaccataagcccctaggtttcgaaagtggcgaggtgacacccgatcagattacatgctccaaccctgaacagtacgtgggctggtattcgagctggaccgccaacaaagcgcgtttaaattcccaagggtttggctgcgcatggctcagcaagtttcaagattccagtcagtggttgcaaattgatctgaaagagataaaggtgatctccggcatcctgacacagggccgttgcgacatagatgaatggatgacgaagtactccgtacagtacaggaccgatgagcgtcttaactggatatactacaaagatcagaccgggaacaaccgcgtgttttacggaaattccgataggacgtcgactgtgcagaacctactccgccctcccattataagccgctttatccggctgattcctttgggctggcacgtgcgaattgctatacgaatggagctgctagaatgtgtcagtaagtgcgct

SEQ ID NO: 251022 - DNA, 672 bp, Artificial Sequence
  Description of Artificial Sequence: Synthetic coding sequence
atgtcaagaaagatcgagggcttcctgttgctgctgctctttggatacgaggccaccctgggactgtcgtcaacggaggatgaaggggaggatccatggtaccagaaggcgtgtaaatgcgactgtcaaggtggacctaacgccctttggtccgcaggggcaacttcacttgattgcatcccagagtgcccctaccataagccgctgggatttgagtctggcgaagtgacgccggaccaaattacctgcagtaacccagagcaatacgtcggctggtactcctcgtggaccgccaacaaagctcgtctcaattcgcagggattcgggtgcgcttggctctcgaagttccaggactcgtcgcagtggctgcaaatagatctgaaggaaatcaaggtgatttctggtatcctgactcagggacggtgcgatatcgacgaatggatgactaaatacagcgtgcagtacaggactgacgaacggcttaattggatttactataaggaccagaccggcaacaaccgcgtgttctacgggaatagcgaccggacttccaccgtccaaaacctcttgcgaccgcccataatctcacgtttcatccggttgattcctctgggctggcacgtgaggatcgcgattcgcatggaacttctggaatgtgtctccaagtgcgcc

SEQ ID NO: 251023 - DNA, 672 bp, Artificial Sequence
  Description of Artificial Sequence: Synthetic coding sequence
atgtccaggaaaattgaaggttttctgcttctgttgctttttggttacgaagctaccctcggcctttcgtcaaccgaggatgagggagaagatccgtggtaccaaaaggcctgcaagtgtgattgtcagggaggcccgaacgctctctggagcgcgggtgcaacttcccttgattgtattccagagtgtccttaccataagccactgggttttgaatcaggggaagtgactcccgatcaaatcacttgttcgaaccctgaacaatatgtgggctggtactcctcgtggaccgcaaataaggcacgcctcaactcgcagggttttggctgtgcgtggctgtccaaatttcaagactcttcccaatggctgcaaattgatctgaaggagattaaggtgatctcaggaattttgactcagggtcggtgtgatattgatgagtggatgaccaaatactcggtgcagtataggacggatgaacgtttgaactggatctactataaggaccaaactgggaataaccgcgtcttttacggaaacagcgatcgtacttcgaccgtgcagaaccttcttcgcccacccattatcagccggtttatccggctgattccactcggttggcatgtccgaatagccattaggatggaactgctggaatgcgtctcgaaatgtgca

SEQ ID NO: 251024 - DNA, 672 bp, Artificial Sequence
  Description of Artificial Sequence: Synthetic coding sequence
atgtccagaaagatcgaggggttccttcttctgctgcttttcggctacgaggccaccctcggtttatccagtacagaagatgaaggggaagacccttggtatcaaaaagcatgtaagtgcgattgccaagggggacctaatgctctgtggtctgctggagcaacgtctctggactgtattccggagtgcccataccacaagcctttgggtttcgaaagcggagaggtcactccagaccagataacttgtagcaatcccgaacaatatgtaggttggtacagctcttggaccgccaataaagcccgcctgaactcccaaggatttgggtgtgcatggctgtccaaattccaggattcttcccagtggttacagatcgatcttaaagaaatcaaagtaatttcaggcatcctcacccaaggccgttgcgatatcgatgagtggatgaccaagtactctgtgcagtaccgcaccgacgaacgcctaaattggatctactataaggaccagaccggcaataatcgcgttttttatgggaattctgacaggacctccacagtccagaaccttcttaggccccctatcatatctcgtttcatacgcttaatacccctcggctggcatgtcaggattgctatccggatggagctgctcgagtgcgtgtcgaagtgtgca

SEQ ID NO: 251025 - DNA, 672 bp, Artificial Sequence
  Description of Artificial Sequence: Synthetic coding sequence
atgtctcgcaagatcgaggggttccttctgctgttgctcttcggctatgaggctacactcggacttagttctacggaagatgagggtgaggatccctggtatcaaaaggcttgtaagtgtgactgccaaggcggtcctaacgctttgtggtcggctggtgctacaagccttgactgtatccctgaatgcccctaccacaagcccttgggttttgaaagcggcgaggtaacgccagatcagatcacgtgctccaaccctgagcaatacgtggggtggtactcatcctggacggcaaataaagctcgactcaattcacagggattcggttgtgcatggttaagtaagtttcaggactcctcccagtggctgcagattgatttgaaggagatcaaagtgatcagcggaatcttaacacaaggacgatgcgatattgacgaatggatgaccaagtatagtgttcagtatcggaccgatgaacggcttaactggatctattataaggatcagaccggcaataacagagtgttctacgggaatagtgataggacaagcaccgtccaaaatctgttgcggcccccgattatcagtaggtttatcaggctgataccactaggatggcacgttcgaattgccatccgaatggagcttttggaatgcgtcagtaaatgcgcc

SEQ ID NO: 251026 - DNA, 672 bp, Artificial Sequence
  Description of Artificial Sequence: Synthetic coding sequence
atgtcgaggaaaatcgagggatttttactgctgttgctctttggctacgaggccacgctcgggctctcctctacagaggatgaaggtgaggatccctggtatcagaaggcgtgtaagtgtgattgtcagggcggcccaaacgctctctggtccgcaggcgccacttctctcgactgcatacctgagtgtccatatcacaaacccctgggctttgagagtggcgaggtgacccctgaccaaatcacctgcagcaaccccgagcagtacgttggctggtactcctcctggaccgctaataaagcccgcctcaactcacaggggttcgggtgtgcttggctctccaagttccaggattcgtcccaatggctgcaaatcgaccttaaggagatcaaggtaatctctgggatacttacccagggccgatgtgatatcgacgagtggatgactaagtactccgtgcaatataggacagacgagcgattgaattggatctattacaaggatcagaccggtaacaaccgagtattctacggaaatagtgatcgcacgtccactgtgcaaaacttgctcaggcctcccattatctcccgctttatacgtttaatacctctagggtggcacgtgcggattgccattcgaatggagctgttggaatgcgtgagtaagtgtgcg

SEQ ID NO: 251027 - DNA, 672 bp, Artificial Sequence
  Description of Artificial Sequence: Synthetic coding sequence
atgtcacgcaagattgaaggatttctactactcttgctcttcggatacgaggcgacgctgggcttgtcatctaccgaagatgagggagaggatccttggtatcagaaggcgtgtaaatgcgattgccagggaggcccaaatgccctgtggtccgcgggagccacctctttagattgcatcccggagtgcccatatcacaagccattggggttcgagagcggggaggtaacccccgatcagatcacatgctccaacccagagcagtacgttgggtggtacagctcttggaccgccaataaagcccgcctgaactcacagggtttcggctgcgcgtggctgagtaaattccaggacagtagccagtggctccaaattgacctgaaggaaattaaggtcatctctggaatcttaacccagggaagatgcgacatcgacgaatggatgactaaatattccgtgcagtacaggaccgatgagaggctgaattggatttactacaaggatcagaccggcaacaacagggtgttctacggtaactctgatagaactagcacagtgcagaacctgttgcggcccccaataatttcgagatttatcaggctcatacccctcgggtggcatgtgcgtatcgcaattagaatggagctcctggagtgtgtttctaagtgcgca

SEQ ID NO: 251028 - DNA, 672 bp, Artificial Sequence
  Description of Artificial Sequence: Synthetic coding sequence
atgtcccggaagatcgaaggatttcttcttctcctgctcttcggctacgaagctactctgggattgtcctccaccgaggatgagggggaagatccctggtaccagaaagcgtgtaagtgtgactgccagggagggccgaacgcactgtggagcgccggagcaacgtcgttggactgtatcccggagtgcccgtaccataaacctctcggctttgagagcggagaggtgactccggatcaaatcacctgttcgaacccggaacaatacgtcggatggtactcaagctggactgcaaataaggcgcgcctgaactcccaaggtttcggctgtgcctggttgtcaaagttccaagattcgtcccagtggctgcagatcgatctcaaggagatcaaagtcatctcaggaatcctcactcagggacggtgcgacatagacgaatggatgactaaatactcagtccagtatagaacggacgagcggctcaactggatctactacaaggaccagaccggaaacaatcgggtcttttacgggaatagcgatcggacttcaactgtccagaacctgctccggcctcctatcatttcccgcttcatccgcctcatcccactcggatggcacgtgcgcattgctatccgcatggaactgctggaatgcgtcagcaagtgtgcg

SEQ ID NO: 251029 - DNA, 672 bp, Artificial Sequence
  Description of Artificial Sequence: Synthetic coding sequence
atgtctcggaagatcgagggattcctgctgctgctgctgttcggttacgaagctacactgggactttcatcaacggaggacgaaggagaagacccctggtatcagaaggcctgtaagtgcgattgtcagggaggtccaaatgccctctggagtgccggggctactagcctggactgtattcctgagtgcccgtatcataagccgctgggcttcgagagcggtgaggtgacaccggaccagataacctgtagcaatcccgaacagtatgtgggatggtatagttcctggaccgcgaataaagcgaggctgaatagccagggcttcggttgcgcatggttgtccaaattccaggactcatcacagtggctgcagatagatctgaaagagatcaaagtaattagcggcatcctcacccaaggtcgttgtgatatcgatgagtggatgacaaagtatagcgtgcaatatcgaaccgacgagaggctcaactggatctactacaaggaccagacgggcaacaaccgggtcttctatgggaacagtgaccggacgtcaacagtccaaaacctgctcagaccgccaataatatctaggtttattaggctgatccccctcggatggcacgtgagaatcgcgatcaggatggaacttctggagtgtgtctctaagtgcgcc

SEQ ID NO: 251030 - DNA, 672 bp, Artificial Sequence
  Description of Artificial Sequence: Synthetic coding sequence
atgtctcgtaagattgagggcttccttcttctgctcctttttggctatgaagctacactcggactgagttccacggaggatgaaggagaggatccctggtatcagaaggcatgtaagtgtgactgccagggcgggcccaatgcactgtggtccgcaggagctacctcactagactgcattccagagtgtccttaccacaaacccttgggttttgagtctggcgaagtaacccccgaccagatcacatgttcgaatccggagcagtatgtcggttggtactcttcctggaccgccaacaaggcacggctgaatagtcagggcttcggttgtgcttggctctccaaatttcaggactcatcacaatggctacaaattgatctcaaggaaatcaaggttataagcggaattctcacccagggtagatgcgacattgacgagtggatgacaaagtattccgtgcaatatcggacagacgagcgcttgaattggatctattacaaggatcagaccgggaataaccgggtcttctatggcaatagcgatcgaaccagcacagtacagaaccttctccggccccctattatcagcagattcattagactgatccccctgggctggcacgtgcgtattgcaatccggatggaactgctagaatgcgtctcgaaatgcgca

SEQ ID NO: 251031 - DNA, 672 bp, Artificial Sequence
  Description of Artificial Sequence: Synthetic coding sequence
atgtcaaggaaaatagaggggtttctcctcctgctcctgttcggatacgaagcaacccttggactttcctccaccgaggacgagggagaggatccatggtaccagaaggcatgtaagtgtgattgccaaggcgggcctaacgcgctttggagcgccggagcgacctcgctcgactgtattcctgaatgtccataccataagccccttggatttgagtcaggggaagtgacccctgatcagattacctgtagcaaccctgaacaatacgtgggttggtacagctcttggactgcaaacaaagcccggctgaactcacaggggtttggatgtgcctggctctcgaaattccaagattcaagccaatggctgcaaattgatcttaaggagattaaggtgatctccggtatccttacccaagggcgttgtgacattgatgaatggatgaccaagtactccgtccaatatcgcacggatgaacggctcaattggatctactacaaggatcaaaccggaaacaacagagtgttctacggcaattcggatcgcacctcgactgtgcaaaatcttcttcggccccccataatctcgaggtttattcgcctgattcctctgggatggcacgtgcggattgcgatcaggatggagctgctcgaatgtgtgagcaagtgtgcc

SEQ ID NO: 251032 - DNA, 672 bp, Artificial Sequence
  Description of Artificial Sequence: Synthetic coding sequence
atgtccaggaagattgaggggttcctcttactgctgttgttcggctacgaggccacactgggactttcctctactgaggatgagggggaagacccctggtatcagaaagcctgtaagtgtgattgtcagggtggccctaacgccttatggtccgccggggccacatccttggactgcatccccgagtgcccctaccacaagccgctgggatttgagagtggagaagtcacgcctgatcagattacatgctctaatccagagcagtacgtaggctggtactctagctggacggcaaacaaggctcggctgaactcccagggtttcggttgcgcttggttgtctaagttccaggattcttcccagtggctgcagattgatttgaaagagatcaaagtaatttccggcatcctcactcaaggccggtgcgacatcgatgaatggatgaccaagtatagtgtacaataccgtaccgacgaaaggctgaattggatttattacaaagaccagactggcaataacagagttttctatggcaacagcgataggacaagtacggttcaaaaccttctgaggccacccattatatcaagattcatcagattgataccgctagggtggcacgtccgtattgcaatcagaatggagctcctcgaatgcgtcagcaagtgtgcg

SEQ ID NO: 251033 - DNA, 672 bp, Artificial Sequence
  Description of Artificial Sequence: Synthetic coding sequence
atgagccgcaaaattgagggcttcttgttgctgctgctatttggctacgaggctactctgggtctgtcgtcgaccgaggatgagggagaggatccctggtatcagaaggcctgcaagtgtgactgccagggtggccctaacgccctatggtcggcgggcgccacctcactggactgcatccccgagtgtccttaccacaagcccctagggttcgagtctggcgaggtaaccccggaccaaatcacctgctctaaccccgagcagtacgtgggttggtacagctcgtggacggccaacaaggcccgtcttaattcccaggggttcggctgcgcgtggctgtccaaattccaagattcctcgcaatggctgcagattgatctgaaggagattaaggtcatttctggcatcttgacccagggccgctgtgatattgatgaatggatgaccaagtactccgtccaataccggactgatgaacgcctgaactggatttactacaaggatcagactggtaataaccgtgtgttttacggcaactcagaccgtacctctaccgtccagaatctcctccgcccccccatcatatcccggttcattcgccttatccctctcggttggcacgtacggatcgctatccggatggagctcctcgaatgcgtaagcaaatgtgca

SEQ ID NO: 251034 - DNA, 672 bp, Artificial Sequence
  Description of Artificial Sequence: Synthetic coding sequence
atgtccagaaagattgaaggcttcctgctccttctgttgttcggttacgaggcgactctcggcctgagctcgaccgaggacgaaggagaggatccgtggtaccaaaaggcatgcaagtgcgattgccagggcggtccgaatgccctctggtcggccggggcgacttcgctcgattgcatccctgaatgcccgtatcacaagcccttgggatttgagagcggcgaggtgacccccgatcaaatcacttgcagcaatccggaacagtacgtgggctggtactcttcatggactgcaaacaaagctcggctgaatagccagggattcgggtgcgcctggctgtccaagttccaggactcgtcacagtggctgcaaatcgacctgaaggagattaaggtgatctccggaatcctgactcagggacgctgcgacattgatgagtggatgactaagtactcagtccagtaccgcacggacgaaagactgaactggatctactacaaggaccagaccgggaacaatagagtcttttacggtaactcagaccgcacgagcaccgtccagaacctgctgcgcccaccaatcatctcccgattcataagactcatcccactcgggtggcacgtgcggatcgcaatccgcatggagctgctggagtgcgtgtcgaagtgcgca

SEQ ID NO: 251035 - DNA, 672 bp, Artificial Sequence
  Description of Artificial Sequence: Synthetic coding sequence
atgagtcggaaaatcgagggctttctgctgcttcttctgttcggctacgaagctacacttggcctgagctctacagaagatgagggcgaggatccatggtaccagaaggcatgcaaatgcgattgccaaggtggaccaaacgcactgtggtcagcgggagcaacttcccttgactgcattcccgaatgtccataccataaaccacttggattcgagtcaggagaagtgactcccgaccagatcacatgtagtaatccagaacaatacgtgggctggtattcttcatggaccgccaataaagcaagactcaatagccaaggatttggatgcgcttggttatctaagttccaagactcatctcaatggctgcagatcgatctcaaagaaatcaaagtgatatcaggcatcctgacccaaggaaggtgcgatatcgacgaatggatgacaaagtacagcgtgcagtaccggaccgatgagagactcaattggatctattacaaggaccagaccgggaataatcgagttttctacggcaacagcgataggacaagcacagtgcagaacctcctccgccctccaatcatttccaggttcataagactcattcccttgggctggcatgtcagaatcgcaatacgaatggagctcctggaatgtgtctccaaatgtgct

SEQ ID NO: 251036 - DNA, 672 bp, Artificial Sequence
  Description of Artificial Sequence: Synthetic coding sequence
atgagccgcaagattgagggattcctcttgttgctgctgtttggttacgaggccactctggggctgtcgtcaactgaagatgagggtgaggacccgtggtaccaaaaggcgtgcaagtgcgattgccagggaggcccaaacgccctctggtccgcgggtgccacctcgctggactgtatacctgaatgtccttatcataaaccactgggcttcgaaagcggagaggtcaccccagaccaaatcacctgttcgaaccctgaacagtatgtcgggtggtacagttcgtggactgcgaacaaggcaaggctgaactcacagggatttggctgcgcttggctgtcgaaattccaagattcatcgcagtggttgcaaatagacttgaaagaaatcaaggtgatctccggaatcctcacgcaggggagatgcgatatcgacgaatggatgactaagtactcagtgcagtaccggactgacgaacgcctgaattggatctactacaaagaccagacgggaaacaatcgagtgttctacggtaattccgaccggactagcaccgttcaaaatcttctgcgcccaccgatcattagcagattcatccgtttgatcccgctgggatggcacgtgagaatcgccattcggatggaacttcttgagtgcgtgtccaagtgcgct

SEQ ID NO: 251037 - DNA, 672 bp, Artificial Sequence
  Description of Artificial Sequence: Synthetic coding sequence
atgtcaagaaaaatcgagggatttctgctcctgttgctgttcggctacgaggctactctcggcctctcttccactgaggatgaaggggaggatccctggtaccagaaggcttgcaaatgtgactgccagggcgggccgaatgcactgtggagcgcaggcgctacatcccttgactgcatcccagagtgcccatatcataagcccttgggttttgaaagcggagaggtcactcccgaccagatcacctgtagtaacccggagcaatacgtcgggtggtactcatcttggacagcaaataaagcaaggcttaacagccaaggcttcggctgcgcatggttgagcaagtttcaggattccagccagtggctgcaaatcgatcttaaagaaataaaagtgatctccgggattctgacgcagggtagatgcgacatagacgaatggatgaccaaatattccgtccaataccggacagatgagcggctgaactggatctattacaaagaccaaacaggaaataatcgagtattctatgggaactctgatcgcacctcaacagtccagaacctgcttcgccctcctatcatctcacgctttatcagattgatcccccttgggtggcacgtgcgcattgcaattagaatggagcttctggaatgtgtctcaaagtgtgca

SEQ ID NO: 251038 - DNA, 672 bp, Artificial Sequence
  Description of Artificial Sequence: Synthetic coding sequence
atgtcccgcaagatcgaagggtttctgctattgctcctcttcggatatgaggcaacgttaggccttagctccacagaagacgaaggggaagatccctggtaccaaaaggcttgtaaatgcgactgtcagggtgggcctaacgccctctggagtgccggggccacgagcctggactgtatacctgagtgcccctatcacaaaccactgggcttcgagagcggggaggtcacccctgatcagatcacctgtagcaatcctgaacagtacgtggggtggtactccagttggactgctaacaaggctaggctcaactcacagggattcgggtgcgcatggctgtctaagtttcaggattcttcgcagtggttgcagattgatcttaaagagattaaagtcataagtggcatattgacccagggtagatgcgacatagatgaatggatgactaagtacagcgtgcaataccggactgacgagcgcctcaactggatttactataaggatcagacaggaaataatcgagtgttctatggcaattctgaccgtacgagtacagtgcaaaatctgctgaggcctccgattatctctcggtttatcagactgattccgctgggctggcacgtccggattgccattcggatggagctactggagtgtgtgtcaaaatgtgct

SEQ ID NO: 251039 - DNA, 672 bp, Artificial Sequence
  Description of Artificial Sequence: Synthetic coding sequence
atgagccgcaagatcgagggttttctcctactcctcctgtttgggtatgaagcaacactgggcctctcaagcacagaagatgagggagaagacccctggtaccagaaagcgtgcaagtgcgactgtcagggcgggccaaacgcgctgtggagcgctggcgctactagcctcgactgtatcccagagtgtccctaccacaaacctctcggctttgagtcgggcgaggtaaccccagaccagattacatgctcgaatcccgagcagtacgtgggctggtactctagctggaccgcaaacaaggccagattgaactcccagggctttggatgcgcgtggctgtcaaagtttcaggattcctcacaatggctgcaaatagacctgaaggagattaaagtcatttccgggatcctgacacaggggcgatgcgatatcgacgaatggatgacgaagtactccgttcaatatagaaccgatgagcgcctgaattggatttactacaaagatcagaccggcaataaccgcgtattctatggtaatagcgaccgtacctccaccgttcagaatctgctccggccacctattatttcccgattcatcaggctgatccctctgggatggcacgttaggatcgctatcaggatggaactgttagagtgcgtgagcaagtgtgcc

SEQ ID NO: 251040 - DNA, 672 bp, Artificial Sequence
  Description of Artificial Sequence: Synthetic coding sequence
atgtcgcggaagattgaagggtttttgctgcttctgctctttggctatgaagcgacactggggttgagctctacagaggatgaaggcgaggatccatggtaccagaaggcctgcaaatgtgattgccaggggggacctaatgcactctggagtgctggagccacaagcctggattgtattcccgagtgtccctatcataagccactgggatttgaatcaggggaggtgactcctgatcaaatcacgtgcagcaatccagaacaatacgttggctggtacagctcttggaccgccaacaaagcaagactgaactcacaaggattcggttgcgcttggctctctaagtttcaggactcaagccagtggctgcaaatcgatctcaaagagatcaaggtgatatcgggtatcctaacccaggggaggtgcgacatcgacgaatggatgaccaagtactcggtgcagtatagaaccgatgagagacttaattggatctactacaaggatcagaccggcaacaatcgggttttctatggtaatagtgaccgcactagcacggtgcagaatttgttgcgtccgcctattatctcccgcttcatccgactcatcccgctgggatggcatgtccggattgcaatcaggatggagctactggagtgtgtgtcaaaatgtgct

SEQ ID NO: 251041 - DNA, 672 bp, Artificial Sequence
  Description of Artificial Sequence: Synthetic coding sequence
atgtcgcggaagattgaaggatttctcttgcttctgctctttggttatgaagccacgctcggcctgtcctccaccgaagacgagggtgaggatccatggtatcagaaggcttgtaaatgcgactgtcagggtggtcccaacgctctatggtccgcaggcgctacgtccctggactgcattcctgagtgcccatatcacaaaccactgggattcgagagcggcgaagttacacccgatcaaatcacatgctctaatccggagcagtacgtagggtggtattcttcctggactgctaacaaagccaggctgaacagccaaggattcggttgtgcatggttaagcaaatttcaggattctagtcagtggctgcagatcgatttgaaggagattaaggtgatttccggcatcctgacgcaggggaggtgcgatatcgatgaatggatgactaaatattctgtccaatatcgcacggatgagagacttaattggatctattacaaagaccagaccgggaataaccgcgtattttatggcaattctgaccgcaccagcacagtgcaaaatcttctccgaccacccattatcagtaggttcatcaggctgatcccccttggatggcacgtgagaatcgccatccgtatggagttgctggagtgtgtgagcaagtgcgcg

SEQ ID NO: 251042 - DNA, 672 bp, Artificial Sequence
  Description of Artificial Sequence: Synthetic coding sequence
atgtcaaggaaaatcgaagggttcctcttattgctcttgttcgggtatgaagctacactcggactgtccagtactgaagacgaaggagaagatccctggtaccagaaagcctgcaaatgcgactgccagggaggacccaacgcactctggtcagccggggccacaagtctcgattgtatacctgaatgcccctatcataaacctttagggttcgaatctggggaagtgactcccgatcagataacttgctcaaatcctgaacagtacgtcggatggtatagttcttggacagcaaataaagcaagactaaattcacaggggttcgggtgcgcatggctgtctaagtttcaggattccagtcagtggctccagatcgatctcaaagaaataaaagtcatatctggaatactcacacagggacggtgtgatatcgatgaatggatgacaaaatattctgtgcagtataggacagatgaaaggctgaactggatatattacaaagatcagactggaaataaccgggtattttatggaaactctgataggacgagtacggtccagaacctcctacgacctcccatcatatcaagatttattagactgatacccctcgggtggcacgtgaggatagctatcaggatggaattattagaatgcgtgtcaaaatgcgct

SEQ ID NO: 251043 - DNA, 672 bp, Artificial Sequence
  Description of Artificial Sequence: Synthetic coding sequence
atgagccgcaagattgaaggatttctgttgcttctcctgttcggatatgaagcgaccttgggcttgagctccactgaagatgagggcgaggacccttggtaccagaaggcctgcaagtgtgactgccagggaggtccgaatgcgttgtggtctgccggcgcaacctccctcgattgcattccggagtgtccatatcataaacccctgggcttcgaaagcggcgaggtgaccccggaccagatcacttgttccaatcctgaacagtacgtgggctggtacagctcgtggactgccaacaaggcgagattgaattcgcagggattcggatgtgcttggctctccaagttccaggacagctcacaatggctccaaatcgacctcaaggaaatcaaggtgatctcagggattctgacccaggggcgctgcgatatcgatgagtggatgaccaaatactccgtgcagtacagaacggacgagagactcaactggatctactacaaagaccaaaccggaaataaccgcgtgttttatggtaacagcgaccggacctccactgtccaaaatctgctgcgcccaccgatcatctcgagattcattagactgatccctttgggctggcacgtgcggatcgccatccgcatggagctgctcgaatgcgtgtcaaaatgcgcg

SEQ ID NO: 251044 - DNA, 672 bp, Artificial Sequence
  Description of Artificial Sequence: Synthetic coding sequence
atgtcccgaaagatagagggatttcttctgctcctgctgttcggctatgaagccacgttgggtctgagtagcaccgaggacgaaggcgaggacccctggtatcagaaggcatgtaagtgcgactgtcaaggcggaccaaacgcactgtggagtgctggggctactagcctagactgcattcccgaatgcccttatcacaagcctctgggtttcgagagtggagaggtgacccctgaccagattacctgttcaaatccggagcagtacgtggggtggtacagcagctggacagcaaacaaggcgcgattaaattcccagggctttggatgcgcctggctgagtaagttccaagactcttcacaatggttgcagattgatctaaaggagattaaggtaatatcaggaatcctgactcagggcagatgtgatatagatgagtggatgaccaagtactctgtccagtatcgcacggacgagagacttaattggatctattataaggatcagactgggaataatcgggtgttttatggaaacagtgatcgcacatctacggtgcaaaacctcctgcgcccgcccatcataagccgctttatccggctgatcccactgggttggcatgtacgcattgccatccggatggagttgctcgaatgtgtgtctaaatgtgca

SEQ ID NO: 251045 - DNA, 672 bp, Artificial Sequence
  Description of Artificial Sequence: Synthetic coding sequence
atgagcaggaaaattgagggctttttgctccttcttctttttggatacgaggctacccttggactgtcgtctactgaggatgaaggagaggacccctggtatcaaaaagcgtgcaagtgcgactgccaaggaggaccgaatgctctatggagcgctggagccacatctctagattgcattccagaatgcccataccacaaaccacttggctttgaatcgggagaggtcacaccagaccagattacttgttctaatccagaacagtatgttggatggtattctagttggaccgctaacaaggcacgtctgaactcgcaaggattcggatgtgcgtggttgtccaagtttcaggattcgagccaatggctacaaatcgacttaaaagaaatcaaagttatcagtggaattcttacgcaagggaggtgcgatattgacgagtggatgactaagtattcggtacagtaccgaacagacgaaagactcaattggatttactacaaggatcaaactggaaacaatcgtgttttctacggaaattcagaccgtacaagtactgttcaaaatcttcttcgtccacctatcatttccagattcatccgactcattccacttggatggcatgttcgaatcgctataaggatggagcttttggaatgtgtttcaaagtgcgct

SEQ ID NO: 251046 - DNA, 672 bp, Artificial Sequence
  Description of Artificial Sequence: Synthetic coding sequence
atgtccaggaagatagaaggcttcctgctgctgcttctgttcggctatgaagccacattgggactctcaagcaccgaggacgaaggtgaggatccctggtaccagaaagcttgtaaatgtgactgccagggcggcccaaacgccctgtggtcagcaggggcaacctcgcttgattgcatccctgaatgcccttaccacaaaccactagggttcgagtctggtgaagtgaccccagaccagattacctgttctaacccagagcagtatgtggggtggtattccagttggactgccaataaagcccggctgaatagccaggggtttggatgcgcttggttaagcaaattccaagactcaagccagtggctgcaaattgacttaaaggaaattaaggtcatatccggaatcttgacgcaaggcaggtgtgatatcgatgaatggatgacaaaatactctgtgcaatacaggacagatgaacgcttaaactggatctactacaaagatcagaccgggaacaatcgcgtgttctacgggaacagcgatcggacatccaccgttcagaacctcttgaggcctcctatcattagcagatttatcagactgatcccccttgggtggcatgttagaatagccatccgaatggagctgctcgagtgtgtttcgaagtgtgct

SEQ ID NO: 251047 - DNA, 672 bp, Artificial Sequence
  Description of Artificial Sequence: Synthetic coding sequence
atgagtaggaagatagaaggttttctcctcctgttgctgtttggttacgaagctaccctgggactgtcaagcactgaagacgagggtgaggatccatggtaccagaaggcttgtaagtgtgactgtcaaggaggacctaacgccctttggagcgcgggagcgacttctttggattgcatacccgagtgcccataccataaacctctcggtttcgagagcggagaagtgactccagatcagatcacttgctcaaatcccgagcagtacgtcggttggtactcctcttggactgctaacaaggccaggctgaattcacagggcttcggttgcgcctggctgtctaagtttcaggattcttcacaatggctgcagatcgacctgaaggagatcaaagtcatatctggcattctgacccagggaaggtgcgatatcgatgagtggatgacaaaatactccgtgcagtataggacagacgagcgcctcaattggatttactacaaggaccagacaggcaataaccgcgtgttttacggcaatagtgacaggacctctaccgtgcaaaatctgctgcgcccccctatcatctccaggttcatcaggctcatcccactgggatggcacgtgcgcatagctatcaggatggaactgttggagtgtgtcagcaagtgtgcc

SEQ ID NO: 251048 - DNA, 672 bp, Artificial Sequence
  Description of Artificial Sequence: Synthetic coding sequence
atgtcgaggaagatcgagggattcctccttctcctgctgttcggatatgaagcgacgctgggcctgtcgtccactgaggacgaaggcgaggacccctggtaccaaaaggcatgcaagtgcgattgtcagggaggaccgaacgctctgtggtcagccggggccacttccctggactgcattccagaatgcccgtaccacaagccgctcggatttgagtcgggcgaggtgaccccggaccagatcacgtgctccaacccggaacagtacgtcggatggtactcctcatggaccgccaataaggcgcggctcaactcgcaaggcttcgggtgcgcctggttgtcaaagtttcaggactctagccagtggctccaaatcgacttgaaggagattaaagtgattagcggaatccttacccagggcagatgcgatatcgacgaatggatgactaaatactcggtccagtatagaaccgatgaacggctgaattggatctactacaaagatcagacgggaaacaatcgcgtgttctatggcaattcggacaggacctccaccgtccaaaacctgctgaggccaccaatcatctcccggtttatccggctgattccgctcggctggcatgtgaggatcgcaatcagaatggagctgctcgaatgcgtgtccaagtgtgct

SEQ ID NO: 251049 - DNA, 672 bp, Artificial Sequence; identical to SEQ ID NO: 250993
  Description of Artificial Sequence: Synthetic coding sequence

SEQ ID NO: 251050 - DNA, 672 bp, Artificial Sequence
  Description of Artificial Sequence: Synthetic coding sequence
atgtccaggaagattgaaggcttcctgctcctcctgctcttcggatatgaggcgacgctgggcctgtcgtcgaccgaggacgaaggcgaggacccttggtaccaaaaggcttgtaaatgcgactgccagggaggtcccaacgcattgtggagcgctggagccacttccctggattgtattccggaatgtccgtatcacaagccactggggtttgaatccggggaagtgactcctgaccagattacttgctccaatccggaacaatatgtgggatggtactcatcatggaccgctaacaaggccagacttaactcgcaaggttttggatgcgcctggctctcgaaattccaggactccagccagtggctccagattgaccttaaggaaatcaaggtgatttccggaatcctgacccagggccgctgcgacatcgatgagtggatgactaaatactctgtccaataccgcaccgacgagagattgaactggatctactacaaagatcaaactggcaataacagggttttctacggtaattcggacagaacctcaactgtccagaaccttctgcgcccgccgatcatcagccggttcatccggctgattccattggggtggcatgttcgaatcgcgatccggatggaactgctggaatgcgtctctaagtgtgcc

SEQ ID NO: 251051 - DNA, 672 bp, Artificial Sequence
  Description of Artificial Sequence: Synthetic coding sequence
atgtctcggaagattgagggattcctgcttcttctcctctttgggtacgaagcaactctcgggctttcatcgacggaagatgaaggcgaggatccttggtaccaaaaagcatgtaagtgcgactgccaaggtggtcctaatgcgctgtggagcgccggtgcgacttcgctggattgtattcccgagtgtccctaccataagcccctgggatttgaatcaggcgaagtgacccctgaccagataacgtgttcaaacccagaacaatacgtcggatggtactcatcatggaccgccaacaaagcaagattgaacagccagggttttggctgcgcctggctgtctaagttccaggattcctcccaatggttgcaaatcgatctgaaagagataaaggtcatttccgggattctcactcaaggacgctgcgacatcgatgaatggatgaccaagtacagcgtgcaataccggacggacgagcggctgaactggatctattacaaggatcagaccggaaacaacagagtgttttacggaaatagcgaccggacgtcaaccgtgcagaatttgctgaggccacctattatcagcagattcatccgccttatcccacttggatggcacgttagaattgcaattagaatggagctcctggaatgtgtgagcaaatgtgca

SEQ ID NO: 251052 - DNA, 672 bp, Artificial Sequence
  Description of Artificial Sequence: Synthetic coding sequence
atgagccgcaagatcgagggctttctgctgttactgctgttcggctacgaggcaaccctcggactgagctccacagaggacgagggcgaagatccatggtaccaaaaggcttgcaagtgcgattgccagggaggcccaaacgccctctggtcagcaggcgcaacctcactcgactgcatccccgaatgtccctatcataaacctctggggtttgaaagcggagaggtcacaccagatcagatcacttgctctaatcccgaacagtatgtcggctggtacagctcttggaccgccaacaaggccagactaaacagtcagggatttgggtgtgcatggctttcaaaattccaggacagcagccaatggctccaaattgatctgaaagagatcaaggtcatcagtggaattctgacacagggaagatgtgatatcgatgagtggatgaccaaatacagcgtgcaatacagaaccgacgagagacttaactggatctattataaggatcaaacaggtaacaacagggttttttatgggaactctgaccgcactagcacagtgcaaaacctgcttcgcccgccaatcattagccgcttcatcaggctgatcccactcggatggcatgtgcgcatcgctatacgcatggaactcctcgaatgtgtgagcaaatgtgcc

SEQ ID NO: 251053 - DNA, 672 bp, Artificial Sequence
  Description of Artificial Sequence: Synthetic coding sequence
atgtctaggaagattgagggctttctgctattactcctctttggatatgaagcaaccctgggcctctcgagtaccgaagacgaaggggaggatccatggtaccagaaggcctgtaagtgcgactgtcagggcggtcctaatgctctctggagcgcgggggccacttcactcgactgcattccggagtgcccctatcacaagcctctggggtttgagtccggggaagtgaccccagatcaaattacctgttctaacccggagcagtatgtcggctggtactccagctggacagctaataaagctaggctgaactcccaggggtttggatgcgcatggctgtccaagttccaggactcttcgcaatggcttcagatagacttaaaagaaattaaggttatctctgggattctcacccagggccggtgtgatatagatgagtggatgacgaagtattctgtgcagtacaggaccgatgaaaggcttaactggatctattataaagatcaaaccggaaacaatagagtcttttacgggaactccgatcggacttccacagtgcagaaccttctgcggcccccgatcatttcgcgttttattcgtctaattccgctcgggtggcacgtcaggattgccatcagaatggaactgctagaatgtgtttcaaaatgcgca

SEQ ID NO: 251054 - DNA, 672 bp, Artificial Sequence
  Description of Artificial Sequence: Synthetic coding sequence
atgagccgtaagattgaagggttcctgctgctgctactgtttggttatgaggcaactctaggattgtcgagcaccgaggacgagggagaggacccctggtaccagaaagcctgcaagtgcgactgccaaggtggtccaaatgcgctgtggagcgctggagctaccagtctcgactgcattccggagtgtccttatcacaagccattaggcttcgagtccggcgaggtcacgccggaccagatcacttgtagcaaccctgaacaatatgtggggtggtactcaagctggaccgccaacaaggctcgcttgaactcacaaggtttcggctgtgcctggttgagcaaattccaggattcaagccagtggttgcaaatcgatctgaaggagattaaggtgattagcggtatcctgacccagggcagatgtgacatagatgagtggatgacaaaatacagcgtccaatacagaaccgatgaacgcctgaattggatctattataaagaccagactggcaataatcgtgttttctacggcaatagcgatcgcacgtccaccgtacagaacctgttgagaccaccaatcatttctcgttttatccggctgatccctttgggctggcacgtgcgcattgcgattcgcatggaactgctagagtgcgtgagcaaatgcgct

SEQ ID NO: 251055 - DNA, 672 bp, Artificial Sequence
  Description of Artificial Sequence: Synthetic coding sequence
atgtcgcggaaaatagaagggttccttctgttgctcctctttggatacgaagcaaccctgggcctgtcctcgaccgaggacgaaggagaagatccttggtaccagaaggcatgtaagtgtgactgccagggaggcccaaacgccttgtggtcggcaggagcaacttccttggactgtatcccagaatgcccttaccataagcctcttggatttgaatccggggaggtgacgcccgatcaaattacttgtagcaatccagagcaatacgtgggttggtactcctcgtggacggccaacaaggcaagactgaactcgcaaggatttggttgtgcatggttgagcaagtttcaagattcgtcccagtggcttcaaatagacctcaaagagatcaaggtcatctcggggattcttactcagggacggtgtgatattgacgaatggatgactaagtacagcgtgcaataccggaccgatgaaagactgaactggatttactataaggatcagactggtaacaaccgagtgttctacgggaatagcgatcgcacttcgaccgtccaaaatcttcttcgccctcccattatcagcaggttcatccggctgataccgctgggttggcatgtgcgtatcgccattcgcatggagcttctcgagtgtgtcagcaaatgtgcc

SEQ ID NO: 251056 - DNA, 672 bp, Artificial Sequence
  Description of Artificial Sequence: Synthetic coding sequence
atgagccggaaaattgagggcttcctcttattactactattcggctacgaagccacccttgggctttccagcaccgaagatgaaggggaggatccatggtatcagaaggcgtgcaaatgcgattgtcagggtggcccaaatgctctgtggagcgcgggagccacttccctagattgtattccggagtgtccgtaccacaaacccctgggcttcgaaagcggtgaggtgaccccagatcagattacttgtagcaaccctgagcaatatgtcggctggtactccagttggacagccaacaaagctaggcttaacagtcaggggttcggctgcgcctggttatctaagttccaggactcttcccagtggctgcagattgacctgaaagaaatcaaggtcatatcgggcatcttgacacagggaagatgtgacatcgatgagtggatgacaaagtattcagtgcagtaccgcacagacgagcgactgaactggatctactacaaggaccagacggggaacaacagagtgttttacgggaactctgatcgaacgtctacagtgcaaaatttgctccgtccccccatcatctcccggttcatccgacttattccattaggctggcatgtgcggatagcgattcgaatggagctgctggagtgcgtgtctaaatgtgca

SEQ ID NO: 251057 - DNA, 672 bp, Artificial Sequence
  Description of Artificial Sequence: Synthetic coding sequence
atgtcgagaaagattgagggctttctgctgcttctccttttcggatacgaggccactcttggccttagctccacggaggatgaaggggaggacccttggtaccaaaaggcgtgtaagtgtgattgtcaggggggacctaacgccctctggtctgcaggtgcgacctcccttgactgtattccagagtgtccataccacaagcctctgggatttgagagcggtgaagtgactccagatcaaattacttgttccaaccctgaacagtatgtgggttggtactcatcctggaccgcaaataaggcgaggctcaacagccagggatttgggtgtgcatggctgagcaagttccaagactcctcacagtggctccagattgatctgaaggagatcaaagtcatctcaggtattctgactcagggaaggtgcgatattgacgaatggatgactaagtactcggtgcaataccggactgacgaacgcctgaactggatttactacaaggaccagacgggaaacaatcgtgtattctacggaaactccgatcggacctccactgtgcagaatcttcttcgtccccccattatctcacggttcatcagactgattccactgggttggcatgtgcgcattgccatcaggatggagctgctcgaatgtgtctccaaatgcgca

SEQ ID NO: 251058 - DNA, 672 bp, Artificial Sequence
  Description of Artificial Sequence: Synthetic coding sequence
atgagccgaaagattgagggtttcctgcttctcctcctttttggttatgaagcaaccctgggactgtcaagcactgaggatgaaggagaagatccttggtaccaaaaggcatgtaaatgtgattgtcaagggggcccgaatgcactttggtccgcaggagctacctcacttgactgcattcctgagtgtccttaccacaagcctcttggattcgaatctggagaggtgacccctgatcagattacttgtagcaatcctgaacagtacgtggggtggtactcctcgtggaccgccaacaaagcacggctgaatagccaaggatttggttgtgcttggctgtcgaaatttcaggactcctcgcaatggcttcaaatagacctgaaggaaatcaaggtcatctcgggaatcctcacccagggacgttgtgatattgatgagtggatgactaagtactcagtgcagtacagaactgatgagcggcttaactggatatactacaaagaccaaactggcaacaatcgggtgttctacggtaattccgaccggacctcaactgtccaaaacctgcttcgcccaccgattatctcaaggtttattcggctcattccactgggatggcacgtcagaattgccattcgcatggaacttctggaatgcgtgtcgaagtgtgct

SEQ ID NO: 251059 - DNA, 672 bp, Artificial Sequence
  Description of Artificial Sequence: Synthetic coding sequence
atgagccgtaagatcgaaggctttctcctgttgcttcttttcggatacgaggctacgctggggctttcatccacggaagatgagggtgaggacccatggtaccaaaaagcatgtaagtgtgactgtcagggaggacccaatgcactttggtccgccggagcgacctcgcttgactgcattccagaatgcccttaccacaaaccactgggatttgaatctggtgaagtgacccccgatcaaataacttgctccaaccccgaacaatacgttgggtggtatagcagctggactgctaataaggctcggctgaactcgcaaggtttcggatgcgcttggctctcaaagtttcaagatagctcccaatggctgcagatcgaccttaaagaaatcaaggtcatttcgggtatcctcacccagggcagatgtgacattgacgaatggatgaccaagtactccgttcagtatcgcactgatgaacggctgaattggatttactacaaggaccagaccggtaacaacagagtgttttacggaaacagcgatcgtactagcaccgtgcaaaaccttcttcgccctcctatcatttcacgcttcattagacttataccactcggttggcacgtcagaatcgcaattcgcatggaacttctcgaatgcgtgtccaagtgtgca

SEQ ID NO: 251060 - DNA, 672 bp, Artificial Sequence
  Description of Artificial Sequence: Synthetic coding sequence
atgtcccgtaagatcgaagggttcctgctgttgttgctgttcgggtacgaggcgacacttgggctctcatccaccgaagatgaaggcgaagacccctggtaccagaaggcctgcaaatgtgactgtcagggcggccccaatgccctctggagcgccggcgccacctccctggactgcatccccgagtgcccctaccacaagccgctgggctttgagagtggcgaggtaacgccggaccagattacctgctcaaatccggaacagtacgtcggatggtactcctcctggactgccaataaagcacgtctcaatagtcaaggattcgggtgtgcatggttaagcaagttccaagactctagtcagtggctgcaaatagatctcaaggaaataaaagtgatttcgggaatcctaacccaggggcgatgcgacattgacgaatggatgaccaaatatagcgtgcagtaccgcacggatgaacggctgaactggatttactacaaagatcagaccggcaacaatcgcgtgttttatggaaatagtgacagaacaagtaccgttcagaatttgttgcggccaccaataatttcacgctttataagattgatccccctcgggtggcatgtgcggatcgcgatccgcatggagcttctagaatgtgtgagtaagtgtgca

SEQ ID NO: 251061 - DNA, 672 bp, Artificial Sequence
  Description of Artificial Sequence: Synthetic coding sequence
atgtccaggaaaatcgaggggtttcttctcttactcttgtttggatacgaggcaactctgggactctcgagcaccgaggatgagggcgaggatccgtggtaccagaaagcttgtaagtgtgattgtcagggaggacccaacgccctctggagcgcgggtgccacctctctagattgtatcccagaatgtccctatcacaagcctttggggtttgaatctggggaggtgacgccagaccagatcacctgcagtaatccagagcagtacgtgggctggtactcatcgtggactgcgaataaagcccgcctgaatagccagggctttggctgcgcctggctgtccaagtttcaggactctagccagtggctccaaatcgatcttaaggaaatcaaggtgatcagtggcattctgacacaaggacggtgcgatatagacgagtggatgaccaaatatagcgtgcagtacaggaccgatgagcgccttaactggatttactacaaggatcaaacggggaataaccgtgtcttctatggcaacagtgacagaacttccaccgtgcagaacctgttgagacctcctatcattagccggttcattaggcttataccccttgggtggcacgttaggatagccattcgcatggaactactggaatgcgtcagcaagtgcgct

SEQ ID NO: 251062 - DNA, 672 bp, Artificial Sequence
  Description of Artificial Sequence: Synthetic coding sequence
atgtccaggaaaattgaggggtttctgctgctccttttattcggttatgaggcaaccctcggactttcatcgacagaggacgaaggcgaggatccctggtaccagaaagcttgtaaatgtgactgccaggggggcccaaatgccctatggtctgcgggagctaccagtctcgactgcatcccggaatgcccttatcacaagcccctaggctttgaaagcggagaggttacaccggatcagatcacatgctctaacccggagcaatacgtcgggtggtactcctcatggaccgcaaataaggcccggctgaacagtcagggatttgggtgtgcatggctcagcaagttccaagacagctcccaatggctgcagattgatttgaaggagataaaggttatttcaggcattctgacccagggccgatgtgatatagacgaatggatgaccaaatatagtgtgcagtatcgcactgacgaaaggttaaactggatttactataaagatcaaacaggcaacaaccgcgttttctacggcaatagcgacaggacctcaactgtacagaacctgctccgcccaccgatcattagccgctttattagattaatcccattgggctggcacgtgcggatcgcaattcggatggagctactcgagtgcgtttccaagtgcgct

SEQ ID NO: 251063 - DNA, 672 bp, Artificial Sequence
  Description of Artificial Sequence: Synthetic coding sequence
atgagccggaagatcgagggctttctcctgctgctcctatttgggtatgaagctactctgggattaagtagcacagaagatgagggcgaggatccatggtatcagaaagcctgcaagtgcgattgtcagggggggcccaatgcattatggtcagcaggggctaccagtcttgactgtatacctgagtgtccttaccacaagcctcttggatttgagtctggcgaagtcacccctgaccaaattacatgtagcaatccggagcagtatgtggggtggtattcctcctggaccgcaaataaggccaggctaaattcacaaggctttggctgcgcctggttaagcaagttccaggacagctcacaatggctgcaaattgacctcaaagaaatcaaggtgatttctggcatcctgacgcaggggaggtgtgatatcgacgaatggatgaccaagtacagtgtgcagtatcgcaccgacgaaagactgaactggatttactacaaagaccaaactgggaataaccgcgttttttatggaaactcagacaggacatccacagttcagaacctgctcaggccccctattatcagtcgcttcattcgattaattcctcttggatggcacgtgcgaatcgcaatcaggatggaactgcttgagtgtgtgtcgaagtgtgca

SEQ ID NO: 251064 - DNA, 672 bp, Artificial Sequence
  Description of Artificial Sequence: Synthetic coding sequence
atgtccagaaagatcgaaggatttctgctcctcctgctcttcggatacgaggcgaccctcggtctttcgagtaccgaagatgagggagaagatccatggtaccaaaaggcgtgcaaatgtgactgccaaggcggtccaaatgccctgtggtcggcgggggccacttccctcgactgcattccggagtgcccttaccacaaaccgctgggattcgaatcaggagaggtgactcctgaccagatcacctgctccaacccggaacaatatgtgggatggtactcctcatggactgccaacaaggctcggctgaattcacagggatttggatgcgcctggctgtccaagttccaggattcatcccagtggctgcagatcgacttgaaggagatcaaagtgatctccggcatcctgacccagggaaggtgcgatatcgatgaatggatgaccaagtactcggtgcagtaccggactgacgaacgccttaactggatctactacaaggatcagacggggaataaccgcgtgttctacggaaattcagaccggactagcaccgtgcaaaatctgctccgtcccccaattatctcacgcttcattcgccttatcccgttgggttggcacgtgagaatcgcaatccgcatggaactcctcgagtgtgtgtcaaagtgcgct

SEQ ID NO: 251065 - DNA, 672 bp, Artificial Sequence
  Description of Artificial Sequence: Synthetic coding sequence
atgtcgagaaaaattgagggattcctgctgctgttgttgttcggctacgaagcaaccctgggcctctcatcgactgaggacgagggagaggatccttggtaccagaaggcttgcaagtgcgactgccagggagggccaaacgccctttggtcggctggcgccacgtcacttgactgcatcccggaatgcccgtaccacaagccgctgggatttgaaagcggtgaagtgactccggatcaaatcacctgttcgaatccagagcagtacgttggttggtatagcagctggaccgccaataaggcgcggcttaattcccagggcttcggctgtgcctggctctctaagttccaggactcctcccaatggctgcagatcgacctgaaggaaatcaaagtcatatcaggaatcctgactcagggacgctgcgacatcgacgagtggatgactaaatactcggtgcaataccggaccgatgaacgtctgaactggatttactacaaggatcagactggaaacaaccgggtcttttacgggaacagcgatagaacctccaccgtgcaaaacctgctgcgcccccctatcatctcacgcttcatccgcctcatcccactcggatggcatgtgcgaatcgcaattaggatggaactcctcgaatgcgtgtccaagtgtgcg

SEQ ID NO: 251066 - DNA, 672 bp, Artificial Sequence
  Description of Artificial Sequence: Synthetic coding sequence
atgtctcggaagatcgaggggtttcttctcctcttacttttcgggtacgaagctacgctgggccttagcagtacagaggacgaaggggaagacccctggtaccaaaaagcctgcaaatgtgactgccaaggcggtcccaatgctctttggagcgcgggggctacatcactggactgcattcctgaatgcccttatcataagccccttggtttcgaaagtggcgaagtcaccccagatcaaattacatgctcaaatcccgagcagtacgtgggttggtatagtagctggacagccaacaaagcccggctgaatagccaggggttcggttgtgcatggctatccaagtttcaggactccagtcagtggttgcagatcgatttaaaggagattaaggtcatttcgggtatcctaactcagggtaggtgtgacatagacgagtggatgacgaaatatagtgtgcagtatagaactgacgaacgtctcaactggatatattacaaggaccaaaccgggaataaccgagtgttttatggcaactccgaccgtacatctacggtccagaatctcctgcggccaccaatcatctctcgatttattcggttgatccctctgggttggcacgttcgcattgcaatccggatggaactgctggagtgtgtgagtaagtgcgcg

SEQ ID NO: 251067 - DNA, 672 bp, Artificial Sequence
  Description of Artificial Sequence: Synthetic coding sequence
atgtcgcgcaagatcgagggtttcctcctgctcctgctgttcggatacgaggccacgctgggtctgtcctcgaccgaagatgaaggcgaagatccatggtaccaaaaggcctgcaagtgcgattgccagggaggcccaaatgccctgtggagcgccggagccacctcactggattgcatcccggaatgtccttaccacaagccccttggatttgagtccggtgaagtgactccggatcaaatcacgtgctcgaacccagaacagtatgtcggctggtactcgtcatggactgccaacaaggcccgcctgaattcgcagggcttcggctgtgcttggctgagcaaattccaggactcatcgcaatggctccagatcgaccttaaggagattaaagtcatttccggaatcctgacccagggaagatgcgacatcgatgagtggatgactaagtactctgtgcaatatcggaccgacgagcgcctgaactggatctactataaggatcaaaccggcaacaatagagtgttttacggaaactcagaccgcacttctaccgtccagaacctgctgcggccgccgatcatcagcaggtttattcgtctgatcccacttggatggcacgtccgcatcgcgattcggatggaattgctcgaatgcgtctcaaaatgcgcc

SEQ ID NO: 251068 - DNA, 672 bp, Artificial Sequence
  Description of Artificial Sequence: Synthetic coding sequence
atgtcgagaaagatcgagggattcctcctgcttcttctgtttggttacgaagccactcttggactcagctctactgaggatgaaggtgaagatccatggtaccaaaaggcatgtaagtgtgattgtcaaggaggcccaaacgcactttggtcagcaggtgcgacttcattggattgtattccagaatgcccttaccacaagccgctcggattcgagtccggagaggtgaccccagaccaaattacctgctccaatcctgaacagtacgtggggtggtactcgtcttggactgctaacaaggccagacttaactcacaaggttttgggtgcgcctggctgtcgaaatttcaggatagctcgcagtggctgcagattgatcttaaggagattaaggttatttcgggtatcctgactcaaggcagatgtgacattgatgaatggatgaccaagtactcggtgcagtaccgcacggatgaacggctcaactggatttactacaaggatcaaaccggcaacaaccgagtgttctatggaaactccgacagaacctcgacggtgcagaatctgcttaggcctcctataatctcgcggttcatccgactcattcccctcggatggcatgtccgcattgcgattagaatggaacttctggaatgtgtgtcgaagtgcgca

SEQ ID NO: 251069 - DNA, 672 bp, Artificial Sequence
  Description of Artificial Sequence: Synthetic coding sequence
atgtctaggaagatagagggtttccttctgctgctgttgtttggctacgaagccacactgggactcagcagcacagaggatgaaggagaagacccgtggtaccagaaagcgtgcaagtgtgactgccagggcgggccaaacgctctgtggtcagcgggagccacatcactggattgtattcccgaatgtccctaccacaagcctctaggcttcgagagtggagaggttaccccagaccagattacttgttctaatccagagcagtacgtcggttggtactcgtcctggacagctaataaggctcgcctcaattcccagggctttgggtgcgcgtggttgtctaagtttcaggactcatcccagtggctgcagatcgacctcaaggagataaaggttattagtggcattctgacccagggacggtgtgatattgacgagtggatgacgaaatactccgtgcagtatcggacagacgaaaggttgaactggatctactacaaagatcagacaggcaataatcgggttttctacggcaactccgacagaacatctacggtgcagaacctgttgcgcccacctattattagccgcttcatcaggctgattcccctgggctggcatgtgcgcatcgccatcagaatggagctcttggagtgtgtgtcaaagtgtgca

SEQ ID NO: 251070 - DNA, 672 bp, Artificial Sequence
  Description of Artificial Sequence: Synthetic coding sequence
atgtcccgcaaaatcgaaggctttttgctgctgctgctcttcggatacgaggcaaccctgggccttagctcaactgaagatgaaggtgaagatccttggtatcagaaagcctgcaagtgcgattgccaaggcgggccgaacgcactctggtcggccggagccacctccctggactgcatccccgagtgcccttaccacaagccgctgggattcgaatcgggcgaagtgaccccggaccagatcacctgttcgaatccggagcaatacgtgggatggtactcgagctggaccgctaacaaagcccgtcttaattcccagggttttggctgcgcatggctgtcaaagttccaggattcatcccaatggctccagatcgacctgaaggaaatcaaggtgatctcaggaatcctgacccagggcaggtgtgacatcgacgaatggatgactaagtactctgtgcagtacagaactgacgagcgcttgaactggatatactacaaagaccagactggcaacaatagagtgttctacggaaactccgacaggacctcaaccgtgcagaatttgctgcgcccgccaatcatctccagattcattcggctcatccctctggggtggcatgtgagaatcgcaatcagaatggagttgctcgagtgcgtttcgaagtgcgca

SEQ ID NO: 251071 - DNA, 3297 bp, Artificial Sequence
  Description of Artificial Sequence: Synthetic coding sequence
atgtcactgaacaactcctctaacgttttcctcgatagcgtaccgtccaacacaaacaggttccaggttagtgtcatcaacgagaatcatgagtctagcgccgcagctgatgacaacacagaccctccacattatgaggagactagtttcggtgatgaggcacagaaacgactgagaatctctttcagacctggtaaccaggaatgttacgacaattttctgcaatcaggagaaacagccaaaaccgacgcttctttccacgcctacgacagtcacaccaacacatattatctgcagaccttcgggcacaatacaatggacgccgtgcccaagatcgaatattacagaaacaccggttccattagcggacccaaagtgaaccgtcccagcctgctggagatccatgaacaactggcaaagaacgtggccgtgacccccagcagcgcggaccgtgtggcgaacggtgatggcatacccggagatgagcaggctgagaacaaggaggacgatcaggccggcgtggtcaaattcggctgggtgaaaggagtcctggtccgctgtatgctgaatatttggggagtgatgcttttcatccgcctgtcctggattgtgggagaggcgggcatcgggctcggtgtgatcattatcggcctgagcgtagtggtcaccaccctcactggcattagcatgtctgctatttgcaccaacggcgtggtgcggggcgggggagcctactaccttatcagtaggtccctcggccctgaatttggcggatccatcggcctcattttcgcgttcgccaacgctgtggcagtggctatgtacgttgtcggatttgcagagacagtggtcgatctcttaaaggagtcagatagcatgatggtcgatcccactaacgatatcagaattataggcagtattacagtcgttattctgttaggaattagcgtggcgggcatggagtgggaggcgaaagctcaggtgattttgctggttatcctattaatagccattgccaacttcttcatcggaactgtgatcccctcaaacaacgaaaaaaagtctagagggtttttcaattaccaggcatccatttttgccgaaaatttcggtccaagatttacaaagggagagggcttcttttcagtgtttgctatcttctttcctgctgcaacgggcatcttagctggcgctaacatttccggcgatctggaggacccacaggatgcaataccgcggggcactatgctggccatcttcatcactacagtggcttacctgggcgtcgcaatttgcgttggcgcctgtgtggttcgggatgcaactggcaacatgaacgacacaataatcagtggaatgaactgcaacggcagtgcggcctgtggccttggatacgacttctctagatgccggcatgaaccttgtcagtacggcctgatgaacaactttcaagttatgagtatggtttcaggattcgggcctctgatcactgctggtatcttctcagccacactctcaagcgctctggcttccctggtgtctgcacctaaggtgttccaggccctttgtaaggacaacatctataaggctctgcaatttttcgccaaaggttacggcaaaaataatgaaccgctgcgcggctacatactaacctttctcatcgctatggctttcatcctgatcgccgagctcaatacaatcgctcctatcatctctaactttttcctcgctagctacgctcttattaacttcagctgcttccatgcgtcttatgctaagtcacctgggtggcgccctgcatacggcatctacaacatgtgggtctctctcttcggggctgtactttgctgcgctgtcatgttcgttattaactggtgggcagcagtcatcacatacgtgatagagttcttcctctacgtttatgtgacctgcaagaagcccgacgttaactggggatctagtacacaggccctcagctacgtgtccgctctggataacgcgctggaactaaccaccgtcgaggaccatgttaagaattttcgaccacagtgcattgtattgaccggcggcccaatgactaggcccgcgttgctcgacataacccacgcattcaccaaaaacagcgggctttgcatctgttgcgaggtgttcgtgggacctaggaaactttgcgtgaaggaaatgaattccggaatggccaaaaagcaagcctggctgattaagaataagatcaaggcattctacgcggccgtggccgcggactgttttagagatggcgtgcggtcactgcttcaggcttctggcctgggcaggatgaaaccaaatacactcgtcataggctataaaaaaaactggcgtaaggcaccactcaccgagatcgagaactatgtgggcatcatccacgacgcgttcgattttgaaataggcgtggtgatcgttcgcatcagccaaggattcgacatttcacaggtgttgcaagttcaggaggaactggagcggctcgagcaagaaaggcttgcccttgaagctactatcaaagacaacgaatgtgaagaagagagtggtggcattcgtggacttttcaaaaaggcaggcaaactgaacataaccaaaactactcctaaaaaagacggctccatcaatacatctcagtctatgcatgtgggagagtttaatcagaaactcgtcgaggcaagtacacagttcaaaaagaagcaggagaaaggaaccatcgacgtttggtggctctttgacgatggcggactgacccttcttatcccctacattctgactctgcgaaagaagtggaaagactgcaaacttcgtatctatgtgggcggtaagataaacaggattgaggaagagaagatcgtcatggcgagcctgttaagcaagtttcgcatcaaattcgccgatatccatatcataggtgacattaatattcgccccaataaagaatcctggaaggtcttcgaggaaatgatcgaaccttaccgtctgcatgagagctgtaaggatctgactacagcggaaaaactgaagcgcgagaccccctggaagataaccgatgcagagttggaagccgtgaaggaaaagagttacagacaggtgcgcctcaatgagctgctccaagagcatagtagggccgcaaacctaatcgtgctctcactccctgtcgctcgtaaaggcagtatcagcgatctgctttatatggcatggctggaaatcctgactaaaaacctgccaccagtgcttttggtgaggggcaatcacaaaaatgtgctcacattttacagc

SEQ ID NO: 251072 - DNA, 3297 bp, Artificial Sequence
  Description of Artificial Sequence: Synthetic coding sequence
atgtctctgaacaacagtagcaacgtgtttctggatagtgtcccttccaatacaaacagatttcaagtcagcgtcattaatgagaaccacgagagtagcgctgcagctgacgataacaccgatccaccgcactacgaagaaaccagttttggggatgaagcacagaagaggctgagaatcagctttaggccaggaaaccaagaatgctatgataactttctccaaagtggagagacggccaagactgatgctagctttcacgcctacgattcacacacaaacacttactatcttcagacctttggccataacaccatggatgctgttcccaagattgagtattacaggaatactggtagcatcagcggtccgaaggttaataggccgtctctgctggagattcacgagcaactcgccaaaaacgtcgctgtgacaccttcatcagcggaccgggtagctaacggcgacggaatcccaggcgacgagcaagcggaaaacaaagaagatgaccaggctggcgtcgtgaagttcgggtgggtgaagggagtgcttgtgaggtgcatgcttaacatctggggcgtcatgctgttcatcagactgagctggattgtgggtgaagcggggatcgggctgggggtaatcatcatcggactgagtgtggtcgttacaaccctgaccggcataagtatgagcgccatatgcacaaacggcgttgtccgaggaggaggagcctactaccttataagtcggagcctcggacccgagttcggaggatccatcggcctcatttttgcttttgcgaacgctgtcgccgttgcaatgtacgtcgtgggattcgctgaaactgtggttgaccttctgaaggaaagcgactcaatgatggtggaccctactaacgacataagaataatcggcagcatcacagttgtgatcctcctgggaatctcggtggccgggatggaatgggaggccaaggcccaggtcatcctgttggtaatcttattaatcgcgatcgctaacttctttatagggaccgtaattccaagcaacaacgagaagaagagccgcggtttttttaattaccaggctagcatctttgcagagaacttcggacccagatttaccaaaggcgagggtttcttctcagtctttgcaattttttttccggctgcaactggcattctcgcgggtgctaacatcagcggggacctggaagatcctcaagacgccatcccaaggggcaccatgctggcaatctttatcacaaccgtcgcctacctcggagtggctatctgcgtgggtgcttgcgtggtgcgagatgccactggaaacatgaacgataccattataagtggcatgaactgcaacgggtctgccgcttgtggactgggatacgattttagtagatgcaggcacgagccttgtcagtacggacttatgaacaactttcaggttatgtctatggtttccggcttcggtcctctcataaccgccggtatattctctgctacattgagcagtgcacttgcatccctggtgagcgctcctaaagtgtttcaggccttgtgcaaagacaacatctacaaggctctgcagttctttgcgaagggctacggcaaaaacaacgagccactgaggggatacatcctgacctttctgatcgccatggctttcattctgatcgcggagttgaatacaatcgctccaatcattagtaatttctttctggccagctacgcattaatcaacttcagctgcttccatgcgtcttacgcaaaatcccctggatggagacctgcctatggaatctacaacatgtgggtttcactgttcggcgcagtattgtgctgtgccgtaatgtttgtcattaattggtgggcggcagttataacatacgtgatcgagtttttcctgtacgtatatgtcacttgtaagaagccagatgtgaactggggcagtagcacgcaggcgctgagctatgtgtcagcccttgacaacgcattggaattgaccacagtggaggaccacgtgaagaattttcgcccccagtgcattgtcctcaccggcggccctatgaccagacctgctctgctcgatatcacacacgccttcaccaaaaattccgggctgtgcatctgttgtgaagtcttcgttggccctagaaaactgtgcgtaaaggaaatgaacagcggcatggcgaagaaacaggcttggctcattaagaacaaaatcaaggctttctacgccgccgtggctgcagattgctttcgcgatggtgtcagaagcctgctccaggcttctggtctgggaagaatgaagcctaacacactggtgattggttacaagaagaactggaggaaagcacctctgacagaaatcgaaaattacgtcggcattatccacgacgcgttcgacttcgaaatcggcgtcgtcatcgtgagaatttctcaggggtttgacatttcccaggtgttgcaagtccaagaggagcttgagagattggagcaggaacgcttggctctggaagccaccattaaggataacgaatgcgaggaggagagcggtggtatccgaggcctatttaagaaagctggaaagctcaacataaccaaaaccacaccgaagaaagacggatcaattaacaccagccaatctatgcacgttggggagtttaaccaaaaactggtggaggcttccactcaatttaagaagaagcaggaaaaaggcacaattgacgtatggtggctgtttgacgatggcggcctgaccctcttaataccctacatcctgaccctgagaaaaaagtggaaggactgcaagctccgcatttacgtgggcggcaagatcaacaggattgaagaagaaaagatagtcatggcttcattgctgagcaaattcagaattaagttcgctgacatacacatcatcggagatatcaacatcagacctaacaaggaaagttggaaggtgttcgaagaaatgattgagccttacagactgcacgagtcctgtaaggatctcactactgccgagaagctcaagagggagaccccctggaaaatcacagatgccgaactggaggctgtaaaggaaaagagctacagacaggtgaggcttaacgaactgctccaggagcactcacgcgctgctaacctgattgtgttgagcctcccagtagcacgtaagggctctatctccgatctcctctatatggcctggttggaaatactgactaaaaatctgccccctgtcctcctcgtccgcggaaaccacaaaaacgttttgaccttttacagc

SEQ ID NO: 251073 - DNA, 3297 bp, Artificial Sequence
  Description of Artificial Sequence: Synthetic coding sequence
atgtcacttaacaactcctcaaatgtgttcctggatagcgtcccatccaacaccaatcgttttcaggtttcggtgattaacgaaaaccacgaatcgtcggcggcagccgatgataataccgaccctccacactacgaagaaacttccttcggcgacgaagcacagaaacggctgaggatctcatttaggcccggtaaccaagaatgttacgataacttccttcaaagcggcgaaaccgcgaaaactgatgcatcgtttcatgcatacgactcccatactaacacttactacctgcaaacttttggccataacactatggatgcagtccctaagattgagtactatcgtaacaccggttcgatctcgggtcccaaggttaacaggccttcgctgctggagatccatgaacagctcgcaaagaacgtcgctgtcacgccctcctcggcagatcgcgtcgcaaatggggatgggattccgggtgatgaacaggcagaaaacaaggaggatgaccaagcaggtgtcgtgaagtttggttgggtgaagggcgtcctggtgaggtgcatgctcaacatatggggtgtcatgctctttatcagattgagctggattgtgggcgaagccgggattggtttgggcgtgatcatcattggcctttcggtggtggtgactactctgactggaatcagcatgtcggccatctgcacgaacggggtcgtgcgcggaggaggtgcttactaccttatctcgcggagcctcgggcctgaattcgggggttctattggtctgatcttcgcatttgcaaacgcagtggcagtcgcaatgtacgtggtgggatttgcagaaaccgtcgtggaccttcttaaggagtctgattccatgatggtcgatccgacgaacgacatccggattatcggatccattactgtggtgattcttctcggtatctccgtcgcaggtatggagtgggaagcgaaggcgcaagtcattcttctggtcattctgctgatcgcaatcgccaatttctttataggaaccgtgatcccttcgaacaatgagaaaaagtctaggggcttctttaactaccaggcgtcaattttcgccgaaaacttcggtcccagattcaccaaaggagaaggtttcttctcagttttcgctatctttttccctgcggctactggaatacttgccggcgccaacatttcgggagatctggaggatccacaggatgcgataccacgcggtactatgctggcaattttcatcactaccgtggcgtacctcggtgtggcaatttgtgtcggagcatgtgtggtgcgggatgcaactggtaacatgaatgataccatcataagcggaatgaactgtaatggtagcgctgcatgtggccttggatacgacttttcgcgatgcagacacgaaccttgtcagtacggtcttatgaacaattttcaagtcatgtcgatggtgtccggatttggtccgctgattaccgccgggattttctccgccaccctgtcatccgcgctcgcatcgctggtgtcagctcccaaggtgtttcaggcattgtgcaaggataacatttacaaggccctgcagttctttgcgaaaggatacgggaagaacaatgagccactccggggttacatacttacgtttttgatcgctatggcattcatcctgatcgcagaattgaacaccatcgcaccgattatctcgaacttttttctggcatcctatgcattgatcaatttctcctgttttcatgcaagctacgcaaagtcgccaggatggcggcctgcatatgggatttacaacatgtgggtgtcgctctttggggcagtgctctgttgcgcagtgatgtttgttatcaattggtgggcagcagtgattacctacgtgatagaattctttctttacgtctacgtcacctgtaaaaagcctgacgtgaattggggtagctccactcaggcgctttcgtacgtgtcggccctggacaacgcgctcgaactcaccactgtagaggaccatgtcaagaactttcggcctcaatgtatagtgctcactggaggacctatgaccaggccggcactgctggatattacccacgcctttacgaagaactccggtctgtgcatttgctgtgaggtgtttgtgggacctcgaaagctctgcgtgaaagaaatgaactcagggatggcaaagaagcaggcatggcttatcaagaataagattaaggcattttacgctgccgtcgcggctgattgtttcagagatggggtgcgatccctgctccaggctagcgggctcggcagaatgaaacccaacaccttggtgataggatacaagaagaattggcggaaggcaccactgacggagattgagaattacgtgggcatcatccacgacgcattcgacttcgagattggcgtcgtcatcgtccgtattagccaaggtttcgatatatcgcaggtgcttcaggtgcaagaagaacttgaacgactggagcaggaaagactcgcactcgaggccactatcaaagataatgaatgtgaagaggagtcgggcggaatccgaggactcttcaagaaggcaggaaagctcaacatcactaagactaccccgaaaaaagacggaagcataaacacgtcacaaagcatgcatgtcggagagttcaaccaaaaacttgtcgaagcatcaacgcaattcaagaagaaacaagagaaaggaaccattgatgtgtggtggctgtttgatgatggtggactgactcttctgattccgtacatacttactcttcggaagaagtggaaggattgtaagctgagaatttacgtgggcggaaagattaatcggatcgaagaagagaagatcgtcatggcgagcctgctgtcaaagttcagaatcaaattcgccgatatccatatcatcggagacataaacatcagaccgaacaaagaatcctggaaggtctttgaggaaatgatagaaccttaccgcctgcatgagtcgtgtaaagatcttactactgccgagaagctcaagcgtgaaactccctggaagattaccgacgcagaacttgaagcggtcaaggaaaagagctaccggcaggtgcggctcaatgagctgctgcaagagcactccagagcagctaacctcattgtcctgtcccttcctgtggcacggaagggttccatctcggacctgctgtatatggcctggcttgagatacttactaagaaccttccaccagtcctgctcgtgcgaggtaaccacaaaaacgtgctgaccttctactcc

SEQ ID NO: 251074 - DNA, 3297 bp, Artificial Sequence
  Description of Artificial Sequence: Synthetic coding sequence
atgtctctgaacaactcgtcgaacgtgttcctggattcagtccctagcaacacgaacaggttccaggtgtcggtgatcaacgaaaatcatgaatcctcggccgccgcggacgacaacactgatccaccacattacgaagaaacctcgttcggagatgaagctcagaaacggctccggatcagcttccgtccggggaatcaggagtgttatgacaactttctgcagtccggggaaaccgccaaaactgacgcctccttccatgcgtacgacagccacactaatacctactacctgcagactttcggacacaacactatggacgctgtgcccaagatcgagtactaccgcaatacgggatcaatttccggaccaaaagtgaatagaccttctctcctggagatccacgaacagttggccaagaacgtggccgtgaccccgtcgtcggcggatcgtgtcgctaatggcgatggtattcctggagatgagcaagccgaaaacaaagaggacgatcaggccggagtggtcaaattcggatgggtgaagggagtgcttgtcagatgtatgctcaatatctggggcgtcatgctgtttatcaggctgtcctggatcgtgggtgaagcaggcatcggactcggagtcatcatcattgggctttccgtggtagtgaccaccctgactggtatctcaatgtccgctatctgtactaatggcgttgtgcggggagggggagcctactacctcatcagccgcagcctgggccctgaattcggaggctcgatcggcctcatcttcgcatttgccaacgccgtcgcggttgcaatgtacgttgtgggattcgccgaaaccgtcgtcgatctgttgaaggagagtgactccatgatggtggacccgaccaacgatatcaggattatcggctcgataactgtcgtgattttgctgggcatctcggtcgccggaatggaatgggaagcgaaagcacaggtgatcctgctcgtgattctcttgatcgccatcgcgaatttctttattggaaccgtaatcccatcgaacaatgaaaagaagtccaggggttttttcaactaccaggccagcatcttcgccgagaatttcggcccgagattcactaaaggcgaagggttcttttcggtctttgcaatcttctttcccgcggctaccggcatcctcgctggagcgaacatctcaggagatcttgaggacccgcaggacgccatccctcggggaactatgctcgcaattttcatcaccactgtggcttacctgggtgtcgccatctgtgtgggagcatgcgtggtcagagacgcaaccggaaacatgaacgacaccattatctcaggcatgaactgcaacggcagcgcagcctgcggattgggttacgatttctcccggtgccgccacgaaccttgtcagtatggattgatgaacaatttccaagtgatgagcatggtcagtggattcggaccacttatcactgctggaatcttttcagctactctgtcctccgcacttgcgtcattggtgtccgccccaaaggtgttccaggcgctctgcaaggacaacatctacaaggcactccagttcttcgctaagggatacgggaaaaacaacgaacctctgcgcggttatatccttaccttcctcatcgccatggctttcatcctgatcgccgagctgaacaccatcgcgccgatcatcagtaacttcttcctggcttcctacgcgcttatcaacttctcgtgcttccacgcttcctacgcaaagtcgccgggctggcggccggcatacggaatttacaatatgtgggtgtccctgtttggggccgttttgtgctgcgccgtcatgtttgttatcaactggtgggccgccgtgatcacgtacgtcatcgaattcttcctctacgtgtacgtgacgtgcaagaaaccggacgtcaactggggcagctctactcaggcgctgtcctacgtgagcgctctggacaacgcactggaactgacgaccgtggaggaccacgttaagaattttcgcccgcagtgcattgtgctgaccggaggaccaatgactaggcctgcgctgcttgacatcacccacgcatttaccaagaactccggactgtgcatctgctgcgaagtgttcgtggggcccagaaaactgtgtgtgaaggaaatgaatagtggcatggccaagaaacaagcgtggctgatcaagaacaagatcaaggccttctacgcagccgtcgctgcggattgtttccgggatggagtacggtcactcctgcaagccagcggcctcggcaggatgaagccaaacactctcgtgattgggtacaagaagaattggcgcaaggcccctctgaccgagatcgagaattatgtcggaatcatccacgatgcatttgacttcgagatcggagtggtgattgtgcgcatcagccaaggatttgatatctcacaggtcctgcaggtacaggaagaattggaaagactggagcaagaaaggctggcgctggaagccactatcaaggacaacgagtgcgaagaagagtcaggaggtattcgcgggctcttcaagaaagcgggaaagctcaacatcaccaaaacgactcccaagaaggacggatcgatcaacacttcccaatctatgcacgtcggtgagttcaaccaaaaacttgttgaagcctcaacccaattcaagaagaagcaggaaaaggggaccatcgacgtttggtggttgttcgacgacggtggcctgaccttgcttatcccgtacatactgactctgcggaagaaatggaaggattgcaaactgcgcatttacgtgggaggcaagatcaatagaattgaggaggagaagatcgtgatggcctccctgctttcgaagttccgcatcaagtttgccgacattcacattatcggggatatcaatattcggcccaataaagaatcctggaaagtgttcgaggagatgatcgagccctaccggctgcatgaatcgtgcaaggacctcaccactgccgaaaagctcaagcgcgaaactccgtggaagatcaccgatgcagagctggaggcagtgaaagagaagagctacagacaagtccggctcaacgagctcctccaagaacatagcagggccgcgaaccttattgtgctctcgttgcccgtggctcgcaagggttcgataagcgacctgctgtacatggcttggctggagatccttaccaaaaatcttccgcccgttctgctcgtgcgcggaaatcataagaatgtgctgactttctacagc

SEQ ID NO: 251075 - DNA, 3297 bp, Artificial Sequence
  Description of Artificial Sequence: Synthetic coding sequence
atgtcacttaataactcctcaaatgtgttcctggacagtgtcccatcaaacacaaaccgctttcaagtgtcagttataaatgaaaaccacgagagcagtgccgctgctgacgataacactgatcccccgcattacgaagaaacctcctttggagatgaagcacagaagcgacttcgaatttcttttcgtcctggaaatcaggaatgttatgacaacttcctgcaatcgggcgagactgccaaaactgacgcttcatttcatgcgtatgactcacacaccaatacttactatctgcaaactttcggtcacaacactatggatgctgttccgaaaattgaatactaccgcaataccggctctatatctggtccaaaagtaaataggccatcccttttggagatacacgaacaacttgcgaagaatgtcgccgtgacaccatcttcagctgaccgcgtcgccaatggagacggaatcccaggagacgaacaggccgagaataaagaagacgatcaggcaggtgttgtgaagtttggatgggttaaaggagttttagtccgctgtatgctgaacatttggggagttatgctttttattcggttgtcgtggattgttggagaagccggaatcggtctgggcgtcataattattggactttccgttgttgttacgacacttactggaattagcatgtcagcaatttgtaccaatggggttgtgagaggcgggggcgcatactaccttatttcgaggtcattgggacccgagtttggaggttcaattggactcattttcgctttcgctaacgccgttgctgtggcaatgtatgttgttgggtttgcagaaacagttgttgatttactgaaagagtctgattcaatgatggttgatccaacaaatgatatcagaataattggttccattactgtcgttattttgctgggaatttctgttgccggaatggaatgggaagcaaaggcacaggttatccttctagtcatactccttatcgccatcgccaatttctttattggaacggtgataccatcaaacaatgaaaaaaaatcacgaggattttttaattaccaagcttctattttcgccgaaaactttggaccccgatttacaaaaggagaaggttttttctcggtctttgcgattttcttcccagctgccactggaatcctcgcaggagctaacatctctggggacctggaagaccctcaagatgcaattccccgaggtacaatgctcgcgatcttcattacaacagtagcctatcttggagtcgcaatctgtgtaggtgcatgtgttgtgagagatgccacaggtaacatgaatgacactataatatcgggcatgaactgtaatggaagtgcggcatgcggactcggttatgatttttcgcgatgccgacatgaaccgtgccagtacggattgatgaataactttcaggttatgtcaatggtgtcgggcttcggaccgttaattaccgccggaatcttttctgcaacccttagcagtgcattggcaagtctggttagtgcgcctaaagtgttccaagccctatgtaaggataatatatataaagcacttcagttcttcgctaagggttatggcaaaaacaatgagccattgcgtgggtacatcctaacattcttgattgctatggccttcattctcatagccgaacttaacaccatcgcaccaatcatatctaacttcttcctcgcaagttatgcactcattaatttctcatgctttcatgcgtcttatgcgaaaagtccaggatggagacctgcatacggtatttacaatatgtgggtttcacttttcggagcagtcttgtgctgtgcagttatgttcgtgattaattggtgggcagctgttatcacatatgttattgagtttttcctttatgtttacgttacatgtaaaaagccagacgttaattggggatcctcaacccaagctttgtcctatgtgtctgctctggataatgccctcgaacttactactgtagaagaccacgtcaagaacttccggccacaatgcattgtgttgacaggaggaccgatgaccagacctgctctgcttgatataactcacgcttttacgaaaaattctggactgtgcatttgttgtgaagttttcgtaggaccccgaaagttgtgtgtcaaggaaatgaatagtggcatggccaaaaaacaggcgtggctgatcaagaataagataaaggccttctacgcggctgtggctgcagattgtttcagggacggggttagatcgctactgcaagcatctgggttgggtagaatgaaacctaacacgttggtgattggatacaaaaaaaattggcggaaagctccactgactgagatcgaaaattacgttggaattatccacgatgcctttgattttgagattggcgtagtgatcgtgcgaatcagtcaaggatttgatatatcacaagtgcttcaggtgcaggaagaactcgagaggctcgagcaagaaagacttgccctagaagccaccattaaagataacgaatgcgaggaagaaagtggaggaattcgtggactattcaaaaaagccggaaagcttaatattactaagactaccccaaagaaagatgggtcaattaacacttcgcaatcaatgcatgttggagaattcaatcaaaaattagttgaggcatcgacacaatttaaaaaaaaacaagaaaaaggtaccattgatgtttggtggttgtttgatgatggagggctcactcttttgatcccttacattttgacccttaggaagaaatggaaagattgcaagctgaggatttacgttggtggaaaaatcaaccgaattgaagaggaaaagattgtcatggcatcacttctttccaagttccggataaaatttgctgatattcatattataggagatattaacatcagaccaaataaagagtcttggaaagtttttgaagagatgattgagccatatagactgcacgaatcatgtaaagatctgacgacagcggaaaagctcaagagagagacaccctggaagatcaccgatgcagaacttgaggccgttaaagaaaaatcttatcggcaagtacgtctaaatgaactgttgcaagagcacagcagagcagcaaatcttatcgtactatcgctcccagttgctcgtaaaggctctatatctgatttgttgtatatggcatggctggaaattctaacaaaaaatcttcccccggtcttgttagtgaggggaaaccataaaaacgttctcactttttattct

SEQ ID NO: 251076 - DNA, 3297 bp, Artificial Sequence
  Description of Artificial Sequence: Synthetic coding sequence
atgagtttgaacaacagctccaatgtcttcctggattctgttccaagtaatacgaataggttccaggtgtccgtcatcaatgagaaccacgaatcgagcgccgctgccgacgataatactgaccctcctcattacgaagagacatcttttggtgacgaagctcagaaacgtttgcgtatctcatttagacccggtaaccaagaatgttatgataatttcctgcaatccggcgagaccgccaagactgacgccagctttcatgcctacgactctcacacaaatacatattatcttcagacattcggtcacaatacaatggacgctgttcctaaaattgaatactatcgtaacaccgggtccatctcagggccaaaagtaaaccgacctagcctgcttgaaattcacgagcagctcgccaagaacgtggctgtcacaccatcttcagccgaccgcgtcgctaatggagacggcataccaggggacgaacaagctgaaaacaaagaggacgatcaagcgggtgtagttaaatttggctgggttaaaggcgtgcttgtgagatgtatgttgaatatttggggcgttatgctgtttattagattgtcatggattgtgggggaggcagggatcggccttggcgtcatcattattggactgtccgtggtcgtaactaccttgactggcatctcgatgagtgctatctgcacaaatggggtcgtaagaggcgggggggcctactacctgatcagccgctctttaggaccggagttcggaggcagtattggccttatctttgccttcgctaatgcggtggccgtcgccatgtatgtggtgggctttgccgaaacggtcgtcgacctgttgaaagaatcagattcaatgatggtggatcctactaacgatatccggatcatcggttccatcactgtggtaatcctgttagggatttctgtagctgggatggagtgggaggcaaaagctcaggtgatcctactggtaatcctgctcatcgccatagcaaatttcttcatcggaacagtcattccctcaaacaacgagaagaagagtagaggatttttcaactaccaggcctccatcttcgccgagaacttcggaccaaggttcactaagggcgagggattcttctctgtgttcgccatattcttccccgcagcaaccgggattttagctggagccaacatttctggtgacctagaggatcctcaagatgccatccctcgtgggaccatgctggcaatctttatcacaacagtggcctatctgggcgtggcaatatgcgtgggggcgtgtgtggtgcgcgatgctacgggcaatatgaatgataccatcatttccggtatgaattgtaatggttcagccgcttgtgggttagggtacgatttctcaagatgtcggcacgagccgtgccagtacggccttatgaacaacttccaggttatgtccatggtgtccggcttcggtccgttgattaccgccggcatctttagcgctacactgtcaagcgcactggcctcactggtctccgcccctaaagtatttcaggcattgtgcaaggataatatttataaggcgctgcaattcttcgccaaagggtacggtaaaaataacgaacccctgcgcgggtacatcctcaccttcctgatcgctatggcattcatccttatcgctgagctgaacacaattgctcccataatctctaatttcttccttgcgtcatacgctcttataaactttagctgttttcatgcctcgtacgcaaagagtcccggatggaggcccgcctacggaatttataatatgtgggtctccctgttcggagctgtactgtgctgcgccgtgatgtttgtcataaactggtgggccgccgttattacgtacgtgatagaattctttctgtatgtctacgtgacatgtaagaaacccgacgtgaactggggcagcagcacccaagcgctgtcatacgtgtctgccttagataatgccctggagcttaccacggtcgaggatcatgtaaaaaacttccggccccagtgcattgtgttgacaggaggaccaatgactaggcccgctctcctggacattacacacgcatttaccaaaaattctggactgtgcatctgctgcgaagtcttcgttggacctcggaagctttgcgtgaaagagatgaacagtggaatggcaaagaagcaggcctggctcatcaagaacaaaatcaaggctttttacgctgccgttgcagcggattgctttcgggacggggtgagatccctgctccaggcctctgggctgggtcggatgaaacccaacacgcttgttataggttacaaaaaaaactggagaaaagcccctttgaccgaaattgagaactatgtcggaataatccacgacgcttttgactttgagataggcgttgtgattgtaaggatatcccaaggatttgacatctcacaagttctacaggtgcaagaagagcttgagcgactggagcaggagcgccttgccctcgaagcgacaatcaaggataatgaatgcgaagaggagtccggggggatacgtgggctgttcaaaaaagcaggaaagctgaacataacgaagaccacacccaagaaagatgggtctatcaatactagccagtcgatgcacgtcggggaatttaatcagaagctcgtggaggcttctacccagtttaaaaagaaacaagagaagggaaccatcgacgtatggtggttgtttgacgacggcggcctaacgctgttgatcccgtatatccttacactacggaagaagtggaaagactgtaagttgcgaatatacgtcggtggtaaaattaatcggatcgaggaagagaaaattgtaatggctagccttctatcaaaatttagaattaagtttgccgacatccacattatcggagatattaatatccggcccaataaggagtcttggaaggtcttcgaggaaatgatagagccttaccgactacacgaatcatgtaaagatcttaccaccgctgagaaattgaaacgggagaccccatggaaaataacagatgccgaattggaagccgtcaaggagaaaagctataggcaggttcgtctcaatgagctgctgcaggagcatagccgggcggctaatctcatagttctgtcgctgcccgtggcgcggaaagggtctattagtgacctgctgtacatggcttggcttgagatcctgacgaagaatctccctccggtgctgctggtgaggggaaatcataagaatgtcctgaccttttattcc

SEQ ID NO: 251077 - DNA, 3297 bp, Artificial Sequence
  Description of Artificial Sequence: Synthetic coding sequence
atgtccttgaacaactcttctaatgtattcctggatagtgttccttctaacaccaaccgcttccaagtgtcagtcatcaatgagaaccacgagagttctgccgctgctgacgataacacagaccctccacattacgaagagaccagtttcggagacgaagcccagaagaggctgaggatctcattcaggcccggtaaccaggaatgttacgacaactttcttcagagtggcgagactgccaagactgatgcctcttttcacgcgtatgattcccatacaaatacttattatctgcagacgtttggacataatacaatggacgcagtccccaagattgagtactacagaaatactggtagtattagtggcccgaaggttaacagaccctccttgctcgagatacatgaacagctcgccaagaacgtcgccgtcacaccttcctctgcagacagagttgccaacggagatggcattccaggagatgagcaggcagagaataaagaggacgaccaggcaggtgtggtcaagttcggctgggtgaaaggtgtgctcgtgcgctgtatgctcaatatctggggagtcatgctctttatcaggctctcctggatagtcggcgaagctggaatcggcctcggtgtcattatcataggcctgtcagttgtagtgacaaccctgacaggaatctcaatgagtgcaatttgcacgaatggagtggtgaggggcggaggagcctactaccttatctccagatccctcggtcccgagttcggcggctcaattggtctgatctttgctttcgccaacgctgtggcagtggccatgtatgtggttggcttcgcggaaacggtagttgacctgttgaaagagtctgattcaatgatggtggacccaaccaacgatatcagaatcatcggctcaatcacagtggtaattctgctgggaatatctgtcgccggcatggagtgggaagctaaggcccaggttatcctgctggtcattctcttgatcgcaattgctaacttttttattggtaccgtgatcccctctaacaacgaaaagaaatcccgcggttttttcaactatcaagcaagtatttttgccgaaaatttcggccctcgcttcactaaaggcgaaggattcttttcagtgtttgccattttttttccagccgccactggaatcctggcaggtgctaacattagtggtgacctcgaggacccccaggatgcgattccgagaggcacaatgctcgccatctttattacaaccgtagcttatctgggcgttgccatttgcgttggcgcctgtgtcgtgagagacgctactggaaatatgaatgacacaatcatctccggtatgaactgtaacggctccgctgcttgcggacttggatatgatttctccagatgtcgccacgagccctgccaatatggcctcatgaataacttccaggtaatgtcaatggtctcaggattcggaccattgattactgcaggaattttctccgctacattgagtagtgccctggcatctttggtgtccgccccgaaagtctttcaagccctttgcaaggataatatctacaaagctctgcagtttttcgctaaaggctacggaaaaaataatgagcctctgaggggatatatcctgaccttcttgatcgctatggctttcattctgattgcggagctgaacaccatcgcgccaattatttctaacttttttttggcttcctatgctcttatcaactttagctgctttcacgcatcctacgcgaaatcacccggttggaggcctgcatacggtatctacaacatgtgggtctctctgtttggcgctgttctttgctgcgctgttatgtttgtcatcaattggtgggccgccgtgatcacctacgtgattgaattctttttgtatgtgtacgtgacctgtaaaaagcctgatgtaaactggggcagctcaacacaggcactctcttatgtgtctgctcttgacaatgcactcgagcttactacggtggaagaccacgttaagaacttcagacctcagtgcatcgtgcttacaggaggtcctatgactaggcccgctttgctggatatcacgcacgccttcactaagaatagcggactttgtatctgctgtgaggtgttcgttggtccgaggaagttgtgcgtcaaagagatgaatagcggtatggcgaaaaagcaggcatggctcataaagaataagatcaaggcattctacgctgctgtggcagctgactgcttcagggatggcgttagatctctgctgcaagcatctggtcttggcaggatgaaaccgaacacactggttatcggatacaagaagaactggcgcaaggcaccgctgacagaaattgaaaattatgtgggcattatccacgatgctttcgatttcgagattggagtggtgatcgttaggatatcacagggttttgacatatcacaagtgttgcaggtccaggaggagttggagaggcttgagcaggagaggctggcactggaggccacaattaaggataatgagtgtgaagaggagtctggaggtattcgcggcttgttcaagaaagcgggcaagctgaacattactaagacgacacctaagaaagacggctccataaacacatcccagtcaatgcacgtcggtgagttcaaccagaagttggtggaagcttctacccagttcaagaaaaaacaggagaagggcaccatcgacgtctggtggctgttcgatgatggcggactgacactcttgatcccctacatcctgacattgagaaaaaaatggaaagattgtaaactccgcatctacgtaggaggcaagatcaatagaatcgaggaggagaaaatagttatggcgtctcttttgtccaagttcagaatcaaatttgctgacattcacatcattggcgatatcaacattagacctaataaggaatcatggaaggtatttgaagaaatgatcgagccttaccgcctccatgagagctgtaaagatctcaccacggcagagaaacttaagcgcgagaccccttggaagatcactgacgccgaattggaagccgtcaaggaaaagtcttacagacaggtaaggctcaacgaacttcttcaggagcactctagagctgccaatctcatagtgctgtcattgccggtggccaggaaaggttctatctctgatctgctctacatggcatggctggagatcctgaccaaaaacctcccaccagtgctgttggtgaggggaaaccataagaatgtactgaccttctattcc

SEQ ID NO: 251078 - DNA, 3297 bp, Artificial Sequence
  Description of Artificial Sequence: Synthetic coding sequence
atgagcctgaacaactcgtctaacgtgtttctggattctgtgccaagtaacacgaatcggtttcaggtttcagtcatcaacgagaaccacgagagtagcgcggcagccgacgataacactgatcccccccattacgaggaaactagctttggcgacgaagctcagaagcgtcttcgaattagctttcggcccgggaaccaagaatgttacgacaatttccttcagtcaggagagactgctaagactgatgcctcctttcatgcctatgacagccacaccaacacctattacttacagacattcggacataataccatggatgccgttcctaagatagagtattacagaaatactgggtcgatctcaggccccaaagtcaatagaccatcattgctagagatccatgaacagctcgcaaagaatgtggccgtgacaccctcaagtgccgaccgagtcgcaaatggtgacggcattccgggagatgaacaagccgagaataaagaggatgaccaggctggcgtggtcaaatttgggtgggttaagggagtgcttgtgcgatgcatgttgaacatttggggagtaatgctctttatcaggttgtcctggattgtcggcgaggctggaattgggcttggagtcattattataggtctttcagtcgtggtgaccacccttacaggaatcagcatgagcgctatctgcaccaacggcgtggtgagaggcggaggagcctattaccttatctctagatcactggggcctgagttcggaggctctatcggtctcatttttgcttttgcgaatgccgtagcagtcgctatgtacgtggtgggattcgctgaaacagtcgttgacttgcttaaggaaagtgacagcatgatggtggatcctacaaacgacataaggataatcgggtcaatcactgtggtgatactgctgggaattagcgttgctggcatggagtgggaagccaaggctcaagtgattctactcgtaatcctactgattgccattgccaacttctttatcggtactgttatcccttctaacaatgaaaagaagtccagagggttctttaactatcaggcgagcatttttgctgaaaattttgggccacggtttactaaaggtgaagggttcttttcggtgtttgccatcttcttccccgcggcgacggggattctcgccggagctaacatcagcggggatctggaagacccccaagatgcgatccctcgcggaacaatgctggccatattcataaccaccgtggcatatttaggggttgcaatttgtgtgggggcttgtgtggtcagagacgcgacggggaatatgaacgacaccatcatatctggcatgaattgcaacgggtccgcagcctgtgggctgggatacgatttctcccgttgtaggcacgaaccttgccagtacggcctgatgaataactttcaggtgatgtctatggtgtcagggtttggccctttgattacagcgggcatcttcagcgcaacactctcttcagccctggctagcctcgtttccgcccccaaagttttccaggccctgtgtaaggataacatctacaaagcactgcagttttttgcgaaaggctatgggaaaaataatgaaccattgagggggtatatcctgacttttctaattgccatggcatttatcttaattgctgaattgaataccattgcccccatcatatctaacttcttcctcgcctcatacgctctaatcaatttctcctgttttcatgcttcttacgcaaagagtccggggtggcggcctgcctatggaatctataacatgtgggtgagtctttttggcgctgtgctttgctgtgccgtcatgtttgttataaactggtgggccgcagtgatcacatatgtgattgaattcttcctgtatgtctacgtgacttgcaagaaaccggacgtgaactggggcagctcgacgcaggccctgtcctacgtatccgccctggataacgctctggagctgaccaccgtcgaggatcacgtgaagaatttcagaccccagtgtattgtgctgacaggcggaccgatgaccagacctgctctactggatataacgcacgccttcaccaaaaattcaggactttgcatctgttgcgaggtgttcgttggaccccgcaaattatgtgtgaaagaaatgaacagcggcatggccaagaaacaagcctggcttatcaagaataaaatcaaagccttctatgcagctgtagccgcggattgcttccgcgacggagtgcggtctttgctccaggcctccgggttaggtaggatgaagcctaatactctagtgataggctacaaaaaaaactggaggaaggccccgttgaccgaaatcgaaaattacgtcgggatcatccatgatgcgttcgatttcgaaatcggcgtggtgatagtgagaatttctcagggattcgacattagccaggtgctccaggtgcaggaagagctggagcgcctcgagcaggagcggctcgctctcgaggccaccataaaggataacgagtgtgaggaggagagcgggggtatcagaggactgttcaagaaggctgggaaactgaacatcacaaagaccaccccaaagaaagatggttcaatcaacacgtctcagtctatgcatgtgggagagttcaaccagaaattggtggaggcctctacgcagttcaagaaaaaacaggagaagggcaccatcgacgtctggtggctgtttgacgatggaggcctgactctccttatcccatacattctcaccctacggaaaaaatggaaagattgcaaacttagaatctatgttggcggcaaaatcaatcggatcgaggaggagaagatcgtaatggcatcactgcttagtaagttcagaatcaagttcgccgatattcatattatcggggatatcaacatccggcccaacaaggagagttggaaagtattcgaggaaatgatagagccatataggctccacgagagttgtaaggacctcactaccgccgaaaagctgaaaagagagaccccgtggaagatcaccgatgcagagctagaggcagtgaaggagaagtcctaccgacaggttcgacttaacgagctgctgcaagagcattcaagggcagcaaacttgatcgttttatcacttcccgtggcccgaaaaggatcgataagcgacttgctgtacatggcgtggctggaaattctgacaaaaaacctcccgccagttttgctcgtgaggggaaatcataagaacgttctgaccttttacagc

SEQ ID NO: 251079 - DNA, 3297 bp, Artificial Sequence
  Description of Artificial Sequence: Synthetic coding sequence
atgagtcttaacaattcatctaacgtttttttagatagtgtaccttcaaatactaatagatttcaagtttcagtgattaacgaaaatcatgaaagttctgctgctgccgatgataatacagatcctccacattatgaagaaacttcttttggagacgaagcacaaaagcgtttaagaataagttttcgaccaggaaatcaagaatgttatgataattttttacaatctggagaaactgcaaaaactgatgcatcttttcatgcttatgattctcatacaaatacatattatcttcagacatttggacataatactatggatgctgttccaaaaattgaatattataggaacactggaagtatttcaggaccaaaagttaatagaccatcacttttagaaattcacgaacaattagctaaaaatgttgctgttacaccttcttcagccgatagggtcgctaatggagacggaattccaggtgatgaacaagcagaaaataaagaagatgatcaagctggtgtcgttaaatttggatgggttaaaggagttttagttagatgtatgcttaatatatggggagttatgttatttatacgattaagttggatcgtaggagaagcaggaattggacttggagttataataattgggctatcagttgttgttactactttaactggaatttcaatgtcagcaatttgcacaaatggagttgtacgtggtggtggagcatattatcttatttctagatcattaggaccagaatttggaggatccattggacttatctttgcatttgcaaatgcagttgccgttgctatgtatgtggtcggttttgcagaaactgttgttgatttgcttaaggaatctgacagtatgatggttgatccaaccaacgatatcagaataattggatctattacagtagttatattattaggtatttcagttgctggtatggaatgggaagcaaaagcacaggtaatattattagttatacttctcattgcaattgctaatttctttattggtactgtgattccaagtaataatgaaaaaaagtctagaggattctttaactatcaagcatctatttttgcagaaaatttcggaccaagattcactaagggagaaggatttttttcagtatttgctattttctttccagctgctactggaattcttgcaggagcaaatatatctggagatttagaagatccacaagatgcaattccacgtggtactatgctcgcaatttttataacaactgtggcttatcttggagtagctatttgtgtaggagcatgtgttgtaagagatgctactggaaatatgaatgatactattatttctggaatgaattgtaatggttctgctgcttgcggtttaggttatgattttagtagatgtagacatgaaccatgtcaatatggacttatgaataactttcaagtgatgtctatggtttcaggatttggaccacttatcactgcagggatttttagtgcaacattatcatcagctttagcatcattagtaagcgcaccaaaagtttttcaagcactttgtaaagataatatttataaggctttgcaatttttcgctaaagggtatggtaaaaataacgaacctttacgaggatatatattaaccttcttaatagcaatggcatttatattaatcgctgaactcaacacaattgctccaataatttctaatttttttttggcttcatatgcattaatcaatttctcatgttttcatgcttcttatgctaaatctccaggatggagaccagcttatggaatttataacatgtgggtatccttatttggtgctgttttgtgttgtgcagttatgtttgttattaattggtgggcagcagtcataacttatgttattgagttttttttatatgtttatgttacttgtaaaaagccagatgttaattggggaagttcaacacaagcactttcctatgtttcagctcttgataatgctcttgaattaacaacagttgaagatcatgttaagaactttagaccacaatgtattgtactcactggaggacctatgacaagaccagctttactagatattacacatgcattcacaaaaaattcaggactttgcatttgttgtgaagtttttgttggacctagaaagctttgtgttaaagaaatgaacagtggaatggctaaaaagcaagcttggttgattaagaataaaattaaagctttctatgctgctgtcgcagctgattgtttcagagatggagttagatccttattacaagcaagtggattaggacgtatgaagccaaatacacttgttattggatataaaaaaaattggagaaaagctccacttacagaaatagaaaattatgtaggtattatccatgatgcttttgatttcgaaattggagtagtaattgttagaattagtcaaggttttgatatttcacaagttttgcaagttcaagaagaacttgaaagattagaacaagagagattagctttagaagcaacaattaaggataatgaatgtgaagaagaaagtggtggaattagaggtcttttcaaaaaagctggtaaattaaatattacaaaaacaacaccaaagaaagatggatctataaatacatcacaatctatgcatgttggagaatttaatcaaaaacttgttgaggcttcaacacaattcaaaaaaaaacaagaaaaaggaactattgatgtttggtggttatttgatgatggaggtttaacattattaatcccatatatattaactcttagaaaaaagtggaaagattgtaaacttagaatttatgttggaggaaaaattaaccgaattgaagaagaaaagattgttatggcaagtttattatccaaattcagaattaaattcgctgatattcatattattggggacatcaatattagacctaataaggaatcttggaaagtttttgaagaaatgatagaaccatatagacttcatgagtcttgtaaagatttaactacagctgaaaagttaaaaagagaaactccttggaagattactgatgctgaattagaggctgttaaagaaaaaagttatagacaagttagattaaacgaattattacaagaacatagtagagctgctaatcttattgtactttcattgccagttgcaagaaaaggaagtatttcagatcttctttatatggcatggcttgagattttaacaaaaaacttacctccagtattattagttagaggtaatcataaaaatgttttaacattttattca

SEQ ID NO: 251080 - DNA, 3297 bp, Artificial Sequence
  Description of Artificial Sequence: Synthetic coding sequence
atgtcacttaacaattcatcaaacgtgtttctggatagcgtgccatcgaacacgaaccgcttccaagtctcagtgattaatgaaaaccatgaatcatccgcagcagcggatgataacactgatcccccgcactacgaagagacttcgtttggtgacgaagcccaaaaaagacttaggatctcctttagaccggggaatcaagaatgctacgataactttttgcagtccggcgagactgcaaagaccgatgctagctttcacgcgtacgattcacatactaacacttactaccttcaaacctttgggcataataccatggacgccgtgcctaaaatcgagtactatcgaaatactggttcgatttcagggcctaaggttaatagaccctccctgctcgagattcatgagcaacttgcaaagaatgtcgcagtcaccccttcgtcagccgatagagtggccaacggggatggtattcccggagatgaacaagcagagaacaaagaagatgatcaggccggggtcgtcaagttcggatgggtgaaaggtgtcttggtccgatgtatgttgaacatttggggagttatgctctttatacgtctctcgtggattgtcggagaggcaggcataggtcttggagtgatcattatcggactgagcgtcgtcgtgactaccctgaccggaatttcgatgtcggcaatttgcaccaatggcgtggtgagaggtgggggagcttactaccttatttctcgttcgcttggtcctgagtttggggggagcattggactgatttttgcgtttgccaatgcggtggccgtcgcgatgtacgttgtcggttttgcagaaaccgtcgtggacctgctcaaggagtcagattcaatgatggtggatcccaccaacgatattcggattatcggatcgattaccgtcgtgattcttctgggtatctcagtcgcagggatggaatgggaggcaaaagctcaagtgatccttcttgtcatcctgttgatagcgatcgcaaacttctttatcggaaccgtcattccgtcgaataatgagaagaaatcgagggggttctttaactaccaagccagcatttttgcagagaactttggtcctcggttcactaaaggcgaagggtttttctccgtgtttgcaatcttcttccctgccgccactggtattctggcaggtgccaacatttcaggtgacctggaagatcctcaggatgcaatacctagaggaaccatgctcgctatattcattaccactgtggcatacctgggagtggcaatttgtgtgggcgcatgtgtggtgcgagatgcgaccggaaacatgaacgataccataatctcaggcatgaactgtaacggatcggcagcctgtggactgggatatgatttctccaggtgtcgtcatgagccttgtcagtacggactgatgaataactttcaagtgatgtccatggtgagcggttttggcccgctgataaccgcaggaattttctcagcaactctcagctccgcacttgcctcactcgtgtcggcaccaaaggtgttccaagccttgtgcaaggataacatttacaaagcgctgcagttttttgcaaagggatacgggaagaacaacgagcctctgcgggggtacatcctgacttttctgattgcaatggcattcatcctgatcgcagaacttaacactatagcgcccatcataagtaatttcttcctggcaagctacgcactgattaacttctcgtgttttcatgcctcgtatgctaagtcacctggctggcgtccggcatacggcatttacaatatgtgggtgtccctttttggagcagtgctgtgctgcgccgtcatgtttgtcattaactggtgggcagctgtgattacttacgtgattgaattctttctgtacgtgtacgtgacttgcaagaagcctgatgtgaactggggctcctcgactcaggcactttcatacgtctcagcgctcgacaacgcacttgaactgactacggtggaagatcacgtgaagaacttcagaccacaatgtattgtgctcaccggggggccaatgactcggcctgcgctcctcgatatcacgcacgcgttcaccaaaaacagcggactgtgtatttgttgtgaagtgttcgtcggtcctaggaagctgtgtgtgaaggaaatgaacagcggcatggcaaagaagcaagcatggctgatcaagaacaagatcaaggcattctacgctgcggtggcagcagattgttttcgcgatggtgtcagatccctccttcaagctagcggcctgggccgaatgaagccaaacaccctcgtgattggttacaaaaagaactggcgaaaggcaccgcttaccgagattgagaactacgtggggatcattcacgatgcatttgacttcgaaataggggtggtgattgtgagaatctcccagggttttgacatttcgcaagtgctccaagtgcaggaagaacttgaacgcctggagcaagaacggctcgcactcgaggcaaccattaaggacaatgagtgtgaggaagaatccggtgggatacgggggctcttcaaaaaggcaggaaaactcaacattactaagaccactcccaaaaaggatggatcgatcaacacttcccagtcgatgcacgtcggggaattcaatcagaagctggtggaagcgtccacccagttcaagaaaaagcaggaaaaaggaaccattgatgtgtggtggctgtttgatgacggtggactgactctgcttattccatacattctgactctgaggaaaaagtggaaggattgtaaacttaggatctacgtgggaggcaagatcaaccggattgaagaagagaagatcgtgatggcgtccctcctgtcgaagtttagaataaagtttgcagatattcatatcatcggggacattaacatcagacccaacaaggaaagctggaaggttttcgaagaaatgatcgaaccataccgactgcatgagtcctgcaaggatctcactacggcagaaaaacttaaacgggaaaccccatggaagatcaccgatgcggaacttgaggcggtcaaggagaaatcctaccgtcaggtgagattgaacgaactgctgcaggaacatagcagagcagcaaacttgattgtgctctccctgcctgtggcaagaaagggtagcatctcggatctcctctatatggcatggcttgaaatcctgaccaagaatcttccgccagttcttctggtccggggaaaccacaagaatgttctgaccttctactcc

SEQ ID NO: 251081 - DNA, 3297 bp, Artificial Sequence
  Description of Artificial Sequence: Synthetic coding sequence
atgtccctgaacaattcctctaatgttttcttggattccgtcccatcaaatacaaaccggtttcaagtttccgttattaatgaaaatcacgagtcatccgctgccgccgacgataataccgatcccccacattatgaagagaccagttttggagacgaagcccaaaagcgactgcgaatcagcttccgcccaggcaaccaggagtgttatgacaactttttacaatcaggggagacagctaagacagacgcatctttccacgcttacgactcccataccaacacctattatcttcagacatttggtcacaacactatggacgccgtgcccaaaatcgaatattatcgcaacacaggatccattagcgggccgaaggtgaacaggccatcacttcttgagattcatgagcagctggccaaaaacgttgcagtgaccccctctagcgcggaccgcgtggcgaatggcgacggtattccaggtgatgagcaagccgagaacaaggaggatgaccaggcgggcgtggttaagttcggatgggtgaagggggtgttggtgcgatgtatgcttaatatctggggagtcatgttgttcatccgcttaagttggatcgtgggcgaggccggtattgggctcggggtgataattatcggtctgagcgtggtggtgactaccctcaccggcatctccatgagcgccatctgtacaaatggagttgtgcggggcggaggagcatactacttgatctcaaggagccttggtcccgagttcggaggtagcatcgggcttatctttgccttcgccaatgcggtggccgtggccatgtatgtggtcggctttgctgaaacagtcgtggacctgctcaaagaatccgacagtatgatggtcgatcccactaacgacattaggatcattggctcgataacagtggtcatcttgcttggcatcagcgtggcgggaatggaatgggaggctaaagcccaggtgatcttgctggtcatcttgcttatcgccatcgcgaacttttttatcggaacggtcatcccctcaaacaatgagaaaaagtcccggggattcttcaactatcaggcctccatttttgctgaaaacttcggacctcggttcaccaaaggcgaaggtttcttctcagtgtttgctatttttttccctgccgctaccgggattctcgccggagcgaacatctccggggatctggaagatccccaggatgcgatcccgcgaggaactatgcttgcaattttcattacaacagttgcctacctcggagttgctatttgcgtaggggcctgtgttgtaagggacgccacggggaacatgaatgacacaatcatctctggtatgaactgcaatggatcggcagcctgcgggctcggatacgatttctcacgatgtcgccacgaaccatgccagtacggactcatgaataacttccaagtaatgtcaatggtctcagggttcggtcccctcatcactgccggtattttttccgccacattgtcctcagccctcgcgagtttggtatcagcccctaaagtgtttcaggctctgtgcaaagataatatatataaggcccttcaattcttcgccaaggggtacgggaagaacaatgaacctctaaggggatatatattaaccttcctcatagctatggctttcatcctgatcgcagagcttaatacaatcgcccctatcattagcaacttttttctcgcatcttatgctctaattaatttttcctgtttccatgccagctatgccaaaagcccaggatggcggccagcctatggaatttacaacatgtgggttagcctattcggcgctgtgctttgctgtgcagtgatgtttgtcattaactggtgggcagccgttataacgtatgttattgagttcttcctgtatgtttacgtcacatgcaagaagcctgatgtcaactggggcagcagcacccaagcactctcttatgtatctgccctggacaatgccctggagctcactacagtcgaggaccacgtgaagaacttcagaccacaatgtattgtcctgaccgggggtcccatgacacgacctgcccttttggacatcacccatgccttcactaagaactctggactgtgcatatgctgtgaggtctttgtgggccctcggaaactgtgcgttaaagaaatgaattccgggatggcaaaaaaacaggcttggcttataaagaataagatcaaggctttctacgccgccgttgctgcggattgcttccgggatggcgtcagatcactcctacaagccagtggcctcggtcgaatgaaacctaatactttggtgattggctataaaaagaactggagaaaagctcctttaacggagatcgagaactacgtcggcattatccacgacgctttcgacttcgaaataggtgtagtgattgtccgcatttcccagggattcgacatatcccaggtcctgcaggttcaggaggaactggagagattagaacaggaaagattggccctggaggccaccattaaagacaacgaatgtgaggaggagtcgggggggattcgagggttgttcaagaaggctggaaagctaaacatcacaaaaaccacccccaaaaaagacgggtccattaatacatctcaaagcatgcacgttggagagtttaaccagaagctggtggaggcctccactcaattcaaaaaaaaacaggaaaaaggtacgatcgatgtgtggtggctctttgatgatgggggtttgacgcttcttatcccttacatcttgactttacgtaagaaatggaaggattgcaaactccgtatatacgtgggagggaaaattaatagaatcgaagaggagaaaatcgtgatggcttcactactgtcaaagttccgcataaaattcgctgacatacatataataggcgacatcaatattcggcccaataaggaatcctggaaggtttttgaggagatgatagaaccctacaggcttcatgaatcttgtaaggatctcaccacagcagagaaactcaagagagagaccccatggaagattacagacgcagaattggaggccgtcaaggaaaaaagttatcggcaggtgcggcttaatgagttactgcaggaacacagccgagcagccaacctaatagtgttgagtctacctgtggcgaggaagggaagcatatccgacttgctctacatggcttggttggagatcctaaccaagaaccttccccctgtgctgctggtgagagggaaccataaaaacgtcttaaccttttacagt

SEQ ID NO: 251082 - DNA, 3297 bp, Artificial Sequence
  Description of Artificial Sequence: Synthetic coding sequence
atgtcattgaacaactccagcaatgttttcctggactctgtgcccagtaacacaaataggttccaagtctcggtgataaacgagaatcacgagtcttccgcagccgcagacgataataccgatcccccccactacgaggaaactagctttggcgatgaagctcagaaacggctgagaatttctttccgacctggtaaccaagagtgctacgacaattttctgcagtcaggagagaccgccaagacagatgcctcgtttcacgcatatgatagtcacacaaacacatactatctccagactttcggccacaacactatggacgctgtgccgaagatcgagtattaccgaaatacagggtccattagtggccctaaggtgaacaggccctccttgttggaaattcatgaacagctcgccaagaacgtggcagtcacaccaagctctgcagaccgagtagccaacggagacggcattccgggcgatgagcaagccgagaataaagaggacgatcaggcaggtgtggtcaagttcgggtgggtcaagggcgtgctggtacggtgcatgctgaacatctggggtgttatgctgttcatacgattgtcctggatcgtaggggaagccgggatcggcttaggagtgataatcataggcctgtccgtcgtcgttactacgctgaccgggattagcatgagtgcgatttgtacaaatggggtcgttcgcggtggcggcgcgtactacctgatcagtcgcagcttaggccctgaattcggcgggagcataggcctaatatttgctttcgccaacgctgtggctgtggcgatgtatgtggttgggttcgccgaaacagtggttgatctgttgaaagaatcagatagcatgatggtggaccccaccaatgacattagaataataggcagcatcaccgtggtaattcttttgggtatctctgtcgccggcatggagtgggaagccaaggcccaagtaattctgctggtgattctgctgatcgccatcgcgaatttctttatcggtacggtgattccctcaaacaacgagaagaagagtagggggttttttaactatcaggcttcaatatttgccgaaaattttgggcccaggtttaccaagggagaggggtttttttcagtcttcgcgattttcttccccgccgccactggcatactggccggcgctaatatcagtggcgacctggaggatccacaggatgctatcccaagggggactatgttggcaatttttatcaccactgtggcctacttgggggtggccatctgtgttggagcttgtgtggtacgcgacgctaccgggaacatgaatgacactattatttcaggcatgaattgcaatggttcggctgcctgtggccttggctacgacttctctcggtgtagacatgagccgtgccagtacggcctgatgaataattttcaggtcatgagcatggtcagtggattcgggcctttgataacagcgggaatatttagcgccaccctgagctcagcgctcgctagcctggtctcggccccaaaggtgtttcaggctctgtgcaaagacaacatttacaaggctctccaattctttgccaagggatacggaaagaacaacgaacctttgaggggatatatcttgacgttcctgattgccatggccttcatattgatcgccgagctgaatactattgctccaataatcagcaattttttcctagccagttatgcccttataaatttcagctgctttcatgcctcatacgcaaagagtccgggctggaggccagcttacggaatttataatatgtgggtatcgttattcggagccgtattgtgctgcgccgtaatgtttgtgatcaattggtgggcggccgtgatcacttacgtgattgagttttttctttacgtatacgtgacttgtaaaaagcctgatgtgaattggggtagctctacacaggcactctcctacgtaagtgcccttgataacgctctcgagcttaccaccgtggaagatcacgtgaagaattttcggccacagtgcatcgttttaaccggtgggcccatgactcgacctgctcttttggatattacccatgcgtttactaaaaattctggcctctgcatttgttgtgaggtcttcgttggacctaggaagctatgcgtgaaagagatgaattccgggatggccaagaagcaggcatggctgattaagaacaaaattaaagccttctacgcagccgtagcggctgattgtttccgcgacggagtgcgtagtttgttgcaggcgtccgggcttggtcgtatgaaaccaaacaccctggttataggatacaagaaaaattggcggaaggcccccctcactgagattgaaaactacgtcgggatcatccacgacgcttttgactttgagatcggggtggtcattgtgaggatttcacagggattcgacatcagccaggtcctccaagtgcaagaagagctggaaagattagaacaggagaggctcgctctcgaagccaccatcaaggacaacgagtgcgaggaggaatctggaggaatccggggtcttttcaagaaggcgggaaagctcaatatcactaagacaacccctaaaaaggacggaagtatcaatacatctcagagcatgcacgttggggagtttaatcaaaagcttgtggaggcttctacacagtttaaaaaaaaacaggagaaggggaccatcgatgtgtggtggctctttgacgacggagggctgaccctgttgattccatacatcctgacattacggaagaagtggaaggactgtaagctgcggatttacgtcggcggcaaaatcaatagaatagaggaagaaaagattgtgatggcctcactgctcagtaaattcaggattaaatttgccgacatacacattatcggagatataaatatccggcctaataaagagtcgtggaaagtgttcgaggagatgatcgaaccctaccggttacacgaatcctgtaaggacctgacaacagccgaaaagctgaagcgggagaccccctggaagataactgatgcagagcttgaagccgtcaaggaaaagtcctaccgtcaggttcgtctcaatgagttgctgcaagagcattcccgggcggctaatcttattgttctgagtctgccagttgcgaggaagggttcaatctcggacctgctgtacatggcttggttagagatcttgaccaagaacctgccccctgtgttgcttgttcgaggtaatcataagaatgtcttgactttttattcc

SEQ ID NO: 251083 - DNA, 3297 bp, Artificial Sequence
  Description of Artificial Sequence: Synthetic coding sequence
atgtcactcaacaacagctcaaatgttttccttgactcggtcccttccaacacgaaccgcttccaagtgtctgtgatcaacgaaaaccacgagtccagtgcggcagccgacgacaacaccgacccgccacattacgaggagacttcgtttggggacgaagcgcaaaagcggctcagaatctccttcagaccaggcaatcaggaatgttatgataacttcctgcaatcaggggaaaccgccaaaaccgacgcctcgtttcatgcctacgactcacacacgaacacctactaccttcaaacgttcggacataataccatggacgcggtacctaagatcgaatactaccgcaacactgggagcatctcgggcccgaaggtgaatcggcctagcctccttgagatccacgaacagctcgcaaaaaacgttgccgtgactccgagttccgcggatcgcgttgcaaacggtgacggaatcccgggcgatgagcaagcggagaataaggaagatgatcaggctggagtggtgaagttcggatgggtgaaaggagtgttggtgcgttgcatgttgaacatctggggtgtgatgctgttcatccggctcagctggatcgtgggagaggccggcataggcctcggtgtgatcatcattgggctgagcgtggtcgtgaccaccctgaccgggatctccatgtccgcgatttgtaccaacggtgtcgtgcgagggggcggggcttactacctgatctcacggagcctgggaccggagttcggtggctcgatcggactgatcttcgcatttgctaacgcagtggccgtcgctatgtacgtggtcggattcgcagaaaccgtggtcgatctgctcaaagaatctgattctatgatggtggacccgactaacgatatccggatcatcggatcgattaccgtggtgatccttctcgggatatccgtggcgggcatggagtgggaggcgaaggcacaggtgatcctgctggtgattctcctcatcgccatcgctaactttttcatcgggacggtgattccaagtaacaatgagaaaaagagcagaggatttttcaattaccaagccagcatcttcgccgagaatttcgggccaagattcactaagggagaaggtttcttttcggtgttcgcgattttcttccctgccgccaccggcatcctcgcgggtgccaatatctcgggagatctcgaggacccacaagacgctatccccaggggtactatgctcgctattttcatcaccaccgtggcctaccttggagtggcgatctgcgtgggcgcgtgcgtggtccgcgatgccaccggaaacatgaacgacaccatcatctcaggaatgaactgcaacggatcggcggcctgcggacttggatacgatttctcacgctgccgtcatgagccttgccagtacggccttatgaataactttcaagtcatgtccatggtgtcaggattcggacctctgatcactgctggcatcttctcagccacgctgtcctccgcactggcctcgctcgtcagtgctccgaaagtgttccaggcgctgtgcaaagacaacatttacaaagccctgcagttcttcgcaaagggatacggaaagaacaacgaaccactgagaggctacatcctgaccttcttgatcgccatggcgttcatcctgatcgcagaactgaatactatcgcccccatcatatcaaatttctttctggcctcgtacgcgttgatcaatttcagctgcttccacgcaagttacgccaagagcccaggatggcgccccgcctacggaatttacaacatgtgggtgtcgctgttcggggccgtcctgtgttgtgccgtcatgttcgttatcaactggtgggcggccgtcatcacctacgtgatcgaattctttctctatgtctatgtgacctgcaagaagccggacgtgaattggggttcgagcactcaggccctgagctacgtctctgcactggataacgctctcgaattgaccactgtcgaggaccacgtgaagaacttcagaccccagtgcatcgtgctcaccggagggccgatgaccagaccggcgctcctcgatatcactcacgctttcactaagaactcaggactgtgtatctgttgcgaggttttcgtcggaccgcgcaagctctgcgtgaaggaaatgaattcaggaatggccaaaaagcaggcttggctgatcaaaaacaagattaaggctttttacgctgcagtggccgccgactgcttccgcgacggagtccgctcactcctgcaagcctccggcctcggaaggatgaagccaaacactctggtgataggatacaaaaagaactggcgcaaggccccgcttacggaaattgaaaactatgtaggaattatccacgatgcgtttgacttcgagatcggtgtggtcatcgtgcggatctcacagggcttcgatatctcgcaagtgttgcaggtgcaggaggaattggagcgcctcgaacaggagcggctcgcactggaagccactatcaaggacaatgaatgcgaagaagaatccggtggaattcggggactgtttaagaaggctggaaaactgaatatcactaaaactactccgaaaaaggatggaagcatcaacacttcgcagtccatgcatgttggtgaattcaatcagaagctggttgaagcgtcgacccaattcaaaaagaaacaggagaagggcaccatcgacgtgtggtggctgtttgacgacgggggcctgactttgctcatcccatatatccttactttgcggaagaagtggaaggactgtaaactgcgcatctacgtgggagggaagatcaatagaattgaggaggaaaagatcgtcatggcaagcctgttgtcgaagtttaggatcaaatttgcggatatccacatcatcggggacatcaacattcgaccgaataaggaatcgtggaaggtgttcgaagaaatgatcgagccctaccggctgcacgagtcctgcaaggatttgaccaccgcggagaagctgaagcgagaaaccccttggaagataacggacgccgaactcgaggctgtgaaagaaaagtcctaccgacaggtccgcctgaacgagctgttgcaggaacattccagggcagcgaatcttattgtcctctcgctgccggtggcaagaaaaggcagcatcagcgacctcctctacatggcctggctcgagatactgactaagaacctgccgccggtgctgctggtgaggggcaatcacaaaaacgtgctcactttttactca

SEQ ID NO: 251084 - DNA, 3297 bp, Artificial Sequence
  Description of Artificial Sequence: Synthetic coding sequence
atgagcctgaataatagtagtaatgtctttcttgattctgtgccctccaacaccaatcgatttcaggttagcgtgatcaatgagaaccacgagagttccgccgctgccgacgataacaccgaccctccacactatgaagagaccagctttggcgacgaagcgcagaaaagactgcgcattagcttcagaccaggcaatcaggagtgttacgataactttctgcaatcaggagagaccgccaagacagatgcttcctttcatgcatacgacagtcatacaaatacctattatttgcagacctttggtcacaatactatggacgcggtaccaaaaatcgagtattaccgaaacaccggctctatatcaggtccaaaggtcaatcgcccctccttgctggagatacacgagcagttggctaagaatgttgccgtaacaccctctagtgccgacagggtcgcaaatggggacgggattcctggcgacgaacaggccgagaataaggaggatgaccaggccggggtagtgaaattcggttgggtaaagggagtgcttgttcgatgtatgctcaacatatggggagtgatgctcttcattcggctaagttggattgtgggtgaagcgggtattggtctcggggtgattatcatcggactgtctgtggtggtcacaactctcactggtatttctatgagtgcaatctgcacaaatggggtggtgagaggaggtggagcgtactacctgatttctcgctctctcggccccgagttcggaggctcgatcggacttatcttcgcttttgcgaacgcggtggctgtggctatgtacgtcgttggatttgccgaaaccgttgtggaccttctcaaagaatccgactcaatgatggttgatcctaccaacgatattcgtataattggctcaatcactgtggtgattttactcggtatctcggtcgcagggatggaatgggaggctaaggcccaggttatcttgcttgtaattctgctgattgccattgctaatttctttattggcacagttatcccttctaataacgaaaaaaagagccgcggattcttcaattatcaggcaagcattttcgcagagaacttcggccctaggttcactaagggggaaggctttttcagcgtcttcgcaatcttttttcccgcagccaccggcatactggctggggcaaatattagtggtgaccttgaggacccgcaagacgctattcccaggggcacaatgctcgctatcttcattaccactgtcgcctacctgggagtggccatctgtgtaggagcatgtgtggttcgcgatgcgacaggcaatatgaatgacacaataatctctggcatgaactgtaatgggtcggccgcttgcggccttggatacgacttctcccggtgccgccatgagccttgtcagtacggactgatgaataactttcaagtcatgagtatggtctctggattcggcccacttattactgcgggcatcttctcggccactctgagtagcgcactggcaagcctggtctctgcacccaaagtgttccaggcactttgcaaggacaatatatataaagccctgcaatttttcgctaaaggttatggaaagaacaatgaaccgctccgggggtatattctcacattccttatagccatggccttcattttgattgccgagctgaacactatcgctcccataatttcaaacttcttcttggcatcttacgccctgataaatttcagctgctttcatgctagctatgctaagtctcccggatggaggcccgcctacggcatatataacatgtgggtgtcactgttcggggccgtactatgctgcgcagtgatgttcgtaataaactggtgggctgctgtgatcacctatgttatcgagttttttctctatgtctacgttacctgtaaaaagcccgatgtcaattggggcagctctacccaggcactgagttatgtgtcagcacttgacaatgcgcttgaattgactacagttgaggatcacgtgaagaactttcgtccacagtgcattgttctgactggaggacctatgacccgacccgcccttctggacatcacccacgccttcactaaaaactcaggactgtgtatctgctgtgaagtatttgtcgggccgcggaaattgtgcgtgaaagagatgaactcaggtatggctaaaaagcaggcttggctgattaagaataaaatcaaggctttctacgcggctgtcgcggcagattgttttcgcgacggtgtgaggagcctgctacaggcatcgggcctcggaaggatgaagcctaacactttggtcataggctacaagaagaactggagaaaagcacccctgaccgagatagagaattacgtgggcatcattcacgacgcgttcgacttcgagatcggagtggtcatcgtgaggatcagccagggcttcgacatttcacaggtgcttcaggtacaagaagaactggagcgcttggaacaggaaagattggcactcgaggccacaatcaaggacaatgagtgcgaggaagagtccggtggtatccgtgggctttttaagaaggccggaaagctcaatatcaccaagacaacacccaaaaaggatggctctatcaatacttcccagtccatgcacgtcggcgaattcaaccagaaactcgtggaagcctcaacacagtttaagaagaagcaagagaagggcaccatcgatgtttggtggctctttgatgacggcggtctgactctcctgataccatacattctgacattacgaaaaaaatggaaggactgcaaactgcggatttatgtgggcgggaagatcaataggattgaggaagagaagattgtgatggcaagcctgttgtctaaatttagaatcaaatttgctgatatccacatcatcggtgatattaacatccggcccaataaggaatcttggaaggtgttcgaagaaatgattgagccgtaccggcttcacgagagctgtaaggatctgaccaccgcggaaaagctgaagcgagagaccccgtggaagatcactgacgctgaactcgaagccgtcaaggagaaaagctatagacaggtcagactgaatgaactgctgcaggagcacagtcgggccgccaatctgattgttttgagtctgcctgtcgctcgcaaggggagtataagtgacctgctttacatggcctggctggagatcttgaccaaaaatctgcctcctgtgctgctcgttagagggaatcataaaaacgtattgaccttctacagc

SEQ ID NO: 251085 - DNA, 3297 bp, Artificial Sequence
  Description of Artificial Sequence: Synthetic coding sequence
atgtccttgaacaattcatctaacgtctttctggacagcgtgccatccaacacaaacaggtttcaggttagtgtaattaacgagaaccacgaaagtagtgccgcggccgacgacaatacagatcccccccattatgaagaaactagttttggggacgaggcccagaagcgactgcggatctccttccggccaggtaaccaggagtgttatgataactttttgcagtctggcgagaccgctaaaactgacgcttccttccatgcatatgactcacacaccaatacgtactatctgcagacctttgggcacaatactatggacgcggtaccaaaaatcgaatactacagaaataccggatctatcagcggccctaaagttaaccggccttcgctgttggagatccatgaacagttagccaaaaacgtagccgtgactccatcttcggccgatagagtggctaatggagacggcatccctggggacgagcaggcagagaacaaggaggatgaccaggccggagtcgtcaaattcggatgggtgaagggagtcctggtgcggtgtatgcttaacatctggggtgtgatgctttttattcgcctttcatggatcgtgggcgaggccggcatcggtctgggcgtaattatcattggactgtcagtcgtcgtgaccacccttacaggtataagtatgagcgcgatctgtaccaacggggtggtgaggggaggcggggcttactatctgatatcccgctccctgggccctgaattcggcggcagtatcggcttaatctttgcctttgcaaacgctgtggcggtggcaatgtatgtggtgggtttcgcggaaacagtagtggacctgctaaaagaatctgactccatgatggttgatccaaccaatgacattagaattatcggctctatcactgtggtcatacttctcggaattagcgtggcgggtatggaatgggaagcgaaagctcaagttatacttctggtgattctcttgatagccatcgccaattttttcatcggcaccgtgattcctagtaataacgagaaaaagtctcgtggattttttaactatcaagccagcatttttgctgagaatttcggtcccagattcactaaaggcgaagggttctttagcgtgtttgctatctttttccctgcagcgactggcatcctggcaggggcgaatatatctggagatctggaagacccccaggatgccatacccagaggaaccatgctggcaatattcatcacaaccgtggcctacttgggagtggccatttgtgtcggagcatgcgtagtcagagatgcgaccggaaatatgaacgacactattataagtggaatgaattgcaacggcagcgcggcttgtggactgggctacgactttagtcggtgtaggcacgagccctgccagtacggcctgatgaataatttccaggttatgtctatggttagcggatttggaccgctgataactgccggtatattctccgcaacactctcgtcagctctggcgagccttgtctccgcccctaaagtgtttcaagcgctgtgtaaagataacatctacaaagctctccagttctttgcgaaggggtatggaaagaacaacgaacccttgcgggggtatattctgacctttctaatcgccatggcgtttatcctgatcgcagagctgaatacaatcgcccccatcatttctaacttttttctcgcaagctatgcactcattaatttcagctgcttccatgcctcctatgcaaaatctcctggctggcgcccagcctacggcatttacaatatgtgggtgagcttgtttggtgcagtactatgttgtgcggtcatgttcgtcattaattggtgggccgctgtaattacttacgtaatcgaattctttctctatgtctatgttacgtgcaaaaagccagacgttaattggggctcctcaacccaggccttaagttacgtgagcgcactagataacgcgctggagttgacgacagtcgaagatcacgtaaaaaactttagaccgcaatgtatcgttctgaccggagggcctatgacacgccctgccctactggacataactcacgccttcaccaagaacagcggcctgtgtatatgctgcgaggtgttcgtcggcccaagaaagctctgtgtcaaagaaatgaacagcggcatggctaagaagcaggcgtggctcatcaagaacaagatcaaagccttttacgctgctgtggcggctgattgttttagggacggagttaggagcctcctgcaggcatcgggactgggtcgaatgaagccaaacacactggtaattggctataaaaagaactggaggaaggctccattgacagaaatcgaaaattacgttgggataatccatgatgcttttgactttgagatcggggtggtgatagtaaggatatcccagggtttcgacatctcacaggttctacaggttcaggaagaactggaacggctggagcaggaacggctggccctcgaagccaccattaaagacaatgagtgcgaggaggaatctgggggcataagggggctgttcaaaaaggcaggtaaactgaatatcacgaaaaccacccctaagaaagacggctccatcaacacctcccagagcatgcatgtgggcgagttcaaccagaagctggtcgaggcatccacccagttcaagaaaaaacaggagaaagggaccattgatgtctggtggctctttgatgatggcgggctgaccttgctcattccctacatcctgactctacggaaaaaatggaaagactgcaagctgcgcatttacgtgggaggtaaaatcaatcgcatcgaagaagagaagatagtcatggcctcactattgagcaagtttaggattaaattcgccgatattcatattattggtgacattaacattcggccaaacaaggaaagctggaaagtgttcgaggagatgatagaaccttatcggcttcatgaatcttgcaaagatcttactaccgctgagaaactgaaacgggagacaccatggaaaattaccgacgccgagctcgaggctgttaaggagaagtcctatcggcaggtgcggttgaacgaactgctccaggagcatagtcgtgctgccaatttgatcgtgctgagcctgcccgtcgccaggaaggggagtatctctgacctcctgtacatggcatggctagaaatcctgacaaagaatctcccgcctgtcctccttgtgagggggaaccacaagaatgtcctgactttctactca

SEQ ID NO: 251086 - DNA, 3297 bp, Artificial Sequence
  Description of Artificial Sequence: Synthetic coding sequence
atgtctctgaataacagctccaacgtgttcttggactccgtgccttcaaacacaaacagattccaggtgtccgtgatcaatgagaaccacgaatcttccgctgccgctgacgataacactgatcccccacattacgaggagacctcctttggagatgaagctcagaaaaggttgcgtatttcctttagacccggcaatcaggagtgttatgataacttccttcagtccggcgagactgctaagactgatgcctccttccatgcttatgattctcacactaacacctattatctccagacctttggacacaataccatggatgcagtgccaaagattgaatactacagaaacaccggctccatttccggcccaaaagtcaaccgtccaagtctcctcgagatccacgagcagctcgccaagaacgtggccgtgactcctagctctgctgaccgtgtggcaaacggcgatggcatccctggcgacgaacaggctgagaacaaggaggacgaccaagctggagtggtgaaattcggatgggtcaagggagtcctggttcgctgtatgcttaatatttggggcgtgatgctcttcattaggctgagctggattgttggtgaggctggaatcggactgggcgtgatcatcattggtttgtctgtggtggtcaccaccctgacaggaatcagtatgtcagcaatctgcactaatggcgtcgtgaggggaggcggtgcctactacctgattagccgcagcctgggccctgaattcggaggttcaattggcttgattttcgctttcgccaatgcagttgctgtcgccatgtacgtcgtcggcttcgccgagactgttgtagacttgttgaaggaaagtgactcaatgatggtcgaccctaccaatgatattagaataataggatccattacagtagtgatcttgctcggtatcagcgtggccggaatggagtgggaagctaaggcccaggttatccttctggtcattctcctcatcgccatcgccaactttttcatcggaacagtcatccctagcaacaatgagaagaagagcaggggttttttcaactaccaggcttccattttcgctgaaaattttggtcctcgcttcactaaaggtgagggtttcttctctgtcttcgccatattctttcccgctgccaccggtattcttgcaggtgccaatatctccggagacctcgaggatccccaggacgctatcccccgcggtactatgctggccatattcatcactactgtggcctatctgggcgtggccatctgtgtaggtgcctgtgtcgtgagagatgccacaggaaatatgaacgacactattatcagcggcatgaattgtaacggatccgctgcatgtggccttggttacgatttctccaggtgccgccacgagccttgccaatacggcttgatgaacaactttcaggtgatgtccatggtatctggatttggacctctcattaccgccggaattttctcagccactcttagcagtgccctggctagcctggtaagtgctccaaaggtgtttcaggctctgtgcaaggacaacatctataaggcactgcaattctttgcaaagggctatggcaagaataatgagccactcagaggctacatcctgactttcctgatcgctatggcctttatcctgattgctgagctgaacaccatcgccccaataatcagcaacttctttcttgctagctacgctcttatcaatttcagctgtttccacgcatcatatgccaagtcccctggttggcgccctgcttacggtatttacaacatgtgggttagcctcttcggcgctgtgctctgttgcgccgttatgtttgtcattaattggtgggccgcagttatcacatacgtaattgagttcttcctgtatgtttatgtcacctgtaagaagccagatgtgaactggggttcaagcacccaggcattgtcctatgttagcgcactggataatgctctggaactgaccaccgtcgaggaccacgtaaagaacttcaggccccagtgtatcgttctgaccggaggcccaatgactcgtcctgctctgcttgacatcacccacgcatttactaagaacagcggactgtgtatctgctgtgaggtgtttgttggaccacgtaagctctgtgtgaaggagatgaatagtggaatggccaaaaaacaggcttggctgatcaagaataagataaaggccttctacgctgctgtggctgctgactgcttccgcgatggagtgaggtctcttctgcaggccagtggcttgggtcgtatgaaacctaataccctggtcattggatataagaagaactggaggaaggctccattgacagagatcgaaaactatgtgggaatcattcacgacgccttcgatttcgagatcggagtcgtcattgtacgtattagccagggatttgatatttcccaggtcctgcaggtgcaggaggagctggagagacttgagcaggaaaggctcgctcttgaggccaccatcaaagacaatgaatgcgaggaggaatctggcggtattcgcggactcttcaagaaggccggtaagcttaacatcacaaaaaccacaccaaagaaggatggcagtatcaacacttcacaatccatgcatgtgggtgaatttaaccaaaaactcgtggaagcctctactcaatttaagaagaagcaggagaagggaactattgatgtgtggtggctgttcgacgatggtggtctgacattgctcatcccatacatccttaccctccgtaagaagtggaaagactgcaaattgagaatttacgtgggcggtaaaataaaccgcatcgaagaggaaaagattgttatggcttccctgctgtcaaagttcagaatcaagtttgcagacatacatataatcggtgatatcaatatacgtcctaataaggaaagttggaaggtcttcgaagaaatgatagagccttacaggttgcacgagtcatgcaaggacctcaccacagctgagaagctcaagagagagaccccctggaaaattaccgacgccgagttggaggctgtaaaagaaaagtcttaccgccaagtaaggttgaacgagcttctccaagagcattcaagggcagctaacttgattgtgctcagccttccagttgcccgtaagggcagcatctccgacctgctgtacatggcatggttggagatcttgaccaagaacttgccacccgtgttgctggttcgcggcaaccacaaaaatgtgctgactttttacagc

SEQ ID NO: 251087 - DNA, 3297 bp, Artificial Sequence
  Description of Artificial Sequence: Synthetic coding sequence
atgagcttaaacaattcctccaatgtgtttctggacagcgtaccttctaataccaatcgtttccaagtaagcgtgataaacgaaaaccacgagtccagtgctgccgccgatgacaatacggacccacctcactacgaggaaacatctttcggcgatgaagctcagaaacgtctgcgcatctccttccggccgggaaaccaggaatgttacgacaacttcctgcagagtggagaaaccgccaagacagacgctagctttcatgcttatgattcacacaccaacacgtactatctgcagaccttcgggcacaatactatggacgcagtgcccaaaatcgagtactacagaaataccgggtcaattagtgggcctaaggttaaccgacccagccttcttgagatccacgagcagctagctaagaatgtggctgtgactccctctagcgcagatagagtggccaatggtgatggtatcccgggagacgagcaggcggaaaataaagaggacgaccaggcgggcgtggtcaaattcggctgggtgaagggcgtcttggtgaggtgtatgctcaatatctggggtgtgatgctctttattaggttgtcatggattgtcggcgaggccgggatcgggctgggggtgataataatcggattatccgttgtagtgactacgctgacgggaatcagcatgtctgctatatgcaccaatggggtggtgcgcggagggggagcttattatttaatatcccgcagcctggggcccgagttcgggggtagtatcggactgattttcgcattcgccaatgcagtagctgtggccatgtatgtggtgggattcgccgaaactgtagtggatctgttgaaggagtctgacagcatgatggtggaccccaccaatgatatccgaattatcggctccatcactgtcgttatactgctgggcatctccgtggccgggatggaatgggaagccaaggcccaggtaattttacttgttatcctactcattgcgattgctaatttcttcattggtactgttattcctagcaataacgaaaagaagtcccgcgggtttttcaattatcaagctagcatctttgctgaaaacttcggaccacggttcacaaaaggggagggcttttttagcgttttcgccatttttttcccggctgccacgggcattctagcaggagctaacatatctggggacctggaagatccgcaggatgcgattccaaggggcacaatgctggcaatctttattaccacagttgcatacttgggcgtagccatctgcgtgggggcgtgcgtggtgagggacgcaacaggaaacatgaatgacaccatcatttccggaatgaactgcaacgggtctgcagcatgcggactcggttacgatttctcacggtgccgccatgaaccttgtcagtacggtctgatgaacaattttcaggtaatgtccatggtgagcggctttggcccactgattacggcgggcatattttctgctaccctctcctccgccctcgcttcactggttagtgcacctaaggtcttccaggctctgtgcaaggacaacatttataaggcattgcaattcttcgccaaggggtacggaaagaataacgaaccgcttaggggctatattctaacctttctgatcgccatggcttttattttgatcgccgagctgaatactatcgctccgatcatctctaacttcttcctcgcatcctacgcattaataaacttcagctgctttcacgccagttacgccaagtcccccggttggcgtcccgcctatggcatatacaatatgtgggtgtccctgttcggcgccgttctgtgttgcgccgtaatgtttgtgataaattggtgggccgccgtgatcacgtacgtgatcgaattttttttgtacgtgtacgtgacttgtaagaaaccggacgttaattgggggagtagcacccaggccctgagttacgttagtgctctggacaacgctctcgagctaactaccgtggaagaccatgtcaagaatttccgtccccagtgcatcgttttgacaggtggaccaatgacgaggccagccctgcttgacatcactcatgctttcaccaagaactccggcctgtgtatttgctgtgaggtgttcgtgggcccaaggaagctgtgtgtgaaggaaatgaatagtgggatggcaaagaaacaagcgtggctaatcaaaaacaagatcaaggcattctatgccgcagttgctgctgattgcttccgagatggggtgcgaagcctccttcaagcaagtggccttggccggatgaaaccaaatactctggtgatcggatataagaagaattggaggaaagccccactgacggagattgaaaattacgtaggcattatacacgatgccttcgactttgaaattggggtagtgatagtccgtatctcccaggggtttgatatctcacaagttctacaggtgcaggaggaattagagcgactggaacaagagcgactggcactagaggccacgatcaaggataacgagtgcgaagaggagtccggtggtatacgaggcctattcaagaaagccggaaaactcaatattaccaagactactccaaaaaaggacgggtccatcaacacttcacagtccatgcacgttggggaattcaatcagaagcttgtcgaagcatctactcaatttaagaagaagcaggaaaaaggtaccattgacgtgtggtggctgttcgatgatggagggctgactctgctaataccgtatatactcaccctgaggaagaaatggaaagattgcaaactgagaatctacgtcgggggcaagattaaccggatagaggaagaaaagattgtgatggcgagcctgttgtcaaagttcaggataaaatttgcagatattcatataatcggagacatcaacatcaggccaaataaagaaagctggaaggtgttcgaggaaatgatagagccctaccgactgcatgaatcctgcaaagatcttacgaccgcagagaaactaaaaagagagaccccgtggaaaataacagacgccgagttggaagccgttaaagagaaatcttatcgccaggtgcgcctcaatgagcttctacaggagcatagtagagctgctaatctcatagtgctatccctccctgtggcaaggaaaggttctatatccgatctgctgtatatggcttggctggaaatcctcactaagaacttgccacctgtcttgttagttaggggcaaccataagaatgtactcaccttctacagt

SEQ ID NO: 251088 - DNA, 3297 bp, Artificial Sequence
  Description of Artificial Sequence: Synthetic coding sequence
atgtccctgaacaattcaagcaacgtgtttctggacagcgtccctagcaacaccaatcgtttccaggtgtcagtgattaatgagaaccatgaatcatcagcagctgcagacgataacaccgatcctcctcattacgaggaaacttccttcggagatgaggcccagaaacgccttaggatatccttcaggccaggaaaccaagagtgctacgacaactttcttcaatccggtgagactgccaaaaccgacgcatcgttccacgcgtacgattcgcacactaatacgtactacctgcagacgtttgggcataacaccatggacgcagtgccaaagattgaatactaccgtaacaccggatccatttccggcccaaaggtcaacagaccttcacttctggaaatccacgaacagcttgcaaagaatgtcgcagtgactccatcatccgcggaccgggtcgcaaatggcgacggaattcccggtgatgagcaggcagagaacaaggaagatgaccaagcaggggtggtgaagtttggatgggtgaagggtgtgcttgtgaggtgtatgcttaacatttggggtgtgatgctgtttatacgcctgtcgtggattgtgggagaagctggtattggtcttggagtcattatcattggactgtccgttgttgtgaccaccctcactggtatttcgatgtcggcaatttgtactaacggggtcgtccggggtggaggggcctactacttgattagcaggtccctcggtcccgagtttggcggatcgatcggactcatttttgcattcgcgaacgctgtcgcagtggcaatgtacgtggtgggtttcgcagaaacggtcgtggacctccttaaggaatcggactcgatgatggtggatcctactaacgatattcgcataattggttcgattactgtggtgattctccttggtatttccgtggcaggaatggaatgggaagcaaaagcccaagtgattctcctggtgattctgttgatcgcgatagctaactttttcataggaactgttattccaagcaacaacgagaaaaagtcaagggggtttttcaactaccaggcatcgatctttgcagaaaactttggccccagattcaccaaaggtgaaggatttttcagcgtctttgccatcttcttccctgcagccactggcattctcgcaggagcgaacatctccggcgatcttgaagatcctcaagacgcaattcctcgcggcaccatgcttgcaattttcattactaccgtcgcatacctgggagtggcgatttgtgtgggagcctgcgtggtgagagatgcaactggaaacatgaacgacactatcatatcaggcatgaactgtaatggatccgccgcgtgcggactgggttacgatttctcccggtgtcgccacgagccatgtcagtacggtttgatgaataactttcaagtgatgtccatggtgagcggttttggccctcttattaccgcagggatcttttcagcaactctgagctcggccctggcatccctggtgagcgcccctaaggtattccaggccctgtgcaaggataacatctacaaggccctccagttttttgcaaaaggatacggaaagaataacgaaccactccgtggctacatcctgacgttcctgatcgcaatggcctttattcttatagccgaactgaacacgattgcgccaatcatctccaacttttttcttgcatcgtacgcattgatcaacttttcgtgctttcatgcctcctacgctaagagcccagggtggcgcccagcctacggcatatacaacatgtgggtgtcccttttcggggcagtcctttgttgtgccgtgatgttcgtgattaactggtgggcagcagtgattacttacgtaattgaattctttctgtacgtgtacgtcacttgcaaaaagcctgacgtgaattggggatcgtccactcaggcactcagctacgtgtctgcacttgataacgcacttgaactcaccaccgttgaagatcatgtcaagaacttccgacctcagtgtatcgtgctgactggcggacctatgacccgcccagcgctgcttgatattacccatgcttttaccaagaacagcggtttgtgtatatgctgtgaagtgtttgtgggtcctagaaagctgtgcgtgaaggaaatgaattcgggaatggcgaagaagcaggcctggctcatcaagaataagatcaaggcattttacgcagccgtggccgcagattgtttccgagatggagtgaggagcctcctgcaagcatcaggtctgggccgcatgaaacccaatactcttgtcattggctacaagaaaaactggcgaaaggcgccgcttactgagattgaaaactatgtgggtatcatacatgacgcatttgatttcgaaataggcgtggttattgtgcgcattagccagggctttgacatctcgcaggtgctgcaagtccaggaagagctggaacggcttgaacaagagcgtctggccctcgaggcaacgatcaaagacaacgaatgtgaggaagagtcgggcggcattagaggtctgttcaagaaggcaggaaagctgaacatcaccaaaactaccccgaaaaaagatggaagcattaacacctcgcagtcaatgcatgtgggagagttcaaccagaagctggtcgaggcatccacccagttcaagaagaagcaagagaaagggacgatcgatgtgtggtggctcttcgatgacggtggacttaccctgcttataccctacatactgactctccggaagaaatggaaggactgcaagctccgtatctacgtggggggaaagattaacaggattgaagaagaaaagattgtgatggcctcgcttctctcaaaattcaggatcaaatttgcagacatccatatcatcggcgacattaacattcgacccaacaaggaatcctggaaggtgttcgaagaaatgatagaaccatacagactgcatgaatcgtgtaaggatctgaccacggcggaaaagctgaagagagaaactccgtggaaaatcaccgatgctgagctcgaggcagtcaaagaaaagtcctaccggcaggtgcgcctgaacgaactccttcaggaacattccagagcggcaaacctgattgtcctgtcgctgcctgtggcacgaaaggggagcatttccgaccttctctacatggcatggttggagatccttaccaagaacttgcctccagtgcttcttgtccgtggcaaccataagaatgtgctgacgttctactca

SEQ ID NO: 251089 - DNA, 3297 bp, Artificial Sequence
  Description of Artificial Sequence: Synthetic coding sequence
atgagcttgaacaattctagcaacgtgttcctcgattctgtaccctctaacacgaatagatttcaggtcagtgtgataaacgagaaccacgaaagcagtgcggcagcagatgacaataccgatccaccccactatgaggagaccagctttggtgatgaagcccagaaacgcttgcgcatttcttttcgtccgggcaatcaggaatgctatgataacttcctccaaagtggagagaccgctaaaactgacgctagcttccacgcctacgacagccatactaacacctactacctgcagacgtttggccataacacaatggatgccgtgcccaagatcgagtattatcgaaataccggatccatctctgggcccaaagttaaccggccctcacttcttgaaatacacgagcagctggctaagaacgtcgccgtgacaccctccagtgcagatcgcgtagccaacggagacggaattcctggagatgaacaggccgagaacaaggaggatgatcaggcaggtgtggtgaaatttggatgggtcaaaggggtgctggtccgctgtatgctaaatatctggggtgtgatgcttttcatcagattgagctggattgtcggggaggccgggattggcctcggagttattatcattgggctgtcggtggtggtgacaacgctgacgggcatctcaatgtctgcgatttgcactaacggtgtggtccgaggcggcggagcttattatctgataagtaggagccttggacccgagttcggtggctcaatcgggttgatctttgcattcgcaaacgccgtggctgtggccatgtatgtcgtcggcttcgccgagacggtggtagacctgctgaaagagtcggactccatgatggtggatcctactaacgatattaggataatcggatctatcacagtggtcatactgctcggaatatccgtggccggtatggaatgggaagcaaaagctcaggtcatcctgcttgtgattctcttgattgcgatcgccaatttctttatcggcaccgtaatcccatctaataacgaaaagaaatcgcgcggttttttcaattaccaggcgagtatatttgccgaaaactttgggccgcgtttcacgaaaggagaggggttcttttctgtgttcgcaatctttttccctgctgcgactggcatcctcgccggggcaaacatatccggggatttagaagatcctcaggacgccatacctagagggactatgctggccattttcatcacaactgttgcctacttgggagtcgccatctgtgtcggcgcttgcgttgtcagagatgccacggggaatatgaacgacacaatcatatccgggatgaactgtaatggtagtgctgcctgcggattggggtacgacttcagcagatgccgccatgagccgtgccagtatgggctgatgaacaactttcaagtaatgagtatggtgtctggatttggacccctaatcacggctggcatttttagcgccactctgagttcggccctggcctcattagtgagcgctcctaaagttttccaggccctctgtaaggataatatctacaaagcattgcagtttttcgcaaaggggtatggtaaaaataatgagcccctccgaggatatatcctgacgtttctgatcgccatggccttcattttaatagctgagctgaatactattgcgccgattatcagtaacttcttcctggcatcctacgccctcatcaacttcagctgcttccacgcttcatatgctaagtcccctggctggaggcccgcatacgggatttacaatatgtgggtatccctattcggggcagtgctctgttgtgcagtgatgtttgtcataaattggtgggccgcggtgatcacatacgtaatagaattttttttatacgtttacgtaacatgcaagaaacccgacgtgaattggggctctagtacccaggctctgagttacgtgtcggccctggataacgcgctcgaacttacaacggtcgaggaccacgtgaagaattttaggcctcagtgtattgtgctcacaggtggcccgatgacccgcccagccctgcttgacatcacacatgcgtttacaaagaattccggtctgtgcatctgttgtgaggtttttgtgggtcccagaaaattgtgcgtgaaggagatgaattccggaatggctaaaaagcaggcttggcttatcaagaacaaaatcaaagcattttatgcagccgtggcagccgactgctttagggatggggtcaggagcctattgcaggctagtggattgggcagaatgaagcccaatactctcgtcataggctacaaaaagaattggcgaaaggcaccactcaccgagattgaaaactacgtgggcataatacatgacgcgttcgacttcgagatcggagttgtgattgttaggatcagccagggtttcgacatcagccaggtactgcaggtccaggaggaacttgaacggttagaacaggagagattagcgctggaggctaccattaaggataacgagtgtgaagaagagtccggaggtatacgcgggcttttcaaaaaagcaggcaagctaaacattaccaagaccacccctaagaaagacggaagcattaatacatcccagtctatgcacgttggcgagttcaaccagaaattagtggaagcctctacacagttcaagaaaaagcaggaaaaggggactatcgatgtctggtggctgtttgatgacggcggacttactctgctgattccttatatactgacgctgcggaaaaagtggaaggactgcaaattgaggatttacgtaggtggaaagatcaacagaatagaggaagaaaagatcgtaatggcctcattgctgtctaagtttaggataaagttcgctgacatccatattataggagacattaacattcgcccgaataaggaaagttggaaagtttttgaagaaatgattgagccctacaggctacatgagtcttgcaaggacctcacaacagcagagaagctgaagagggaaactccatggaaaatcaccgacgccgaactggaggcggtgaaagagaagagttaccgccaggtgcgcctaaacgaactgctgcaggaacattcccgtgccgctaacctgatcgtcctcagtctgccagtggcacggaaagggtcaattagtgacctgttatacatggcgtggctcgagattctgaccaaaaatctgcctccagtgttgctagtgaggggcaatcataaaaacgtcctcacattttattcg

SEQ ID NO: 251090 - DNA, 3297 bp, Artificial Sequence
  Description of Artificial Sequence: Synthetic coding sequence
atgtccttgaacaacagctcaaatgtcttcctcgactctgttccaagcaatactaacaggtttcaggttagcgtaatcaacgagaatcatgaatctagcgcggctgccgatgataacacggatcctccacattacgaggaaacaagtttcggcgacgaagcccaaaagcgattacgtatctcattcaggcccgggaaccaggagtgctatgataatttcctgcagagcggtgaaactgccaagaccgatgcctccttccatgcctatgattcccacaccaatacctactatttgcagacgttcggccataatacaatggatgctgtcccgaagatcgaatattatagaaacactgggtcaatcagcggtccaaaagttaaccgaccttctttactcgagatccacgaacaactagcaaagaacgtcgctgtaaccccttcttcagccgaccgcgtcgctaatggcgatggaattccaggggatgagcaagccgagaacaaggaagacgatcaggccggggtcgtgaaattcgggtgggtgaagggagtgttagtacgatgcatgttgaatatatggggagtcatgctcttcatcaggctgagctggatcgtaggtgaagctggcattggtcttggcgtgatcattattgggctctccgtagtcgttaccaccctcacagggatcagcatgagtgctatctgcacaaatggcgtagtgcgcggagggggtgcttattatttaatctctcgtagcctgggacctgaatttgggggctccatcggactaattttcgcatttgccaacgctgtagcagtggccatgtacgtggtcggattcgctgaaaccgtggttgacttgctgaaagagtcagattccatgatggtcgatccaactaatgacattagaataataggtagtatcaccgttgtgattctgcttggcatctcagtagcaggcatggagtgggaggccaaggcacaggtcattttgctggtgatcctactcatcgccatcgctaacttcttcataggaactgtgattcctagcaacaacgagaaaaaatctcgcgggttctttaactaccaagcgtctatctttgccgagaacttcggccccaggttcacaaaaggggagggcttttttagcgtctttgccatatttttccccgctgctactgggatcctcgctggtgccaatatatcaggggatttggaggatccgcaggacgccatacctagagggactatgttggccatattcattaccacagttgcttatttaggcgtcgccatctgtgtcggggcttgcgtagtgcgtgacgctaccgggaatatgaacgacactatcatctcaggtatgaattgtaatggttccgccgcttgtggtctcggatacgatttcagcaggtgccggcatgaaccgtgccaatacggcctgatgaataactttcaggtgatgtccatggtgtccggattcggtccattaataaccgctggtattttctcagccactcttagttcagccttagcaagcttagtaagtgccccaaaggtcttccaggcactttgtaaggataatatttataaggcactccagtttttcgccaagggctacgggaagaacaacgaaccgctgcgggggtatatcctgacgttcctcatcgccatggccttcatccttattgcagagctgaacaccattgccccgataatttctaacttcttcctggcctcctacgcgttgatcaacttttcatgtttccacgccagttatgccaaatcccctggttggagaccagcttacggcatttacaatatgtgggtctcactgtttggagcagttctgtgctgtgcggtcatgttcgtgataaattggtgggcagctgtgatcacttatgtcatcgaatttttcctgtacgtgtacgtgacatgcaagaaacccgacgtgaattggggctcctctactcaggctctctcctatgtcagtgcccttgataacgcccttgagttaactactgtggaggatcatgtgaagaatttccggccacagtgtatcgtactaacgggtggaccaatgacccggcccgccctcctcgacattactcacgctttcaccaagaacagcggtctgtgtatctgctgtgaggtgttcgtggggcctcgcaagctgtgcgtgaaggagatgaacagcggtatggctaaaaagcaagcttggcttatcaaaaacaagatcaaagccttctatgccgccgtggccgccgactgttttagagatggtgtccggtctctccttcaggcgagtgggctgggtcggatgaaacccaacactttggtgatcggttataagaagaattggcggaaggctcctctaactgaaatcgagaactatgtcggcataattcacgatgccttcgattttgagatcggggtcgtcatcgtgaggatcagtcagggctttgacatatcacaagtactgcaggtccaagaggagctggagcggcttgaacaggagcgtctcgccctcgaggccaccatcaaagacaacgagtgcgaagaagagagcggaggcatacggggactgttcaagaaggccggcaagttaaacatcaccaagacaacgcctaaaaaggacggctcgattaacacctcccagagtatgcatgttggcgaatttaaccagaagttagtggaggcaagtacccaatttaagaagaagcaggagaaaggcactattgacgtgtggtggctgtttgacgatgggggactcaccctgctgattccttatattttaacccttcgcaagaagtggaaggattgcaagctgcggatatacgtgggaggaaagattaataggattgaggaggaaaaaatagtgatggctagtctgttgagtaaatttcgaatcaagttcgctgatatccacatcattggtgatataaacatccggcccaacaaagaaagctggaaggtctttgaagagatgattgaaccgtatcggctgcacgagtcgtgcaaggacttgaccacagccgagaaactgaagagggaaaccccttggaagattaccgatgccgagctcgaggcagtaaaggagaaatcatatcggcaagtccgattgaatgagctcctccaggaacacagtagggccgccaatttaatcgtgttatctcttcccgtcgcgcgaaaaggtagcatttcagatttgctgtacatggcttggctggagatactgacgaagaacttgccacctgtgttgcttgtgcgtggcaaccataagaacgttcttacattttacagc

SEQ ID NO: 251091 - DNA, 3297 bp, Artificial Sequence
  Description of Artificial Sequence: Synthetic coding sequence
atgtcacttaacaacagctcgaatgtgtttctggacagcgtgccttccaacaccaatagattccaagtgtcggtcatcaacgaaaaccatgaatccagcgcagccgcagacgataatactgatcctccccattatgaggaaacctcctttggagatgaagcacagaaacgtctgcgcatatccttcagaccaggtaaccaagaatgttacgataactttctgcagtcaggggaaactgcgaaaaccgacgcctcattccatgcatacgattcccataccaacacctactacctgcaaacctttggtcataatacgatggatgccgtgcctaagatcgagtactaccgcaataccggctccatttccggaccaaaggtgaacaggcctagccttctggaaattcatgagcaacttgcaaagaatgtcgcggtgactccatcgtctgcagatcgcgtggcgaatggtgatggaatcccaggtgatgaacaagccgagaataaagaagatgatcaggcaggagtggtgaagtttggttgggtgaagggcgtgctcgtcaggtgtatgctgaacatctggggtgtgatgctgtttattcgcctctcatggattgtgggagaagccggcatcggcttgggagtcattatcatcggactgtccgtcgtggtcactaccctcactggaatatcgatgtccgccatttgtactaacggtgtggtgaggggtggaggtgcatactatcttatctccagaagcctgggtccagaatttggcggctcgattggcctcatttttgcatttgcgaacgcagtggcagtggcaatgtacgtggtgggattcgccgagactgtcgtcgatttgcttaaggaatcggattccatgatggtggatcccactaacgacatacggattattgggtcgatcactgtggtgatcctgttgggtatcagcgtggcaggaatggagtgggaggccaaggcacaggtcatcctgcttgtcattctgcttattgctattgccaatttctttatcgggactgtcataccttcgaacaatgaaaagaaatcgagaggattctttaactaccaggcatccatctttgcagaaaacttcggaccgcgtttcaccaagggcgagggctttttctccgtctttgcgattttcttcccagcagctaccgggatcctcgccggcgcgaacatttcgggagatctggaggatccccaggatgcaattcctcgcggaactatgctcgccatattcatcacgaccgtcgcataccttggcgtcgcaatctgtgtgggggcttgcgtcgtgcgcgacgcaaccggcaacatgaacgatactatcatttcaggtatgaactgtaacggttccgcggcgtgtggtctggggtacgattttagcaggtgtagacatgagccgtgtcagtacggtctgatgaacaatttccaagtgatgtcgatggtgtcaggatttggccctctgattaccgccggaatcttcagtgcaactctctcgagcgcactggcaagcctggtgtcagcacccaaagtgtttcaggcactttgtaaggataacatttacaaagccctgcagttttttgcaaagggatacgggaaaaacaacgaacctcttcgaggttacatcctgacctttcttatcgctatggcattcattcttatcgccgaacttaacacgattgccccgattatctcgaacttcttccttgcgtcttacgctttgattaacttcagctgcttccatgctagctacgccaaatccccgggatggcgacctgcctacggtatttacaatatgtgggtcagcctcttcggcgcagtcttgtgttgcgcggtgatgtttgtcattaactggtgggcagcagtgatcacttacgtcattgagtttttcctttacgtctacgtcacttgtaaaaagcctgacgtgaattggggatcatcgacccaagctctgagttacgtctcagcactggacaatgccctggagctgactactgtggaagatcacgtgaagaactttcgcccacagtgcatcgtcctgactggtggaccaatgaccaggcctgcacttcttgacatcacgcatgccttcactaaaaacagcggactctgtatttgctgcgaggtgtttgtcggtccacggaaactgtgtgtgaaggagatgaactcaggaatggccaagaaacaggcttggcttatcaagaacaagataaaagcgttctatgcagcagtggctgcagattgttttcgcgatggagtccggagcctgctgcaagcatccggtttggggagaatgaaacccaatacccttgttattggctacaagaagaattggaggaaggccccacttaccgaaatagaaaactacgtgggaatcatacacgatgcatttgactttgagattggcgtcgtgattgtgagaatcagccaaggttttgacatctcccaggtgcttcaagtgcaggaagagctggaaaggctggaacaagaaaggctggcgcttgaagctaccatcaaagacaatgagtgtgaggaggaatcgggagggattcggggactgttcaaaaaggcaggaaagctgaacatcaccaagactacgccaaaaaaggacgggtccatcaatacgtcccaaagtatgcacgtgggggaattcaaccaaaagctcgtggaagcatctactcagttcaagaagaaacaagagaaaggtactattgacgtgtggtggctctttgacgatggcggtcttactcttcttattccttacattcttactctccggaagaagtggaaagattgtaagctgaggatttacgtcggtggtaaaatcaaccgaattgaggaagaaaagattgtgatggcctcgttgctttcgaagtttagaataaagttcgcagatattcatatcattggtgatatcaatatccggcctaacaaggagtcgtggaaggtctttgaagagatgattgagccttacaggttgcacgaatcgtgcaaagatctgaccaccgccgagaagctgaagcgtgagactccttggaagattaccgatgcagaacttgaggcagtgaaggaaaagtcgtacagacaagtgagacttaacgagctgcttcaagagcactcgcgggctgccaatcttatcgtgcttagcctccctgtggccaggaagggatcgattagcgatctgctgtacatggcgtggctggagattctcaccaagaatctgccccctgtgctgctcgtccgggggaaccacaagaatgtgctgaccttttactcc

SEQ ID NO: 251092 - DNA, 3297 bp, Artificial Sequence
  Description of Artificial Sequence: Synthetic coding sequence
atgagcctcaacaattcaagcaacgttttcctggattcggttccctcgaacactaaccgtttccaagtgtccgtgatcaatgagaaccacgagagcagcgctgccgccgacgacaacactgaccctccacattacgaggagactagcttcggcgacgaagcccaaaagcggctccggatctcgtttcggccaggaaaccaagaatgctacgacaactttctgcaatctggagagactgcaaagaccgacgcctcttttcacgcctacgattcgcataccaacacctactaccttcagacctttggacataatactatggacgctgtgccgaagattgaatactaccgcaacaccggatccatcagcggaccaaaggtgaatcgaccgtcactgctggagatccacgagcagctggctaaaaacgtggctgtgactccctcttcagccgatcgcgtggctaatggagatggcattccgggcgacgaacaggcggaaaacaaggaggacgatcaggccggggtggtgaagttcggatgggtcaagggagtgctggtgcgctgcatgttgaacatctggggcgtcatgctgttcatcaggctgagctggatcgtgggagaggctggaatcggactgggagtcatcatcatcggactgtcggtcgtggtcaccacgttgacgggcatctcgatgtccgccatctgcactaatggtgtggtgagagggggcggagcctactacctgatctcccggagcctgggacctgaatttggagggtcgattggtctgatctttgccttcgccaatgcggtcgcggtggccatgtacgtggtgggatttgccgagactgtggttgaccttctgaaggagagcgactccatgatggttgacccgactaacgacattagaattatcggatcgataaccgtcgtcatcctgcttggaatctcggtggctggtatggagtgggaggccaaggcccaggtgattctcctcgtcatccttctgattgcaatcgccaacttcttcatcggtaccgtgatcccttccaacaacgaaaagaaatcacgaggattctttaactatcaggcatcaatcttcgcggaaaacttcggcccaagatttaccaaaggagaagggttcttctctgtctttgcaatctttttccctgcggctactggcatcctggcgggcgcaaacatctccggggaccttgaggacccccaagacgcaatcccccggggaactatgctggcgattttcatcactacggtggcgtacctgggcgttgccatttgtgtcggagcgtgtgtcgtgcgcgatgcgaccggaaacatgaatgacaccatcatctccggtatgaattgcaacggctcggctgcgtgcggactgggatacgatttttcgagatgtcgccatgaaccttgtcagtacggccttatgaacaacttccaagtgatgtcaatggtgtccggcttcggaccgctcatcaccgccggaatcttcagcgcgactctgtcgtcagccttggccagcctcgtgtccgcgccaaaagtgtttcaggccttgtgtaaagataacatctacaaggcgttgcaattcttcgccaagggatacgggaaaaacaatgagccactccgtggctacatcctgaccttcctcattgctatggcgtttatcttgatcgctgaactcaacaccatcgccccgataatcagcaactttttcctcgcgagctacgctctgatcaatttctcctgcttccacgcttcgtacgccaagagcccaggttggcgtccggcctacgggatttacaatatgtgggtgtctctgttcggggcggtcttgtgctgcgcggtgatgttcgtgattaactggtgggcagctgtcatcacctacgttatcgaattcttcctgtatgtctatgtcacttgcaagaaaccggatgtcaactggggatcgagcacgcaagcattgtcctacgtgtccgcacttgacaatgctctggaactcactaccgtggaagatcatgtgaagaactttcgcccgcagtgcatagtgctgactggggggcccatgacccggccggccctgctcgatattactcatgccttcaccaagaactcgggcctgtgtatctgttgcgaagtgttcgtgggaccaaggaagctctgcgtgaaagagatgaattcggggatggcaaagaaacaagcatggctcatcaagaataagatcaaggcattttacgcagcagtggccgcagattgcttccgggacggagtgcgctccctgctgcaggccagcggactgggacgcatgaagcccaacacgctggtgatcggttacaaaaagaactggagaaaggcaccgctgacggagatcgagaactacgtgggaatcatacacgacgccttcgacttcgaaatcggagtggtgatcgtcaggataagccagggtttcgacatatctcaggtgctgcaggtccaggaagagcttgaacggcttgagcaggaacggcttgccttggaggcgaccatcaaggacaatgagtgcgaagaagaatcaggtggtattagaggcctgttcaagaaggcaggtaagctgaatatcaccaagaccacgcctaagaaagacggctcaattaacaccagccagtccatgcacgtgggcgagttcaatcagaagctggtcgaggcgtcgacccaattcaaaaagaaacaggaaaagggaacgatcgatgtctggtggcttttcgatgatggcggactcactcttttgatcccatacatcctgactctccggaaaaagtggaaagactgcaagctgcggatttatgttggcgggaagatcaaccggatcgaagaggaaaagatcgtgatggcgtcgctcctctcgaaattccggatcaaattcgccgacatccacatcatcggggacatcaatatcagacctaacaaggaatcgtggaaggtctttgaagaaatgattgaaccataccgcctgcatgaatcatgcaaagacctgaccaccgcggaaaaactcaaacgagaaactccgtggaaaatcactgatgccgaactcgaagcagtgaaggagaaatcctaccgccaagtgcgcctgaatgagctgcttcaggagcactcccgggccgcaaatctgatcgtgctcagcctgccagtcgcgcgcaagggatccatctcggatctgctgtatatggcctggcttgaaatcctcaccaagaatctgccgccggtgcttctcgtgaggggtaaccataagaatgtcctgactttctactcc

SEQ ID NO: 251093 - DNA, 3297 bp, Artificial Sequence
  Description of Artificial Sequence: Synthetic coding sequence
atgtccctgaataactcctcaaacgtctttcttgacagcgtgccatccaacacgaaccggttccaagtgtccgtgattaacgaaaaccatgagtcgtcggcggcagccgatgataataccgacccgcctcattacgaggaaacctcttttggcgatgaagctcaaaagagactccgaattagcttccggcctggaaaccaagagtgctacgataacttcctgcaaagcggagaaactgccaagacggatgcatcatttcatgcatatgactcacatacgaatacctactacctccaaacctttggacacaataccatggacgcggtgcctaagattgaatactaccgcaataccgggtcaatctccggtcccaaggtcaacagaccatccctgctggaaatccacgagcagcttgcaaagaacgtcgccgtcaccccgtcctccgcagatcgggttgcaaacggagacggaattcctggcgatgaacaagccgagaacaaggaagatgaccaagcaggagttgtgaagtttggatgggtgaagggagtgcttgtgcgatgtatgctgaatatctggggagtcatgcttttcatacgcctctcgtggattgtgggggaagcagggattggactgggtgtgatcattatcggactgtcggtggtggtgaccactcttactggaatctccatgtcagcaatttgtaccaatggagtcgtgaggggtggtggggcgtactacctgatttcgcggtcgctggggcctgaattcggggggtcaattggactcattttcgccttcgccaacgctgtggccgtcgcaatgtacgtggtcggatttgcagaaacggtggtggacctgctcaaggagtcggattcgatgatggtcgaccccaccaacgatattcgcatcatcggttcgattacggtggtgatcctgcttggaatttcagtcgcaggaatggagtgggaagccaaggcacaggtcatccttctcgtcatcctgctgatcgcaatagcaaatttcttcattggtaccgtgatcccgtcgaataacgaaaagaagtcacgtgggtttttcaattaccaagcaagcatctttgcagaaaactttggacctcgctttaccaaaggagaaggatttttctccgtgtttgcaatctttttcccagcggcgaccggcatccttgctggtgcgaatatctccggtgacctggaggacccccaagatgcaatcccacgcggtaccatgctggcaatattcattactaccgtcgcatacctcggcgtggcaatctgtgtgggtgcctgtgtggtgagagatgccactggcaacatgaatgataccattatctcgggtatgaactgtaatgggtcagccgcctgcggtctgggatacgatttttcgaggtgccgacacgaaccatgtcagtatggactgatgaataactttcaggtcatgtcgatggtgtccggcttcggtccactgattaccgcaggcatcttttccgcaaccctctcctccgcacttgcatcgcttgtatctgcgcctaaggtctttcaagccctttgtaaggacaatatctataaggcactccagttttttgcaaagggatacggcaagaacaacgagcctctgcgcggatacatcctgacctttcttatcgccatggcatttatccttatcgcagagcttaataccattgcacctatcatttcaaatttctttttggcaagctacgcgctcataaactttagctgttttcatgcctcctacgcaaaaagccctggttggcgtcccgcatatggtatctacaacatgtgggtgtcgcttttcggagccgtcctgtgttgtgcagtcatgttcgtcataaactggtgggccgcggtgataacctatgtgattgaattctttctgtacgtctacgtgacttgtaaaaagcctgatgtcaactggggctcgagcacccaggccctctcctacgtgtctgcactggataacgcgctcgagctcactactgtggaagatcatgtcaagaattttcgacctcaatgtatagtgctcaccggtggaccgatgactcgcccagcactgcttgacattacgcacgccttcactaagaattcgggactctgtatatgttgtgaggtgttcgtgggtccccggaaactttgtgtgaaggaaatgaacagcggtatggccaagaaacaggcatggctgatcaagaacaaaatcaaggcattctacgcagcagtggcagcagattgtttcagggacggggtgcgtagccttctgcaagcatcggggctggggcgtatgaagcctaataccctcgttattggatacaagaaaaactggcgaaaggcccctctgaccgagattgaaaactacgtgggtatcattcacgatgcatttgattttgaaattggagtggtcattgttcggataagccagggatttgatatatcgcaggtgctgcaagtacaggaggaacttgagagattggaacaagaaagactcgctctggaagctacgattaaagataacgaatgtgaagaggagagcggtggaattcgaggactgtttaagaaagcaggaaagctcaacataaccaagactaccccgaaaaaggacggttcaattaacacttcacagtcgatgcatgtcggcgagtttaaccagaagctcgtcgaggcttcaacgcagttcaagaagaaacaagagaaaggcactatagatgtgtggtggctcttcgacgacggtggactgactctcttgattccatacatactgacgcttcgaaagaagtggaaggattgtaagttgcgtatttacgtgggaggtaagattaaccggattgaagaagagaaaattgtgatggcttccctgctgtccaagtttcgcattaagttcgcagatattcacattattggagatatcaacataaggccgaataaggaaagctggaaagtgtttgaggaaatgatcgaaccctaccggctccacgaaagctgcaaggatcttaccaccgcagaaaagctcaaacgtgaaaccccttggaagattaccgatgcagaactggaggcggtgaaggaaaagtcgtaccggcaagtgagactgaatgaacttcttcaggagcattcgagggcagcgaaccttattgtgctttcgctgccagtggcaaggaagggtagcatttcggacctgctgtacatggcatggttggaaattctcaccaagaatcttccaccagtcctgttggtgcgcgggaatcataagaatgttcttaccttttactcg

SEQ ID NO: 251094 - DNA, 3297 bp, Artificial Sequence
  Description of Artificial Sequence: Synthetic coding sequence
atgtcccttaataattccagcaacgtgttcctagactcagtccccagcaatacaaatagatttcaagtgagtgtgattaatgaaaatcatgagtccagtgccgctgcggatgacaataccgatcccccccactacgaagaaacatcctttggggatgaagctcagaagcgactgcgtatcagttttcggcccggtaatcaggagtgttacgacaacttcctccagtcaggtgagacagccaagacggatgcatcatttcacgcttacgacagccatacaaatacatattatctccaaactttcggccacaacactatggatgctgtgcctaagattgagtactacaggaatactggaagcatttccggacccaaggtcaatcgaccatctttgttggagattcatgagcagctggcgaagaacgtagcggtgacacctagttccgcagaccgagtcgcgaacggagatggaatccctggcgacgagcaggctgagaacaaggaagacgatcaggccggtgttgtgaagtttggatgggtaaagggcgtgctcgtccgctgtatgctgaatatttggggcgtcatgctgtttatccgcctatcctggatcgtgggtgaggcgggaattggccttggagtgatcattattggactgtctgtagttgtgacaactttaacaggtataagtatgtccgctatatgtacaaacggtgtcgtaaggggaggtggtgcttactatctgatctcacgatctctcggacccgagttcgggggtagcatcggcctaatttttgcttttgctaacgcagttgcagtggccatgtatgtggtgggattcgcggagacggtggtggacttactcaaggagagtgacagtatgatggtggatcctaccaacgacattcggattattggctccattactgtggtgatcctgttggggatatcagttgcaggaatggagtgggaagccaaggctcaggtaattcttctcgttattctgttgattgccatagccaattttttcatcggcaccgtcatcccatcgaacaacgagaagaagtctcgaggatttttcaattatcaagcctctatttttgccgagaatttcggaccccggtttacaaaaggggaaggatttttttctgtgttcgctatcttttttcccgcagcaactggtatcttagcaggagctaatatatctggagatttggaggaccctcaggatgcaatcccacgtggcacaatgctcgctatcttcatcacaaccgtggcttaccttggcgttgccatctgtgtgggcgcctgcgtggtgagagacgcaactggaaatatgaacgacacaataatttcgggtatgaattgcaatgggtccgctgcctgtggtttgggttacgacttttcacgctgccggcacgaaccgtgtcagtacggccttatgaacaacttccaggtgatgtctatggtctcaggcttcggcccactgatcacggctggaatcttttcagcaaccctgtcctccgctctcgcaagtttggtttccgctccgaaggtgttccaggcgctttgtaaagataatatctataaagctctacagttcttcgctaagggatacgggaaaaataatgagccattacgcgggtatatcctcacctttctgatagcaatggcatttattctcatagccgagctgaatacgatagccccaataatcagtaacttttttctggcaagctacgcactcattaattttagctgtttccacgcctcctacgcgaaaagccctgggtggcgcccggcctacggaatttacaatatgtgggtgtctctgttcggggccgtgctgtgctgcgcggtcatgttcgtcattaactggtgggcagctgtcataacctatgtaatcgaattctttctgtacgtttacgtaacatgtaagaaaccagatgtgaactggggatcctccacacaggctttgagttacgtttctgctctggataatgccctggagcttactactgtcgaagaccacgttaagaatttcaggccccagtgcattgtcctgaccggaggacccatgacccggcctgccctactagacatcacacatgcctttaccaaaaattcaggcctatgcatatgttgcgaagtgttcgtggggcctagaaaactctgcgttaaagagatgaattccggcatggctaagaaacaggcctggctcatcaagaacaagatcaaagcgttctacgcggctgtagccgcggactgttttcgggatggagtgcgatccctcctccaagctagtggactggggaggatgaaacctaacactttggtgattggctataaaaagaattggagaaaggctcccctgacagagatcgaaaattacgtcgggattattcatgatgcatttgactttgagataggagttgtgatcgtgcgaatatcccagggcttcgacatctctcaagtgctccaggtgcaggaggagctcgaacggcttgagcaggaaagattggccctggaggctactatcaaggacaacgagtgcgaggaggagagtggcgggataagaggtctgtttaagaaagcaggtaagcttaacatcaccaagacaactcctaaaaaggatgggtcaatcaatactagtcagtctatgcatgtgggggaatttaaccaaaagctggtggaagctagtactcagttcaagaagaagcaggagaaggggacaattgacgtatggtggctcttcgatgacggagggctgactctcctgatcccgtacatactcactttgcgcaagaaatggaaggactgtaaattgcgtatctacgttggcggaaaaatcaaccgcattgaggaagagaaaatcgttatggctagcttactgagcaaattccggattaagttcgctgacatccacatcatcggtgatataaatatcagacccaacaaagagtcctggaaggtgtttgaagaaatgattgagccttaccggctgcatgaatcttgtaaggatctgacgacagctgagaaactgaagagagagactccttggaaaataacggacgctgagctggaggccgtgaaggagaaaagctaccgccaggtccggctcaatgaactcctacaggagcactcgcgggccgctaacctgatcgtgctctctttacctgttgcgcggaagggcagtatctctgacctcctctacatggcctggttggagattctgaccaaaaaccttcctcctgtgctattggtcagggggaaccacaaaaatgtcctcaccttctattct

SEQ ID NO: 251095 - DNA, 3297 bp, Artificial Sequence
  Description of Artificial Sequence: Synthetic coding sequence
atgagtctgaataacagctctaacgtgtttctggacagcgtgccaagtaacacaaatcgtttccaggtcagcgtgatcaatgaaaatcatgagagttcagccgctgctgacgacaacactgaccctccccactacgaggaaacatctttcggagacgaagctcagaagcggttgcgtatttcatttcgtcctggcaatcaagagtgttacgacaacttcttacagtccggagaaacagcaaagaccgatgcatctttccacgcctacgacagccacaccaacacctactatcttcagacatttgggcataacaccatggacgctgtgcctaaaatcgagtactacagaaacaccgggagcatttctggacccaaggtgaacaggcccagtctgttagagattcatgagcagttggcaaaaaatgtagctgtgactccatcaagcgccgaccgcgtcgccaatggcgatggaatacccggtgacgagcaagcagaaaacaaggaagacgaccaagctggggtggtcaagtttggctgggtaaaaggtgtgctagtccggtgtatgctgaatatatggggcgtcatgctgtttatccggttatcttggatagttggtgaagctggaatcggcctaggcgtgatcattattggtctgagcgtggtggtgactacattaactggaatctctatgagcgctatctgtaccaacggggtggtgcgtggcggtggagcctactacctgatatccagatcattggggcctgagtttggcggcagtatcggacttatattcgcattcgcaaacgcagttgcagtggccatgtatgttgtgggctttgctgaaaccgttgtggatctgttgaaagagtctgactcaatgatggttgacccaaccaatgatatccgtataatcggaagcatcactgtcgttatactgctaggcatttcagttgctgggatggagtgggaggctaaggcccaggttatcctcttagtaatactgctgatcgctattgccaacttcttcatcggcactgtgattcctagtaacaacgaaaaaaagagtagaggttttttcaactatcaggcttccatatttgctgaaaatttcgggccacggttcaccaagggcgaaggtttcttctcagttttcgctatattcttccctgccgctaccggcatcctggcaggagccaacatatctggagatctagaggatccccaggacgcaattcctcgcggtacaatgctggccatattcataactacagtcgcctatctgggcgttgcaatttgcgtgggcgcttgcgtcgtgagagatgccactggcaacatgaatgacaccataatttctggcatgaactgcaatgggagcgctgcctgcggactgggctacgatttcagccgctgtaggcatgaaccgtgccaatacggtctgatgaacaatttccaggttatgtccatggtttctggctttggccccctgataacagccggcatattctcagcaaccttatcttctgctctggcttctctggtatcagccccaaaagtgttccaggctctctgtaaagacaatatatacaaggccttacagtttttcgctaagggctatggcaagaataatgaacctttacgtggatacatcctgaccttccttatagccatggcttttatactcatagccgagctaaacaccatcgccccgataattagtaatttctttctagcctcttatgctctgatcaacttttcctgctttcatgcctcctacgcaaaatccccagggtggagacccgcttatggcatctacaatatgtgggtgtccctgttcggagctgtgttatgctgtgccgttatgtttgtgattaattggtgggccgccgtcatcacttatgtgattgaatttttcctgtatgtgtacgtgacttgcaaaaagcccgacgttaattgggggagctccactcaagccctatcttatgtgagcgccctcgataatgctctggaactgacaactgtggaggatcatgtgaaaaactttaggccacagtgcatagtcctcacaggcggcccaatgacacggccagctctgcttgatataacccacgcttttaccaagaacagtggactgtgcatatgttgcgaagtgttcgtgggaccccgcaaactatgtgtgaaggaaatgaactccggcatggccaaaaagcaagcatggttaatcaaaaataaaatcaaggccttttacgcagccgtagctgctgactgctttcgggacggcgttcggagtctgctacaggcctctggactgggtcgcatgaaacctaacactctggtgattggttataagaagaactggcggaaggctcctttaactgagatcgagaactatgttggtattatacatgacgcattcgattttgagataggtgtggttatcgtacggatttcacagggttttgacatctcccaggtgctgcaggtgcaggaagaattggagaggctggagcaggagcgactggccctggaggcaacaatcaaggacaatgagtgtgaagaagagtccggcggaatccgcggtctttttaagaaagccggaaagctgaatataaccaaaaccactccaaagaaggacggctcaataaacacctcacagagcatgcatgttggcgaattcaatcagaagttggtagaggcttcaacccaattcaagaagaagcaggaaaagggtactatagacgtttggtggctcttcgacgacggcggtttaaccctgttaatcccatacatattaactctgcgcaagaaatggaaggattgtaaattgcgaatctacgttggtggcaagatcaaccgaatcgaggaggagaaaatcgtcatggcttcattactgagtaagtttcggatcaaatttgccgatattcacatcataggagacatcaatatcaggcctaacaaagaatcctggaaagtgtttgaagagatgattgagccatacaggctccacgagtcttgcaaagacctgacaaccgcagaaaaactgaagcgggaaaccccttggaagataaccgatgccgagttagaggctgttaaagaaaaaagctatcgacaagtccggttaaacgagctgctccaggaacattccagggccgctaacttaatcgtgctcagcctcccagtcgccagaaagggctcaatcagtgacctgctctacatggcctggctggagattctaaccaaaaacttacccccagtgctgctggtccggggtaaccacaagaacgttctgacattctattct

SEQ ID NO: 251096 - DNA, 3297 bp, Artificial Sequence
  Description of Artificial Sequence: Synthetic coding sequence
atgtcgctgaacaattcttcgaacgtgttcctggacagcgtcccatcgaataccaataggttccaagtgtcggtaatcaacgaaaaccatgagtcaagcgccgccgctgacgacaataccgatccaccgcattacgaagaaacctctttcggggacgaggcccagaaacggctgagaatctcgtttcggccaggaaaccaggaatgctacgacaatttcttgcagtctggagaaacggccaagaccgacgctagcttccatgcttacgattcgcacactaacacctactatctccagacgtttggacataacaccatggacgccgtgccaaaaatcgagtactaccgcaacactggctcaattagcggaccgaaggtgaacaggccgtcgctgctggaaatccacgagcaactggcgaagaacgtggcggtcacgccctcctcagccgaccgggtggccaacggggatggtatccctggagacgaacaagctgaaaacaaagaggatgatcaggcaggggtggtgaagttcggatgggtgaaaggagttctcgtcaggtgtatgctgaacatctggggcgtgatgctcttcatccggctgtcgtggatcgtgggagaggccggaatcgggctcggggtgatcattatcgggctcagcgtggtggtcactacgttgacgggcatctcgatgtctgcgatctgcacgaacggagtggtgcgcggagggggtgcgtattacctgattagcaggtccctgggcccggaatttggagggtcgatcgggctcatctttgccttcgcgaatgcggtcgccgtcgcaatgtacgtggtggggttcgcagagactgtggtggacctgctgaaggagtccgactcgatgatggtcgatccgactaatgacatccgcatcatcggatcaatcactgtggtgatcttgctgggcatctcggtcgccggaatggaatgggaggcaaaggcccaggtcatcctgctcgtgatcctgttgatcgctatcgcaaatttcttcattggaaccgtcatcccctccaacaacgaaaagaagtcaagaggcttctttaactaccaggcgtccatcttcgccgagaatttcggaccaagattcacgaagggcgaagggttcttttcagtgtttgccatctttttcccagccgccactggtatcctcgctggtgcgaacatttctggcgacctcgaggatccgcaagatgccatcccgaggggaactatgctggcgatattcattactaccgttgcgtacctgggcgtggccatctgcgtgggggcctgtgtcgttcgcgatgcaacgggcaacatgaatgataccatcatttcgggaatgaattgcaacggatcggcagcttgcggactgggatacgacttctcccggtgtcggcacgagccttgccagtacggcctcatgaacaatttccaggtgatgtcgatggtgtccggatttgggccgctgatcactgcaggaatcttctcagcaaccctcagctcagcactggcctctctcgtgtcagcgccgaaagtctttcaggcactgtgtaaggacaacatctacaaagccttgcagttcttcgccaagggatacggaaagaataatgaaccacttcgcggatacatccttaccttcctgatcgccatggctttcatcctgatcgcagaactcaacactattgcaccgatcatctcgaatttctttctcgcatcatatgctcttatcaacttctcgtgctttcatgcctcctacgcaaaatcgccgggatggcggccggcctacggcatctacaacatgtgggtttcattgttcggcgctgtgctttgttgtgcggtgatgttcgtcatcaactggtgggcagctgtgatcacctatgtcatcgagttctttctgtatgtgtacgtcacttgcaagaaaccagacgtgaattggggaagctcgacccaggctctttcgtacgtctcggcgctggacaatgcgctggaactcaccaccgtcgaggaccacgtgaagaacttccggccacaatgcatcgtcctcactggcggccccatgacccgtccggctctgctggatattacccatgccttcaccaagaactcaggcctttgtatttgttgcgaagtctttgtgggaccccggaagttgtgcgtgaaggaaatgaattccggtatggctaagaaacaggcatggctgattaagaacaagattaaagcgttttacgccgcggtggcggccgactgctttcgcgatggagtgcgcagcctgctccaagcatcggggcttggtagaatgaagccaaacacccttgtcattggatacaagaagaattggagaaaggcccctctgactgaaatcgaaaactacgtgggaattatccatgacgcgttcgacttcgaaatcggggtggtgattgtgcgcatctctcagggattcgacatctcgcaggtgctgcaagtccaggaggaactggaacggctggaacaggagcgcctggctcttgaggcgactattaaggataatgagtgcgaggaggagtcgggagggatccgcgggctgttcaagaaggcaggcaagctgaatatcactaagaccacgccaaagaaggatggaagcatcaacactagccagtccatgcacgtgggagaattcaaccagaagctcgtcgaagcctccactcaattcaaaaagaagcaggaaaagggaaccatcgatgtgtggtggctgttcgacgatggagggttgactctcttgatcccatacatcctgactctgcggaagaagtggaaggattgcaaactgagaatctacgtcggaggaaagatcaacagaattgaagaggaaaagatcgtcatggcatccctgctctcgaagtttaggattaagtttgcagacatccacatcatcggagatatcaacatccgcccaaacaaggagtcgtggaaagtgtttgaagagatgatcgagccttaccggcttcacgagtcctgcaaggatctgaccactgcagaaaagctgaagcgcgagactccgtggaagatcactgacgctgaactggaagcagttaaggagaaatcataccgccaggtccgcctgaatgaactgctgcaggagcacagccgcgccgcaaacctgattgtgctcagtctgccagtggctcggaaagggagcatttcagatcttctttacatggcctggctcgaaattctgaccaaaaacctgccgcccgtgctgctcgtgcgcgggaatcataagaacgtgctgactttctactcg

SEQ ID NO: 251097 - DNA, 3297 bp, Artificial Sequence
  Description of Artificial Sequence: Synthetic coding sequence
atgagcctgaacaacagtagtaacgtctttctggattccgtaccttccaacaccaacaggttccaggtgagcgtgatcaacgaaaatcatgaatctagcgctgccgctgacgacaatactgatcccccacattacgaagaaacatcattcggcgacgaagcccagaaacgcctgcgaatttcgttcagacccggtaatcaggagtgttatgataatttcctccagagcggagagaccgcaaagacagatgccagttttcacgcctacgacagccatacgaacacgtattatctccaaacctttgggcataatacaatggatgccgtccccaagatcgagtactaccgaaatacaggcagcatatccggacctaaagtgaaccggccgagcttgcttgagattcacgaacagctcgctaagaacgtcgctgtgacaccaagctctgctgatcgtgtagctaacggggatgggatcccaggcgacgagcaggctgagaataaagaggacgatcaggcgggtgttgttaaattcggctgggtgaaaggggttctagtgaggtgtatgttaaacatctggggcgtcatgctcttcataaggcttagctggatcgtgggagaagctggaatcggcctcggcgtgatcatcattggacttagcgtcgtggtgacaaccttgacagggatctctatgtcagcaatttgcacaaacggtgttgtgaggggaggtggtgcatattacctgatctcaagaagtttgggcccagagtttggaggctccatagggctgatctttgcatttgccaatgcagtggcggtcgctatgtacgtggtgggcttcgcagagaccgttgtcgacctgctaaaggaatctgactctatgatggtggatcccactaatgacatcaggattattggaagtatcactgtggtcatactgttggggatttcagtagcgggtatggagtgggaggcgaaagcccaggttattctgctggttattttgctgatagccattgcaaattttttcatcggtacggtgattccgagcaacaatgaaaaaaaatccaggggcttttttaattatcaggcatctatctttgccgagaatttcgggcccaggtttacgaaaggggaagggttcttctcagtgtttgctatctttttccccgccgccaccggcatcctggcgggggctaatatttctggcgatttggaagatccacaagacgcaattccaagaggtactatgctcgccattttcattaccaccgtcgcctaccttggcgtcgcaatttgcgtgggtgcttgcgtcgtcagagacgcgacagggaacatgaatgacacaattatttctggtatgaattgcaacggaagtgcagcgtgtggactcggctatgacttcagccgatgcagacacgagccatgccagtatggcctgatgaataacttccaggtgatgtctatggtgtcagggtttggacccctgatcaccgccggaattttctctgccacacttagctcagccctggccagcctggtcagcgcccccaaggtattccaagctctctgcaaggataatatttacaaggcattgcagttcttcgccaagggctatggtaagaataacgaacccctgaggggctatatattaacatttctcatagcaatggcatttatcctcatcgccgagctcaacactatagccccaatcatcagtaacttctttctggctagttatgccctcatcaacttttcgtgttttcatgcctcatatgcaaagtcccctgggtggaggccagcctacggcatctataacatgtgggtgtcgctgttcggggctgtactctgctgcgcggtgatgtttgtcatcaattggtgggcggcagtcattacgtacgtcatcgagttctttctttacgtgtatgtgacatgcaagaagccagacgtaaactggggtagtagcacccaggcgctctcatatgtgtccgccctcgataatgctctcgaacttacaaccgtagaagatcatgtaaaaaacttcaggccccaatgcatagttttaaccggcggtcccatgacaaggcccgctctgcttgatatcacacacgcatttactaaaaactccggactatgcatatgctgcgaagtattcgttgggccacgaaagctttgtgtgaaagaaatgaactctggtatggccaagaaacaggcttggctgattaaaaacaaaatcaaagctttctacgccgccgtggcagctgattgctttcgggacggcgtgcgatcccttctgcaggctagcgggctgggcaggatgaagcccaacacccttgtgatcggttacaagaaaaactggcgcaaggccccattaacagaaatagagaactacgtgggcataattcatgatgcattcgacttcgagataggggtggtcattgtgcggatcagccagggttttgatattagtcaagttctgcaagtgcaggaggaactcgaacgcctggagcaagagcgacttgcattggaggccaccattaaggataatgaatgcgaggaagaaagcggcgggatccgcggtttgttcaagaaagcaggcaagcttaacattactaaaacaaccccaaagaaagacggatcaataaatacaagccaatcaatgcatgtgggcgagttcaatcagaagctggttgaagcttcaactcagtttaaaaaaaaacaggaaaagggaaccattgatgtatggtggctattcgatgatggtgggctgaccctcctgatcccttacatcctaacgttacgaaagaagtggaaagattgcaagctaaggatctatgtaggaggtaaaataaatagaatcgaggaagaaaaaatcgtgatggcttcccttctgagtaagttcagaattaaattcgcggacattcatattattggggatattaacatacgaccaaacaaagaaagttggaaggtgtttgaagagatgatcgagccctatagactccacgagagttgcaaggatttgaccaccgcagaaaaactgaagcgcgagaccccgtggaaaattacggatgccgagttggaggccgttaaagagaaaagctatcgccaggtgaggctgaatgagttactgcaggaacatagccgggcagcgaacctcatcgtcttgagtctacctgtggctcgtaaaggcagtatcagcgacctgctttacatggcttggctggagattctgactaaaaacctgcccccagttctactggttaggggcaatcataaaaatgtgctgaccttctactca

SEQ ID NO: 251098 - DNA, 3297 bp, Artificial Sequence
  Description of Artificial Sequence: Synthetic coding sequence
atgtccctgaataactcatccaatgtgttcctggacagcgtcccttcaaacactaacaggtttcaagtctctgtcatcaacgaaaaccacgaatcatcagcggcagcagacgataacactgacccacctcattacgaggaaacctcattcggtgatgaagcgcagaagagactgcggatcagcttccgcccaggaaaccaagagtgttacgacaactttctgcagtccggtgaaaccgcaaagactgacgcatccttccatgcatacgattcacacactaacacgtactacctccagacttttggacacaacactatggatgccgtgcccaaaattgaatactatcgtaacaccggctccatctcgggcccaaaggtcaaccgcccctccctcctcgagatccacgaacagttggcgaagaacgtggcagtgactcctagctctgcagatcgtgtggccaacggagatggcatcccaggggatgagcaggcagaaaacaaggaggacgaccaggcaggtgtggtcaagtttggctgggttaagggagtcctggtgcgctgcatgctgaacatctggggtgtgatgctctttatccgcttgtcctggattgtgggtgaagccggtatcgggctgggagtcattatcattggtctttcggtggtggtgactactctcactggtatttcgatgtcggcaatatgtaccaacggagtggtgaggggaggtggtgcatactaccttatttccagatctctggggcctgagtttgggggttccattggcctgatttttgcatttgccaatgccgtggcggtcgccatgtacgtggtgggatttgctgagacggtggttgatctgcttaaggaaagcgattcgatgatggtggatccaactaatgacatccggattattggttccattactgtggtgatacttcttggtatttcagtggcgggtatggaatgggaggcaaaggcacaagttatactgctcgtgatcctgcttatcgcaattgcaaacttctttatcggcaccgtgattccatcgaataatgagaagaagagccgtggttttttcaactaccaggcctcgatatttgcagagaatttcggacccagatttaccaagggagagggcttcttttcagtgttcgccattttctttccggccgccactggaattttggcaggagcaaacatcagcggtgaccttgaagatcctcaagatgcgatccccagaggaaccatgcttgcaatattcatcaccaccgtggcttaccttggagttgctatttgtgtcggcgcatgtgttgtgagagatgcaaccgggaacatgaacgataccattatctccggtatgaattgtaatggatcggcggcgtgcggactcggctacgattttagccggtgtcggcatgagccgtgccaatacggcctcatgaataactttcaagtcatgtcgatggtgtccggatttggaccgcttatcacggccgggatattcagcgccaccctgagctccgcccttgcgtcgctcgtgtcagcaccgaaggtgttccaggcactgtgcaaggataacatttacaaggcacttcagttttttgcgaagggttacggtaagaacaacgaaccacttcgcggatatatccttacctttctgattgcaatggcctttatcctgatcgccgaacttaatactattgcccctattatctcgaatttcttcctggcatcatacgcactcatcaatttcagctgctttcacgcctcatacgcaaagtcaccgggctggcgccctgcatacggaatttacaacatgtgggtgtcactttttggggcagtgttgtgttgtgcagtgatgtttgtgatcaactggtgggcagcagtgataacctacgtcatcgaattctttctgtacgtgtacgtgacttgcaaaaaaccagacgtcaactgggggtcatccacccaagccctgtcatacgtgtcggcactggataatgctcttgagctgacgactgtcgaagatcatgtgaaaaacttcaggccgcagtgcattgtgctcaccggcgggcctatgaccagacccgccctccttgatatcacccatgcctttaccaagaattcagggctgtgtatatgttgtgaagtttttgtgggaccccgaaagctgtgcgtgaaggagatgaattcgggaatggcaaagaaacaagcatggctgatcaagaataagattaaggccttttacgcagccgtggccgcagactgcttcagggatggcgtccggtccctgctgcaagcctctggactgggtcggatgaagccaaataccttggtgatagggtacaagaagaactggcggaaagcacctctgaccgaaattgaaaactacgtgggaatcattcacgatgcatttgattttgagatcggagttgtgatcgtccgcatctcgcaaggctttgacatcagccaggtgctgcaagttcaagaggaactcgaaagactggagcaggaacgactcgcacttgaggctactatcaaggacaacgagtgtgaagaagaatctggaggtattaggggactgttcaagaaagcaggtaaacttaacataactaagaccactccgaaaaaagatggcagcattaacacctcgcagagcatgcatgtcggagaattcaaccaaaaactggtggaggcatcgactcaattcaagaaaaagcaagaaaagggaaccattgacgtgtggtggctgtttgatgacgggggacttactcttctcattccttacattctcacccttagaaagaagtggaaggattgtaagctcagaatctatgtcggtggcaaaatcaatagaattgaagaggagaagatcgtcatggcctcgcttttgtccaagtttagaattaagtttgctgatattcacattataggggacataaacatccggccaaacaaggagtcgtggaaagtgttcgaagaaatgattgagccataccggctgcatgaatcgtgtaaggatctgactactgccgagaagctcaaaagagaaactccgtggaaaatcacggatgcggaattggaagcagtcaaggaaaagtcctaccggcaggtccgtctgaacgaactcctccaagaacattcccgtgcagccaacctgattgtgctgagcttgccggtcgctagaaagggatcgatctctgaccttctgtacatggcatggctggagattcttacgaagaatttgccccctgtgttgcttgtcaggggcaaccacaaaaatgtcctgaccttctattcg

SEQ ID NO: 251099 - DNA, 3297 bp, Artificial Sequence
  Description of Artificial Sequence: Synthetic coding sequence
atgtccctcaataactcgtcgaacgtgttcctcgactccgtcccgagcaacaccaatcggttccaggtcagcgtgatcaatgagaatcacgaaagctccgcggcggctgatgacaatactgatccacctcactatgaggaaacttcctttggggacgaagcccagaagaggctgcggatctccttccgcccaggtaaccaggagtgttacgacaacttcctccaatccggggaaactgccaagacggacgcatctttccacgcatacgactcccatactaacacttactaccttcagactttcggacacaacaccatggacgcagtgcccaaaatcgaatactacagaaacaccggatccatcagcggtccgaaggtcaaccgcccttcccttctcgaaatccatgagcaactggcgaaaaatgtggcggtgaccccatcctcggccgatcgcgttgcgaatggagacggaatcccaggggacgaacaggcagagaacaaagaagatgaccaggcgggcgtggtgaaattcggatgggtgaagggagtgcttgtcagatgcatgttgaacatttggggcgtgatgctcttcatccggctctcgtggatcgtgggtgaagctggtatcggactgggggtgatcatcatcgggctcagcgtggttgtgactacgttgaccgggatttcgatgtcagccatctgtactaatggcgttgtgcggggaggcggagcttactacctgatctctcgctccctcggacctgagttcggcggatcaattggcctgatctttgccttcgcaaacgccgtcgccgtcgccatgtacgtcgttggattcgcagagactgtggtggatctgctgaaggagtccgacagcatgatggtggatcccaccaacgacatccgcattatcgggagcatcactgtcgtaatcttgctggggatctcagttgcgggcatggaatgggaagcgaaagcgcaggtgattctcctcgtgatcctgctgatcgcgatcgccaatttctttatcggaactgtgatcccatcgaataacgaaaagaagagccggggattcttcaattatcaggcctctatcttcgcagaaaacttcggccctagattcaccaagggagaaggctttttctccgtgtttgcaatcttttttccggcggccactggcattcttgcgggcgcgaacatcagcggagatttggaggatccgcaagacgcgatcccgagaggcactatgctggcaatcttcatcactaccgtggcctacctcggagtggctatctgcgttggagcctgcgtggtcagagacgcgaccggaaatatgaatgacactatcatttctggaatgaattgcaatggttccgccgcatgtgggctcggatacgacttctcgagatgtcgccatgaaccatgtcaatacggcctcatgaacaacttccaggtgatgtcaatggtgagcgggtttggacccctgatcaccgccggcatctttagcgccactctgagcagcgccctggcatcgctggtgtctgccccgaaggtgttccaggcactttgcaaggacaacatctacaaggcgcttcagttctttgcgaaaggctacggaaagaataatgagcctctccgcggatatatcctgacctttctcatcgccatggctttcattctgatcgcagaactcaatactatcgcacccatcatttccaacttcttcctcgctagctatgctcttatcaactttagctgcttccatgcctcgtacgccaagagcccgggctggcggcctgcctacggaatctacaacatgtgggtgtcgctgttcggtgctgtgctctgctgcgcggtgatgttcgtgataaactggtgggctgcggtgattacctacgtgattgagttttttctgtacgtgtacgtcacttgtaagaagcccgacgtgaactggggatcctcaacccaggcactgtcgtacgtgagcgcactggataacgcgctggagttgactaccgtggaagatcatgttaagaacttccgcccgcagtgtattgtgctcaccggaggccccatgactcgcccggccctgctggacattactcacgctttcactaagaattcgggtctttgcatctgctgtgaagtgttcgtgggaccgcgcaagctgtgcgtgaaggaaatgaactcaggaatggcaaaaaagcaagcatggctgatcaagaataagatcaaggccttctacgctgcggtcgccgccgattgctttcgcgacggcgtccggagcctgctgcaggcgtccggcctgggaaggatgaagcctaacaccctggtcatcggatacaagaagaattggaggaaagctccgcttaccgagatcgaaaactacgtcggcataattcatgatgcatttgactttgaaatcggagtcgtgatcgttcgcatttcacagggtttcgatatctcgcaggtgctgcaagtgcaagaggagctggagcgactggagcaggaaagactggccctggaagccaccattaaggataatgagtgcgaagaggagtctggaggaatccggggactctttaagaaggccggcaaacttaacatcaccaagactactcctaagaaagacggatccatcaatactagccagtccatgcacgtgggcgagtttaaccagaaactggtggaagccagcacccagttcaaaaagaagcaagagaaggggactatcgatgtttggtggctctttgacgacggggggctgactctgcttatcccgtacattctgaccctgcggaaaaagtggaaggattgtaaactgcgtatttacgtcggtgggaagatcaatcggatcgaagaagaaaagattgtcatggcctccctgctgtccaagttccggatcaagttcgctgatatccatatcattggggacatcaacattcgccctaataaggaatcatggaaagtgtttgaggaaatgatcgaaccttaccgcctccacgaaagctgtaaggacctgacgacggcggagaagctcaagcgggagactccttggaagatcaccgacgcggaattggaagccgttaaggagaaatcctaccgccaggtgaggctgaatgaactgttgcaggaacactcacgcgctgcgaacctgatcgtgttgagcctgccggtcgcacgtaaaggaagcatctcggacctgctgtacatggcctggctggagatactcacgaaaaacctgcctccggtcttgctggtgagaggaaaccacaaaaatgtgttgaccttctactcg

SEQ ID NO: 251100 - DNA, 3297 bp, Artificial Sequence
  Description of Artificial Sequence: Synthetic coding sequence
atgtcattgaacaattcctccaatgtgttcttggattccgtgcctagtaacactaatcgctttcaagtcagcgttattaacgagaaccatgagtcatccgctgctgctgacgataatacagatccacctcattatgaggagacatcatttggagatgaggcccagaaacgcttgcgaattagcttccggccgggcaaccaggaatgctatgacaacttcctgcagtctggagaaacggccaagaccgatgcttcattccacgcttacgatagccataccaatacatattacctacagacattcgggcataacacaatggatgccgttccaaagatcgaatactaccggaatactggctccataagcggccccaaggtgaatcgaccttctctgctggagattcatgaacaactcgctaaaaatgtcgccgtgaccccttccagtgcagacagggtggctaacggtgacggcattcccggagatgagcaggccgagaataaggaggatgaccaggcaggagtagtcaagtttggatgggtgaaaggagtcctggttaggtgtatgctcaatatctggggtgtgatgctatttataagactctcatggatcgtaggagaggccgggatcggcctcggcgtgattatcatcggcctgtctgtggtagttaccaccctgaccggcatttcaatgagcgcaatctgtacaaatggggttgtgaggggcggcggtgcctactatcttatcagcaggagcctaggtccagagtttggtgggtcaattggattgattttcgcctttgctaacgcagtggcggtggccatgtacgtggtaggtttcgccgagacagtcgtcgatctgctgaaggaaagtgactctatgatggtggatccgaccaatgatataagaataatcggcagtattactgtggttattcttcttggaatctcagtggcaggaatggaatgggaagccaaggcacaagtaatcctgttggtgatactgctgatcgcaatcgcaaattttttcatcgggaccgtgattccgagtaacaacgagaagaaatcaaggggattctttaactaccaagcatctattttcgcggagaattttgggcctcggttcaccaaaggggaggggttcttctctgtttttgctattttttttcctgccgcgactggaatcttagcaggtgccaatattagtggcgatctggaagatcctcaggacgccatcccccgggggaccatgctcgccatctttatcacaacagttgcctacctgggcgtggctatatgtgtgggcgcatgtgttgtgagggacgccaccgggaacatgaacgatacaatcatctcaggtatgaactgtaatggaagcgctgcatgcggcctgggttacgacttctctcgctgccgccacgaaccctgccagtacggactcatgaacaactttcaggtgatgtcaatggtcagcggctttgggccactaatcacagccggcatcttcagcgctactctgtcctccgccctggcgtccttggtgtctgccccaaaggtgttccaggcactgtgtaaagacaacatctacaaagccttgcagtttttcgccaaaggctacggcaaaaataacgagcctctacgtggatacatcctcacctttctgatagcaatggccttcatccttattgccgagctcaatacaattgccccgatcatttccaatttctttctagcatcttatgccttaatcaacttctcctgttttcacgccagctacgcaaagtcccctggctggcggcccgcctacggcatctataatatgtgggtctccttattcggcgccgtactgtgttgtgccgtaatgtttgtcataaactggtgggctgctgtgatcacatatgtgatagagttttttctgtatgtgtatgttacttgtaagaagcctgacgtgaactggggctccagtacacaggccctaagttacgtgtcagccttagataatgccttggaactcacaaccgtggaagatcatgtgaaaaacttcaggccccagtgcatagtgctcaccggtggacccatgacgagaccagctctcctcgatattactcatgcatttaccaagaattccgggctgtgtatttgctgcgaagtttttgttggtccccgcaagctctgcgtgaaagaaatgaattccgggatggctaaaaagcaagcctggctcatcaagaacaaaataaaggctttttatgccgccgtcgccgccgattgcttccgggacggagtcaggagcctgctccaggcttcgggcctagggcggatgaagcccaacactctcgtgatcggatataaaaagaattggaggaaagctcctttaaccgaaattgaaaactatgtgggaatcatccatgatgcgttcgatttcgaaatcggagtggtaattgtgagaattagtcagggctttgatatttcccaggtgttacaggtccaggaagagctggagaggctcgagcaggaaagattggccttggaagcgacaataaaggacaacgagtgtgaagaggagagtggggggataagaggcctgtttaagaaggcagggaaactgaatattactaagactactccgaaaaaggacgggagcatcaacacctcacagtcgatgcacgtgggcgagtttaaccagaaactggtggaggccagcacgcagtttaagaaaaagcaggaaaaggggacaattgacgtatggtggcttttcgacgacggtgggcttaccctgctgatcccctatatactgacgctacgaaagaaatggaaggactgcaagctgcgcatttatgttggcggaaagattaaccgtattgaagaagagaaaatagtgatggcatcactgctatccaagtttcggattaagtttgccgatatccacatcattggcgacatcaacatacgacctaacaaggagagctggaaggtgttcgaagagatgatcgaaccttacaggctgcacgaatcatgcaaggacctgaccactgccgagaagctgaagagagaaacaccctggaagatcaccgatgccgaactggaggctgtcaaagaaaaatcatatcggcaggtgcggctgaacgagctgttacaggaacattccagggccgcaaacctgattgtgctcagcttgcccgtagcaagaaagggtagcatctccgaccttctgtacatggcatggttggagatcctcacgaagaatctgcctcctgtgctgctagtgaggggcaaccataagaacgtgctgaccttctattcg

SEQ ID NO: 251101 - DNA, 3297 bp, Artificial Sequence
  Description of Artificial Sequence: Synthetic coding sequence
atgtctcttaacaacagctcgaatgtctttctggactcagtaccgagcaatactaaccgttttcaggtgtctgttatcaatgaaaaccatgaatctagcgcagccgctgatgacaacacagatcctcctcactatgaagaaacctctttcggagacgaggctcaaaaaaggctgcgtatatcctttaggccaggaaaccaagagtgctatgataatttcttgcagtctggagaaacggctaaaacagatgcctccttccacgcatatgatagtcacacaaacacatattacctccaaaccttcggacacaacactatggatgctgtccccaaaatcgagtactataggaacacaggttccattagtggccctaaagttaaccgacctagccttttagagattcacgaacagttagccaaaaacgttgcggtgactccttctagcgcggaccgggtggcaaacggcgatggcattccaggtgatgaacaagccgagaacaaggaagacgatcaggctggagttgttaaatttggatgggttaagggtgtactggtgcgctgcatgttgaacatttggggagttatgttgttcattaggttatcttggatagtcggcgaggctgggatcggcctgggcgtaatcattattggactatcagtggttgttaccacccttaccggaatctctatgtcagctatttgcactaatggagtggtaaggggtggaggtgcttattacttaatatccagatccttgggtcctgaattcggggggtcaattggtttaatcttcgcattcgctaatgctgttgcagtggctatgtacgtagtaggatttgctgagactgttgttgatctgctaaaagaatccgacagcatgatggtagatccgaccaatgatataagaattatcggatcaataacagttgtcatactcctcggaatttctgttgccggtatggagtgggaggcaaaggcccaggttattttgctagttatcttgcttattgcaattgctaatttctttatcgggacagtgattccgtcgaataacgagaaaaaatccaggggtttcttcaactaccaggcttctatttttgctgagaattttggtccaaggtttaccaaaggagaaggttttttcagcgtctttgctattttttttcccgctgccacaggtatattagccggcgccaacatatccggagatcttgaagaccctcaggatgccattccccgtggtactatgcttgccatttttataacaactgtcgcatacttgggagtggcgatctgcgtaggtgcttgcgttgtaagggatgctaccggaaacatgaacgatacaattatttcggggatgaattgcaacggaagtgctgcttgcggactagggtacgacttctctcgttgtagacatgagccctgccagtacggtcttatgaataacttccaagtgatgtctatggtttcaggcttcggaccacttatcacagctggaatctttagtgccactctttcgtctgctctcgcttcactcgtttctgcaccgaaggtgttccaggctctgtgtaaagacaacatatataaggctttgcagttctttgcaaaaggttacgggaagaacaatgagcctttaagagggtatattcttactttcttaattgcaatggcatttatattaattgcagagcttaacactatcgctcccattataagcaattttttccttgcgagttatgccctgattaacttctcctgctttcatgcttcatatgctaaatcaccaggttggaggcctgcctacggcatctataacatgtgggttagtttgtttggtgctgttttgtgttgcgccgtcatgttcgttataaattggtgggctgctgtcataacctatgttatcgaattttttttgtacgtatatgtaacgtgtaagaaaccagatgtaaattggggctcaagtacacaagccttatcctatgtgtccgccttggataacgctcttgagttgactaccgttgaggatcatgttaagaactttagaccccagtgcatcgtgttgaccggaggacctatgacgaggccagctctgctggatatcactcacgcatttacaaaaaattccggattgtgcatttgttgtgaggttttcgttgggcctaggaaattgtgcgtgaaggaaatgaactccgggatggcaaagaaacaagcttggttgatcaagaataagattaaagctttttacgctgctgtagccgctgactgttttcgggatggggttcgttcattactccaggcttctggtttaggtcgaatgaaacctaacacccttgtaataggatacaaaaagaactggaggaaagcccctcttacagagatcgaaaactacgtaggtatcatccacgatgcttttgactttgagatcggtgtcgttatagttagaatcagtcagggatttgatattagccaggtgttacaagttcaggaggaactagaaagattagaacaggaaagacttgcccttgaggcaactattaaggataatgaatgtgaggaagaaagcggaggaatccgtggtttattcaagaaagctggaaagcttaatataactaagaccacaccaaagaaggacggttctataaacaccagtcagtctatgcatgtaggagagttcaatcagaagttggtggaggcttctactcaattcaaaaagaagcaggagaaaggtactattgatgtttggtggctatttgatgatgggggtttgacgcttttgattccatacattttaactttgagaaaaaaatggaaggattgcaaacttaggatttatgtaggcggtaagattaatagaattgaagaagaaaagattgtaatggcttctttattgtccaaattcagaataaaattcgccgatatacacatcattggtgacataaacatcaggcccaataaagagtcatggaaggtttttgaagagatgatcgaaccatacagactccacgagagttgcaaggatcttacaactgctgagaagcttaagagggaaacaccttggaagataaccgatgctgaacttgaggcggtaaaggagaagtcttatcggcaagtgagattgaacgaacttcttcaagaacactctagagctgccaatctgatcgtgctctccctaccggtggctaggaaaggtagtattagcgatttactttatatggcgtggcttgagattctcacaaaaaacttgccacctgtacttcttgtccgaggaaaccataaaaatgtgctgaccttttattcg

SEQ ID NO: 251102 - DNA, 3297 bp, Artificial Sequence
  Description of Artificial Sequence: Synthetic coding sequence
atgtctctgaacaactctagcaacgtttttttagatagtgtccctagcaacacgaatcgatttcaagtgtctgtcatcaacgagaatcacgagagttccgcagcagcagacgacaacacggatcctccacactatgaggagacttctttcggggatgaggcccagaagagactacgcatttcctttagacccggcaatcaggagtgttacgataatttcttgcagtctggcgaaaccgcgaagactgacgcctcctttcatgcatacgatagccacaccaatacgtactatctgcagacattcggccataacacaatggacgcagtcccgaaaattgaatattacagaaacactggaagcatcagcggtccgaaggttaataggccttcgcttctggagatccatgaacagctagcgaaaaacgtcgccgtcacaccctcatcagctgatagggtggccaatggagatggtatccccggtgacgagcaagctgagaataaagaagacgatcaggctggagtggttaagtttggctgggtgaagggagtgttagtccgctgcatgctcaatatttggggcgtcatgctgtttatccgactgtcgtggattgtgggggaggccggtataggcctgggcgtgataattatcggcctgtcagtggtggtgactacccttacggggatttcgatgtcagccatctgcacaaatggggtcgtgcgcggagggggcgcttattatcttatctccaggagcctgggtccggagtttgggggaagcatcgggctgatttttgcttttgccaacgcagtggctgtggccatgtacgtggtggggtttgccgaaactgtggtggacttgctgaaagaaagtgacagcatgatggtcgaccccactaatgacatcagaatcattggatcaatcaccgtggttatcttacttggaatctcagttgcagggatggaatgggaagcaaaggctcaagtcatactgctcgtgatcctattaatagcaatcgcgaactttttcatcggaacagtaataccaagtaacaacgagaagaagtctaggggcttctttaattatcaagccagcatctttgcagagaactttggcccacgttttacgaagggcgaggggtttttttcagtgttcgccattttttttcctgccgcgacaggaatactggcgggggcgaatatttccggggaccttgaggacccacaggatgcgattccacggggcacaatgctggccattttcatcactactgtggcttacctgggggtcgccatttgcgtaggtgcctgtgtggtgcgggacgccacgggaaacatgaacgataccataattagcggcatgaactgtaatggaagtgcagcttgtgggctgggatatgacttcagccggtgtagacatgaaccttgtcagtacggcctgatgaacaattttcaggtcatgtctatggtgagcggtttcggtcctttgatcaccgccgggatcttttctgcgaccctgtcatctgctctcgcaagcttagtatctgctccgaaggtttttcaagccctgtgcaaggataatatctacaaagcgttgcagtttttcgccaagggctatggaaagaacaacgaacccctccggggttatatcctcaccttcctgattgccatggcatttattctgatagccgaactaaacacgatcgccccaataatttctaactttttcttggcctcttatgcattgatcaacttctcatgtttccatgccagttacgcgaaatctcctggttggaggcccgcgtatgggatatacaacatgtgggtcagtctgtttggagccgtgctatgctgcgccgtgatgttcgtcattaattggtgggccgccgtgatcacatatgttatagaattcttcttgtacgtgtacgtgacttgtaaaaagccggacgtgaattggggaagctcaacccaggcgctgagttacgtgtctgctttagacaacgccctcgagcttacgaccgttgaagaccacgtgaagaacttcagaccacagtgcatcgttctgactggtggcccgatgacccggcccgccttgcttgacatcacacatgcattcactaagaattccggactgtgtatctgttgcgaggtatttgtggggccccggaaactttgcgtaaaagagatgaatagtggaatggccaaaaagcaggcctggctgatcaaaaataagattaaagccttctatgcagctgttgccgcagattgctttcgagacggcgttagatcgctgctgcaggcaagtggcttggggcgaatgaaaccgaacaccctggttattggctacaagaagaactggaggaaggcccctctgactgagattgaaaactatgtgggaatcatccatgatgcatttgatttcgaaattggggtggtgattgtacggatctcgcaaggattcgacattagccaagtgttacaggtgcaggaggaactcgagagactcgagcaggagagactggccctggaggcaactattaaggataacgaatgcgaggaggagagcggcggtatccgtggattgttcaaaaaggcaggaaaattgaacatcacaaaaacaacccccaagaaagatggaagcatcaatacctcccagtccatgcacgtgggagagttcaaccagaaactggttgaagcgtctactcagtttaagaagaagcaggaaaaagggaccatcgacgtttggtggctgtttgatgacgggggtctgaccctgctgataccttacatcctgacactgcgtaaaaagtggaaagattgcaaacttaggatatacgttggcggcaaaataaatcgtatcgaagaggaaaagattgtcatggccagtttgctttcaaagtttcgcattaagtttgcggacattcacataataggtgacattaatatcaggcctaacaaagaatcctggaaggtcttcgaggagatgatcgagccttatcggttgcatgagtcttgtaaggatcttactaccgcagaaaagcttaaacgtgaaacaccatggaagattaccgatgcagaactcgaagccgttaaggaaaaatcctaccggcaggtgcgcctcaatgaattgcttcaagagcacagcagagcggccaatctcatcgtgctcagtctgcctgtagcacgtaagggatctatttctgacctactgtatatggcttggctggagattctgactaagaacctccctcctgtcctgctagtgagaggcaaccataaaaacgtactcacattttactca

SEQ ID NO: 251103 - DNA, 3297 bp, Artificial Sequence
  Description of Artificial Sequence: Synthetic coding sequence
atgtctctaaacaatagttcgaatgttttcctcgactcggtcccatctaacacaaaccggtttcaggtgtctgttattaacgagaatcacgagagctccgccgcagcggatgataatactgaccccccacactacgaagaaacctcgttcggtgacgaggcgcaaaaacggttgcgcatttcttttcgcccgggcaaccaagaatgttacgataacttcttacagagcggagaaacagccaagacagacgcgagcttccacgcttacgattctcatactaatacctattatcttcagaccttcggccataacactatggatgccgtacccaaaatcgaatactatcgtaataccggttcaatctccggacccaaggtgaaccggccttcgcttctggagattcacgaacaacttgctaaaaatgttgccgttaccccatcatccgctgatcgggtcgcaaatggcgacggcatcccaggcgacgagcaggcagaaaataaggaggatgaccaggccggcgtcgttaaatttggttgggtgaagggagttctggtcagatgcatgcttaacatctggggcgtcatgctgttcataaggttgagctggattgtgggggaggctggtataggtttgggcgtgattattatcgggctgagtgtagttgtgactaccttaaccggtatcagcatgtcagcgatttgtacaaacggggtggttaggggaggcggtgcgtactacctgatctcacgctcgctcggccctgagtttggaggcagcattgggctgatctttgcattcgcaaatgccgtagccgtagctatgtacgtcgtaggttttgcagaaaccgttgtggatcttctgaaggaatctgactcaatgatggtggatcctacgaacgacattcgtattatcggatcaatcactgttgtgattctcctcgggatctctgttgcgggtatggagtgggaagcaaaagctcaagtgatactgttggtgattttgctcattgccattgctaatttcttcattggcacggttattccttcgaataacgaaaaaaagtcgcggggtttcttcaactaccaggcatcaatttttgctgagaactttgggccccgcttcaccaagggcgaaggcttcttcagtgtgtttgcaattttcttccctgcagcgacgggaatcctcgctggcgctaacatctctggtgatctagaggacccccaggatgccattccgcgtggaaccatgcttgctatcttcatcaccaccgtggcctatttgggcgttgccatctgtgtgggcgcctgtgtcgtccgagacgctacggggaacatgaacgatacaataatctctggtatgaactgtaatggttccgccgcctgtgggttaggttatgatttctctcgttgtcggcacgagccctgccagtacggtttgatgaacaatttccaggtaatgagcatggtctcgggctttggtcctttgattacagccggaatcttctcggcgaccctaagctcggcacttgcatctctggtctctgctcctaaggtgtttcaggcactttgcaaagataacatttacaaggcgttgcagtttttcgcgaagggatatggaaaaaataatgaaccattgcgtgggtacatactcacctttctgatcgcaatggcatttatccttattgcggagcttaacactatcgcacctatcatttcgaacttctttttggcttcatacgcactgattaacttcagctgtttccatgcatcttacgccaaatctcctgggtggcgaccagcttatggaatctataacatgtgggtgtcattgttcggtgctgttttatgttgcgccgtcatgttcgttattaactggtgggccgcggtcataacctacgtaatcgagttcttcctctatgtctacgttacatgtaagaagccggacgtcaattggggttcgtcgactcaggcacttagctatgttagcgctttggataatgctttagaactcaccaccgttgaagaccacgtcaagaactttcgtccacaatgcattgtgctaaccggaggaccaatgaccaggccggcgctgctggatatcacgcatgcctttaccaagaatagcggactgtgtatctgttgtgaagtctttgtcggccccaggaaattgtgtgttaaagaaatgaattctgggatggcgaaaaagcaggcttggctcattaagaataagatcaaggccttttacgcagccgttgccgccgattgcttcagggacggagtacggtccttattgcaagcttctgggctgggtcggatgaaacccaacacgttggtcattggatataaaaaaaactggcgaaaggcaccccttactgaaattgaaaattatgttggaataattcatgatgcgtttgacttcgagatcggcgttgtcatcgtgcgtatcagtcaaggattcgatatctcccaagtcttgcaagtgcaggaggaactggagcgtctcgaacaggaaagacttgcgctagaagcgaccataaaggataatgaatgcgaagaggagtccgggggtattcgtgggttgttcaaaaaggctggcaagctaaacatcacgaagacaacccccaagaaagatggatctattaacaccagccagtcaatgcacgtgggggagtttaaccagaagctcgtcgaggccagcacccaattcaagaagaaacaggagaagggtacaattgatgtctggtggctgttcgacgacggcgggctgacgttgctcatcccctacattcttactttgcggaagaaatggaaggattgcaaacttcgcatatatgtaggtggcaagataaaccgcatagaagaagagaaaattgtgatggcctccttgctctctaaattccgcattaagttcgcggatattcatatcattggtgatataaacatccggccgaacaaagagtcttggaaagtgtttgaagagatgattgagccatatagacttcacgagtcctgtaaggatttaacgactgcggagaagctcaaacgtgagaccccttggaagatcactgatgctgagctcgaggccgttaaggaaaagtcgtaccgccaagtccggcttaacgagttgctacaggagcattccagggcagcaaatctcatcgtattgagtcttccagtcgctcggaagggttctatctctgatttgttgtatatggcatggctcgagatacttacgaagaatctacctccggtgcttctggtccgaggcaaccataagaatgtactcacgttctactcc

SEQ ID NO: 251104 - DNA, 3297 bp, Artificial Sequence
  Description of Artificial Sequence: Synthetic coding sequence
atgtctctgaataattcatccaatgtgtttctggactccgtgccctcgaatacaaacagatttcaagtgtcggttattaatgaaaatcacgaaagctcagcggcagctgacgacaataccgacccgccccattacgaggagactagcttcggcgatgaagcacaaaagcgtctgcgaatctcattccgacccggcaaccaggaatgttacgataactttttacagtcaggagaaactgcaaagaccgatgctagtttccacgcgtatgattctcacactaacacatactatcttcagacattcgggcacaacaccatggatgcggtcccaaaaatcgaatactatcgcaacaccggcagcattagcgggcctaaggttaaccggccgagcctcttggagatccacgagcaactggctaagaatgtcgccgttacgcccagcagcgccgaccgagtggctaacggagatgggattcccggggacgagcaggctgagaacaaagaggacgatcaggctggtgtggttaagttcggctgggttaagggagtactggtccgatgcatgctcaatatttggggagtgatgctgtttatcagattgagttggatcgtgggagaagccggcatcggcctgggagtcatcatcataggactgtcagtggtggtaaccaccctgaccggcatctctatgtccgcaatatgcacaaacggggtggtgaggggcgggggggcttactacctgatatcccgaagtctcggccctgagttcggggggagcattggtctgatatttgcgtttgccaacgccgtggccgttgcaatgtatgttgttggcttcgccgagacagtcgtggacctactgaaggagtccgattctatgatggtcgaccctactaatgatatccgcatcattgggagcatcaccgttgtcattttgcttggcatttctgtggccgggatggagtgggaagctaaagcccaagtcatcttactagtgatcctcttaattgccatcgctaactttttcatcgggactgtgattcctagcaacaacgaaaaaaagtctcggggctttttcaactaccaggcctccatctttgccgagaattttggccctaggttcactaagggcgaaggcttctttagcgtgtttgcaatcttctttccggctgctactgggatccttgctggagccaatatatccggcgatttagaggatccccaagacgcaatcccgcgcggaaccatgctggccatcttcattacaacagtggcatatctgggagttgccatctgtgtcggcgcctgcgtcgttagagatgcaactggcaatatgaatgataccatcatctcagggatgaactgtaatggatcagctgcctgtggtctgggctacgacttcagcaggtgtcggcatgagccgtgccagtatggactcatgaataatttccaagtgatgtccatggtgtctgggttcgggcctttgattacggccggaattttctctgccactctcagctccgcgttggcctccctggtgtctgcccctaaggtatttcaagctctctgtaaggacaatatctacaaggcactgcagttcttcgctaagggctacggcaagaacaatgaacctctgcgcggctatattctgacattcctgatagctatggcatttatacttatagccgaactgaatacgatagccccaattatcagtaatttcttcctggcaagttacgccctcattaatttctcctgttttcacgccagctacgctaaaagtcccgggtggcgcccagcgtatggcatatacaacatgtgggtgtcactctttggcgccgtgttgtgctgcgccgtgatgttcgtgattaactggtgggctgcagttattacgtatgtgatcgaattcttcctgtatgtatatgtaacctgcaagaagcctgatgtcaattggggcagtagcacccaggctctttcttacgtttcggccctagataatgccttggagttgacgacagtagaggatcatgtgaaaaacttccggccacaatgcatcgtactcacagggggacctatgactaggcccgctctgctggatattacacatgcttttactaaaaattcaggcctctgtatttgttgcgaagtctttgtgggcccccgcaagctttgcgttaaagaaatgaactctgggatggctaaaaagcaggcatggctgataaaaaacaaaatcaaagccttttacgctgctgtcgccgccgactgttttcgcgatggcgtgcgcagcctgctgcaggctagcggattaggacggatgaaacctaatacgctggtgatcggctacaagaaaaactggcggaaagctcccctcaccgaaatcgagaattacgtgggtatcatccatgacgcttttgattttgagatcggagtcgttatagtgagaatttcacagggcttcgacataagccaggttctccaggttcaggaggagctcgagcggctcgaacaagaacgcttggcacttgaggcgaccatcaaagacaacgaatgcgaagaggagagcgggggtataagggggctcttcaaaaaggccgggaaactaaacatcactaaaactacccccaaaaaggacgggtccattaacaccagtcagtcaatgcatgtcggagagttcaatcaaaagcttgttgaagctagcacccagtttaagaaaaaacaggaaaagggaacaattgacgtctggtggctgttcgatgatgggggcctgacactcttaatcccttacattctcactctgagaaagaaatggaaggactgtaagctgcggatatatgtcggggggaaaattaatagaatagaagaagaaaagattgtgatggccagcctgctcagtaagttccggattaagttcgcagatattcacattatcggggacatcaacatcagaccaaacaaagaatcgtggaaggttttcgaagagatgatcgagccatacaggctgcacgaatcctgcaaggaccttaccaccgctgagaagttaaagagagagacaccatggaagatcactgatgcagaacttgaagcagtaaaggaaaagtcataccgccaggtcagacttaatgagctgctccaagaacacagtcgggcggctaacctgattgtgctgtctctgcctgtggctcgaaaaggctccatcagtgacctgctatacatggcatggttggaaatcctgaccaagaatctgccccctgtgctgctggtgcgcggcaatcacaagaacgtgctgactttttacagt

SEQ ID NO: 251105 - DNA, 3297 bp, Artificial Sequence
  Description of Artificial Sequence: Synthetic coding sequence
atgtcgctcaacaactcgtccaatgtctttctcgatagcgtgccaagcaataccaatcggtttcaggtgtcagtgatcaacgagaaccacgaatcgtccgctgctgccgacgacaataccgatccgccacactacgaagaaacttcgtttggagacgaagcacagaagaggctccgcatttcatttaggccgggcaaccaagagtgttacgataactttctgcaatccggggagactgccaagaccgatgcctccttccatgcgtacgactcccatactaacacgtactacctgcagaccttcggacacaacacgatggatgcagtcccaaagattgaatactatcggaacactggttccatttccggacccaaagtgaaccgaccgtcgcttctcgagatccatgaacagctggcgaaaaacgtcgcggtgaccccatcttcagccgatcgggtggcgaacggagacggaatccctggcgatgaacaggctgaaaacaaggaagatgaccaagccggtgtcgtgaaattcggctgggtgaaaggagttctggtcagatgcatgctcaacatttggggagtgatgctgtttatccggctgtcatggatcgtgggcgaagcaggaattggactgggcgtgatcatcatcgggctcagcgtggtggtcactaccctcactggcatcagcatgtcagccatttgcactaacggcgtcgtgcggggcggaggagcttactaccttatttcaagaagcctcgggccagaatttggcgggtccatcggactcattttcgcctttgccaacgcggttgcggtggctatgtacgtggtcgggtttgctgaaacggtggtggacttgctcaaagaatcggactcaatgatggtggatccgaccaatgacatccgtattatcggatcgatcaccgtcgtcattctgctcggaatctccgtggcaggcatggagtgggaggccaaagctcaagtgatcctgctcgtgatcctgcttattgcgattgccaactttttcattggaactgtgatcccttcgaacaacgaaaagaaaagtagaggattcttcaattaccaggcatccatctttgcagagaatttcgggccgcgcttcaccaagggagagggattcttctcggtctttgccatcttcttcccggcggccaccggcatcctggctggagcaaacatctccggggacctggaggaccctcaggatgctatccctaggggtacgatgttggcaatcttcatcaccactgtggcctaccttggcgtggcgatctgcgtgggcgcgtgtgtggtccgggacgcgactggcaacatgaacgatactatcatttcagggatgaattgcaacgggagcgccgcgtgcggattgggatacgactttagccggtgtcggcatgaaccctgccagtacggtttgatgaacaatttccaggtgatgtcaatggtgagcggattcggaccgctgataaccgcgggaattttctcagcaaccctgtcgtcggcgctcgccagcttggtcagtgccccaaaggtgttccaagccctgtgcaaggacaacatctacaaggcactgcaattcttcgcaaagggttacggaaagaacaacgaaccgctgcgcggctacatcctgaccttcctgatagcaatggcattcatcttgattgccgaactcaacactatcgcccctattatcagcaacttctttctcgcctcctacgctctcattaacttctcctgtttccacgcctcatacgcgaagagtccgggttggcggcccgcgtatggtatttacaatatgtgggtgtcactcttcggagccgtgctgtgctgtgcggtgatgttcgtaatcaattggtgggccgcagtcattacctacgtcattgaattcttcttgtacgtgtatgtgacctgcaagaagccggatgtgaattggggcagcagcacccaagctctgtcgtacgtgagcgccctggacaatgctttggagctgactaccgtggaagatcatgtgaagaactttcgcccgcagtgcatcgtgctcactggcggaccgatgacgcggccggctctgctggacatcactcacgcgttcactaagaattccgggctgtgcatatgttgcgaggtgttcgtgggcccaaggaagttgtgcgttaaggagatgaatagtggtatggcgaagaagcaggcctggcttatcaagaacaaaatcaaggcgttctacgcggccgtcgccgccgactgcttccgcgatggcgtccgcagcttgctccaagcatccggcctcggcagaatgaagccgaacaccctggtgattggatacaaaaagaactggcgaaaagcccccctgacggagatcgagaattacgtcggtattatccacgatgctttcgactttgaaatcggtgttgtcatcgtaagaatctcccaaggattcgacatctctcaagtcctgcaggtgcaggaggaactggagcgcctggaacaggaacgcttggcgctggaggcaactatcaaagacaatgaatgcgaggaagagtccggaggaatccggggactcttcaagaaggctggaaagctgaacatcactaagactactccgaagaaagatggatctatcaacaccagccaatcaatgcacgtgggtgaattcaatcagaaacttgtcgaagcgagtacccaattcaaaaagaagcaggagaagggaactatcgacgtctggtggctgtttgacgatggcggtcttactctcctcatcccatacatcctcactctccggaaaaagtggaaggattgtaaacttcggatctatgtggggggaaagatcaatagaatcgaagaagaaaagatcgtgatggcctcgctgctgtccaagttccgaattaagttcgcagacatccacatcatcggagatatcaacatccggcctaacaaggaatcatggaaggtttttgaggagatgatcgagccgtataggctgcacgagagctgcaaggatcttactaccgcggaaaagctgaaacgagagactccttggaaaatcactgatgccgagctcgaggcagtgaaagagaaatcatacaggcaggtgcggctcaacgagctgctccaggaacacagcagagcggccaatctgatcgtcctctcactgcctgttgctcgcaaagggtcaatctccgaccttctgtacatggcttggttggagatcctgaccaagaatcttcccccagtgttgctggtgcgcggaaaccacaagaatgtgctgactttttacagc

SEQ ID NO: 251106 - DNA, 3297 bp, Artificial Sequence
  Description of Artificial Sequence: Synthetic coding sequence
atgtccctcaacaactcctccaacgtgtttctggactccgtgccgagcaatactaaccgcttccaagtgtctgtgatcaacgaaaaccacgagtcgtcagccgcagccgatgacaacactgaccctccgcactatgaggagacttccttcggtgatgaagcccagaaaaggctgcggatctcgtttcgaccaggtaaccaagagtgctatgacaattttctgcaatccggagagactgccaagaccgacgcttcattccacgcctacgactctcacaccaacacctactacttgcaaacttttggacacaacactatggatgcggtgcccaagatcgaatactacagaaacactggatccatatctggaccgaaggtgaatcgacccagcctcctggagattcacgaacaactggcgaagaacgtcgcggtgaccccgtcgagcgccgatcgggtggctaatggagacggaattccgggcgatgagcaggctgagaacaaagaggacgatcaagcaggggttgtgaagtttggttgggtcaagggcgtgctggtaagatgtatgctgaatatctggggagtgatgctgtttatccgtctgtcgtggatcgtgggcgaagctggaatcgggctcggggtcatcatcatcgggctttcggtagtggtcactactctgactggaatctctatgtctgcaatttgcactaacggagtcgtgagaggcggaggagcttactacctcatctcccgctcgctcggaccagaatttggtggctcgatcggcctcatcttcgccttcgccaacgcggtggctgtggccatgtacgtggtcggatttgccgaaacggtggtggatcttctcaaggaatcggattcaatgatggtggaccctaccaacgacatcagaattatcggctcaatcaccgttgtaatcctcctgggcatctcagtcgccggaatggaatgggaggcaaaagcacaggtcatcctgctcgtcatccttctgatcgccatcgcaaactttttcatcggcaccgttatcccatcgaacaatgaaaagaagtcccgcggattcttcaactaccaggcatcgatcttcgcggagaatttcggcccaaggttcactaagggagaaggattcttttccgtctttgccatcttcttccctgcagccactggaatccttgccggcgcgaacatcagcggcgacctggaggacccacaggatgccatcccacgcgggaccatgcttgcaattttcattaccactgtggcatacctgggtgtggcgatctgtgtcggcgcttgcgtcgtgcgggacgcaaccggaaacatgaacgatactatcatctcgggaatgaattgtaacggaagcgccgcgtgcggcctcggctacgacttctctcgctgtcggcacgaaccttgccagtacggcttgatgaataacttccaggttatgtcgatggtgtccggattcggacccctgatcaccgcgggaatcttctcggcgaccttgtcgtccgcactggcctcgctggtgagtgccccgaaagtgtttcaagccctgtgtaaagacaatatctacaaggccctgcaattcttcgccaaggggtacggaaagaacaacgagccactgagagggtacatcttgaccttcctcatcgccatggccttcatattgatcgctgagctcaacaccattgcaccaatcatctccaacttcttcctggcctcatatgccctcatcaacttcagttgcttccatgcgtcatacgcgaagtcgccgggttggcggccggcctacggtatctacaacatgtgggtgtcgcttttcggtgcggtcctgtgctgcgccgtgatgttcgtcataaactggtgggcggcggtgatcacttacgtgatcgagttctttctctacgtttacgtgacctgtaaaaagccggacgttaactgggggagctcaacccaggccctgagctacgtgtccgcgctggataatgcactcgagttgacgactgtcgaagatcacgtgaagaatttccggccgcagtgcatcgtgcttaccggaggcccgatgaccagaccagctttgctggacattacccacgcgttcacgaagaatagcggactgtgcatctgctgtgaagtgttcgttggtccgcgaaagctgtgcgttaaggagatgaacagtggcatggccaaaaaacaggcctggctcattaagaataagataaaggctttctatgcagccgtcgctgctgactgcttccgcgatggagtccggtcactcttgcaagctagcggactcggaaggatgaagccaaatacgctggtgattgggtacaagaaaaactggcggaaagcacctctgacggagattgagaactacgtggggattattcatgatgcgttcgactttgagataggcgtggtcatcgtgcggatctcacagggattcgacatcagccaggtcctgcaggtgcaagaggagctcgaacgcctcgagcaggagcggctggcccttgaagctacgattaaggataacgaatgcgaagaagaaagcggagggatcaggggcctgttcaagaaagccggcaaattgaatatcaccaaaactaccccgaagaaagacggatcaatcaatacttcacagtccatgcatgtgggtgaattcaatcaaaagctggtcgaagccagcacccagtttaagaagaaacaggaaaaggggacgatcgacgtgtggtggctctttgacgatggagggctgaccctcctcatcccttacatcctcacccttcgcaagaaatggaaagactgcaaattgcggatctacgttggaggaaaaatcaatcgcatcgaagaggaaaagattgtcatggcctccctgctcagcaagttccggattaagttcgcagatattcatatcatcggagacatcaacatcaggcctaacaaagaatcctggaaggtgtttgaggaaatgatcgagccgtaccgcctccatgaaagttgcaaggacctgaccaccgcggaaaagttgaagagagaaactccctggaagatcactgacgcagaactggaagccgtgaaggagaagagctacagacaggtgcgcctgaatgagttgctccaggaacattcacgcgcggctaacctgatcgtgctctccctgcctgtggcgagaaaaggatcaatctcggatcttctttacatggcgtggctggaaatactgaccaagaatctgccgccggtcctgctggtgaggggcaatcacaagaatgtgctcactttctactcc

SEQ ID NO: 251107 - DNA, 3297 bp, Artificial Sequence
  Description of Artificial Sequence: Synthetic coding sequence
atgtctctgaataattctagtaacgtgttcttagattctgtccctagcaacacaaaccggtttcaggtttcagtgataaacgagaaccacgagtcgagtgctgcagccgacgataacaccgacccgccacattatgaagaaacatcattcggcgacgaagcacagaaaagactgaggatttcctttagacctggcaaccaagaatgctatgataatttcctacagtccggcgaaactgcaaagaccgacgcgagctttcacgcctacgattcgcacactaacacctactacctgcagaccttcggccacaacacgatggacgccgtgccaaaaatcgaatattatcgtaatacaggatctatttcgggccccaaggtgaaccgcccctcattacttgagatccacgagcagctggctaaaaatgtggcagtgaccccctctagcgccgaccgcgttgctaacggggacggtatacctggggacgagcaagcggaaaacaaagaggacgaccaggccggagtggttaaatttggttgggtaaaaggggttctggtgcggtgtatgctgaatatatggggagtgatgctctttatacgcctcagctggatcgttggagaggcaggcattggcctgggagtcatcatcatcggattatcagtggtcgtaacgacccttacaggcatttccatgtccgccatctgtaccaacggggttgtgaggggcgggggtgcttactatttgatttctcgctcgctgggccctgagttcgggggcagtattggtctaatctttgcctttgccaacgcagttgccgtggcgatgtatgttgtcggttttgcggaaactgtggtcgaccttttaaaagaaagcgactccatgatggttgatccgactaacgatatccggattatagggagcataacggttgttattctgctggggatctccgttgccggcatggaatgggaagcaaaggcccaggtcattttgctggtcattctattaattgctattgctaactttttcattggtaccgtgatacccagcaacaatgaaaaaaagagccgggggttttttaattatcaggcttcaatcttcgccgagaattttggcccacgcttcactaaaggcgaaggttttttttctgtgttcgccatattcttccctgcagcaaccggcattctagccggtgccaacatctcaggagatctggaggatcctcaggacgcaataccccgaggcacaatgctggccatctttataacgacagtcgcgtatttaggcgtggctatctgtgtcggtgcttgcgtggtccgagacgccacaggcaacatgaacgacactatcatcagtggcatgaattgcaatggctcggccgcttgtgggttggggtacgacttttccaggtgtcgccatgaaccatgccagtatggcctgatgaacaatttccaggttatgtctatggtttccggtttcggacctcttatcacggccggaattttctcggccacgctgagcagcgccctcgcttctctggtctctgccccgaaggtcttccaggcactttgcaaggataacatttacaaggccctgcagttttttgccaagggctatggtaagaacaatgaaccgctgaggggatatatcctcacattcctgatcgcgatggccttcattctcatagccgagctcaatacaatagctcctataatcagcaacttctttctcgcgtcttatgccttaatcaatttctcctgttttcatgcgtcttacgccaaatcccccgggtggcgccctgcatacggcatatacaacatgtgggtgagtttgttcggggcggtgttatgctgtgcagtaatgtttgtgataaattggtgggcagccgtaattacctatgtgatcgaattctttctgtacgtgtatgtcacttgcaagaagccagacgtcaactggggatcatcaactcaggctctgtcttatgtctcagccctagataatgccttggagctgactacagtggaggatcatgtgaaaaacttcaggcctcaatgcatagttcttacaggaggaccaatgaccagacctgctctgctggatattacacatgcattcacgaaaaattcggggctttgtatatgctgcgaagtgtttgtaggtccccggaaactctgtgtgaaggagatgaattctgggatggccaaaaagcaggcctggttgattaaaaacaaaatcaaggctttttacgccgcggtggcggctgattgcttcagggatggtgttagaagccttcttcaggcatccggtctgggaagaatgaagccgaacaccctggtgattggatataagaagaattggaggaaagctcccctgaccgagatcgaaaattacgtcggaatcatacacgatgcatttgacttcgagatcggcgtggtgatcgtccgcatatcgcagggcttcgacatctcccaggtcttgcaagtacaggaggagctggaacggcttgagcaggaacggctcgcattggaggccactatcaaggacaatgagtgtgaagaagagtcaggggggatacgagggctttttaaaaaggcaggcaagctgaacattacgaagacaaccccaaagaaggatgggagcatcaatacgtctcagtcgatgcacgtcggtgagtttaaccagaagttggtggaggcatccacccagtttaaaaagaaacaggaaaagggtactattgacgtgtggtggctgtttgacgatggcggattgacgctgctcatcccttacatactgactcttcgcaaaaagtggaaggactgcaaacttcggatctatgtcgggggaaagatcaatcgaatcgaagaagaaaagatcgtgatggcttctcttctttcgaagttccggatcaaatttgctgatatccacatcattggtgacatcaatattaggcccaataaggaatcctggaaggtttttgaggagatgatcgagccatatagactgcatgagagttgtaaggatctgacaactgccgagaaactcaaaagggaaaccccttggaaaataactgatgcggaactcgaagcagtaaaggaaaaaagctaccggcaggtcagactcaacgagctgttacaggagcatagcagagctgcgaatctgatcgttctctccctgccagtagctcgtaaagggagcattagcgacctgctgtacatggcctggcttgagattctgaccaagaacttgccaccggtgctgctcgtgaggggcaaccacaagaacgtgctaactttttactcc

SEQ ID NO: 251108 - DNA, 3297 bp, Artificial Sequence
  Description of Artificial Sequence: Synthetic coding sequence
atgtcccttaacaactcctccaacgtctttcttgactcggttccttcgaataccaacaggtttcaggtgtccgtcataaacgaaaatcacgagtcctccgcagcagcagacgacaacaccgacccccctcattacgaagagacttcgtttggtgacgaagctcaaaagaggctcagaatctcatttagaccagggaatcaagaatgttacgacaattttctgcagtcaggtgaaactgcaaagactgatgcctcattccatgcatacgactcacatacgaatacttactatctccaaaccttcggtcacaataccatggatgcagtgccgaaaattgaatactaccggaacaccggaagtattagtggacctaaagtgaacaggccatccctgctggaaatacacgagcaactcgccaaaaatgtggccgtgaccccctcctcagcagatcgtgtcgccaatggggatggcattcccggagatgaacaagcggagaacaaggaagatgatcaagcaggagtggtgaagttcggatgggtcaaaggtgtgctggtcaggtgtatgctgaatatctggggcgtcatgctgttcattaggctttcctggattgtgggagaagccgggattggacttggagtgatcattatcgggctgtcggtggtcgtcacgactctgaccggcatatcgatgtcagccatttgtactaacggagtggtgagaggcggaggtgcgtactacctcatttcacgctcactcgggccagagttcggaggctccatcgggctcatttttgcatttgccaatgcggtcgcagtggccatgtacgtcgtcggttttgcagagactgtggtggatctgcttaaagagtcggacagcatgatggtggatccaaccaacgacatccggataattggatccatcacggtcgtgattcttctcggcatttcagtggcaggtatggagtgggaagccaaggcgcaagtcattcttttggtgattctgcttattgcaatcgcaaactttttcattgggaccgtgatcccttccaacaacgagaagaagagccggggatttttcaactaccaggcatccatattcgccgagaactttgggccgagatttaccaaaggagaaggtttcttttccgtctttgccatcttttttccagcagcaactggaattcttgcaggagccaatatcagcggggacctggaagatccacaggacgccatcccgcgtggtaccatgcttgccatattcattacgactgtggcgtacctgggggttgcaatctgtgtgggtgcatgtgtggtgcgcgatgcaaccggaaatatgaatgataccatcatctcgggtatgaactgtaatgggagcgcagcatgtggcctgggatacgattttagccgatgccggcatgaaccctgtcagtatgggctcatgaacaattttcaggttatgtcgatggtgtcgggtttcggcccactgatcaccgcaggaatcttctccgccaccctttcgtccgctcttgcatcgctcgtgtcagctcctaaagtgtttcaagctctctgcaaggacaacatctacaaggcgctgcagttctttgctaaggggtacggcaagaacaacgaaccactcagggggtacattctgacttttctgattgcaatggctttcattttgattgcagaactgaacaccattgctcctatcatctctaactttttcctggcaagctacgcactcattaacttctcgtgttttcacgcatcctacgcaaaatcgccgggatggaggcctgcgtacggtatctacaacatgtgggtcagcttgttcggggcagtcctttgttgtgcggtcatgtttgtcattaactggtgggccgcagtgattacttacgtcattgaattcttcctttatgtgtacgtgacttgcaaaaagcctgacgtaaattggggatcgtcaactcaagctctcagctacgtgagcgcacttgacaacgcccttgaactgacgaccgtcgaagatcacgtcaaaaacttcagaccccaatgtattgtgcttaccgggggaccgatgactcgacccgccttgttggacatcactcacgcatttaccaagaattcagggctttgcatttgttgcgaagttttcgtcggaccgaggaagctgtgtgtgaaggaaatgaactcgggaatggcgaagaagcaagcgtggttgattaagaacaagattaaggccttttacgctgcggtggcagccgactgtttccgcgatggagtccgttctctgctgcaggcttcaggtttgggacgcatgaaacctaataccctcgtcattggttacaaaaagaactggcgaaaggcacctttgactgagattgagaattacgtcggtataatccacgatgcatttgactttgagattggggtcgtcatcgtgcgaatatcccagggatttgacattagccaggtgcttcaagtccaggaggagttggaaagactggagcaggagaggcttgcacttgaagcaacgattaaggacaacgaatgcgaagaagagtcgggcggcatccggggtcttttcaagaaggcaggaaaacttaacattaccaaaaccactccaaaaaaggatggtagcatcaacaccagccagtccatgcacgtgggagagtttaatcagaagctggtcgaagcatcaactcagtttaagaagaagcaagagaaggggaccattgatgtctggtggctctttgatgatggaggattgacccttctgatcccatacatcctcactctgcgcaagaagtggaaggattgcaaattgagaatttacgtgggtggaaagattaaccgcatcgaagaagaaaagatagtgatggcaagcctcctctcaaagtttagaatcaaatttgcggacattcacattatcggagatatcaacattcgcccaaataaggaatcatggaaggtgtttgaagagatgattgaaccgtacaggcttcatgagtcctgcaaggatcttactactgcagaaaaacttaaacgtgaaaccccgtggaagattactgatgccgaacttgaggcagtcaaagagaagtcctaccgacaggtcagactgaatgaactgcttcaagaacactcgcgcgcggcgaacttgattgtgctgtctctgccagtcgcacgaaaagggtccatcagcgatcttctgtacatggcatggcttgaaatcctgaccaaaaatctccctcccgtgttgctcgtcagaggtaatcataagaacgtcctcaccttttacagc

SEQ ID NO: 251109 - DNA, 3297 bp, Artificial Sequence
  Description of Artificial Sequence: Synthetic coding sequence
atgagtctgaataattcgagcaacgttttcttggattctgtgccgtctaacactaaccgtttccaggtgagcgtcattaacgaaaatcacgagagcagcgcggctgctgacgataatacagatccgccgcattatgaagaaacgtctttcggcgacgaagcacagaagcgcttgcgcatctcttttcggccggggaatcaagaatgctatgataattttctgcaatccggtgagaccgcaaaaacagatgctagcttccatgcttatgatagccacaccaatacttactatcttcaaacgtttggtcataacacgatggacgcggttcctaagattgagtattatcgaaacacgggaagcattagtgggccaaaggtgaaccgtcctagcctcctagagatccacgagcagctggcaaagaacgtcgcggtcaccccatcctccgccgaccgtgtcgctaatggcgatggcattccaggcgatgagcaagccgagaacaaggaggatgaccaagccggagtggttaaattcggctgggtaaagggggtcctagttcgttgtatgctgaacatttggggggtgatgttattcattcgtctgtcctggatagtcggcgaggcgggcattgggcttggcgtgatcattattggcttgagcgtagttgtgaccaccctgaccggcatcagcatgagcgctatttgtactaacggtgttgtgcgtggtgggggtgcctattacctgatctcccgttccctgggtcctgagttcggcggcagcataggcctgattttcgcgtttgccaacgctgtggcggtcgcaatgtatgttgtcggttttgcggagaccgtagtggatctgcttaaggaatctgactccatgatggtcgacccgaccaatgacatccgtattattggtagcattaccgttgttattctgttaggcattagcgtcgcggggatggaatgggaggcgaaggcacaggtcattctgttggtcatcctgctgatcgctatcgccaatttctttattggtacggttatcccgtcaaacaatgagaagaaaagcaggggcttttttaactaccaagcaagcatatttgcggagaactttggaccccgttttactaagggagagggctttttcagcgtgtttgccattttcttccccgcggctaccggtatcttggcgggcgccaatatatccggcgatctggaagacccacaggacgcaatcccccgaggaaccatgctggcgatctttataacgaccgttgcttacctaggtgttgcgatttgtgtgggtgcctgtgtggtgcgcgatgctacggggaatatgaacgataccatcatttccggcatgaactgtaacggctcggcagcgtgcggcctaggttacgacttcagccgctgtcgtcacgaaccatgtcagtacggtttgatgaacaacttccaggtgatgagcatggtgagtggtttcggcccactcataacggcaggcattttctccgctactctgagcagcgccctggcgtcactggttagcgcaccaaaggtgttccaggcactgtgcaaagataacatctacaaggccctgcagttcttcgccaaaggttacggcaagaacaatgagccactgcgcggttatatactaactttcctgattgccatggcattcatcttaattgcggaactcaataccattgccccaatcataagcaatttctttctggcgagctacgctctgattaatttctcctgtttccacgcatcttacgcgaagtcccccggctggcgcccagcgtacggtatttataatatgtgggtttccctgttcggtgcggtgctgtgttgtgctgtgatgtttgttataaactggtgggcggcagtcattacctacgtcatcgagttttttttatacgtctacgttacctgcaagaagcctgacgttaattgggggagctctacgcaagcgctgtcgtatgtgagcgccttggacaatgcattggaactgacgaccgtcgaggatcacgtgaagaatttccgtcctcaatgcattgtgttaactggtggtccaatgacccgacctgctctgctggacatcacccatgcctttactaagaattctggtctgtgtatttgctgcgaggttttcgttggtccccgcaaactgtgtgtgaaggagatgaacagcggtatggccaagaaacaggcttggctgattaaaaataaaattaaagccttttacgcagcggtggcggcggactgctttagagatggcgtgcgcagcttgctgcaagcctctggcttgggacgaatgaagcctaacactctggttattggctacaaaaaaaattggcgcaaggctcccctgaccgagattgaaaactatgtcggaatcattcatgatgcgttcgatttcgaaataggagtcgtgatcgtccgtatctcccaaggttttgacatttcccaagtgctgcaagtgcaggaggagttggagagattggagcaggagcgcttggcgctggaggcgactatcaaagataatgaatgcgaggaagaatccggtggaatccgcggtctgttcaagaaggcggggaagctgaatatcaccaaaaccacacctaaaaaagatggaagcatcaacacctctcagtccatgcacgttggtgagtttaaccagaagttggtggaggcgtcaacgcagtttaagaagaaacaggagaaaggtaccattgacgtctggtggttgtttgatgatggcggcttgactttactgatcccgtacatcctgactttgaggaagaagtggaaggattgtaagctgaggatctatgtcgggggcaaaataaaccgcatagaagaagagaagatcgtgatggccagcctgctgtctaagttccgtattaaatttgccgatatccatataatcggcgacatcaacatcagaccgaacaaggagtcctggaaagtattcgaggagatgattgaaccataccgcctgcacgaatcctgtaaggatctgacaaccgcagaaaagctgaaacgagaaaccccttggaagatcactgatgcggagctggaggcagttaaagagaagagctatcgccaggttaggttaaatgagctgctgcaggagcattctcgcgccgccaacttgattgtcctgagcctgcctgttgcgcggaaggggagcatctccgatctgctgtacatggcttggctggaaattttgacgaagaacttgccaccggttctgctggttagaggcaaccacaagaacgtcctgaccttctatagc

SEQ ID NO: 251110 - DNA, 3297 bp, Artificial Sequence
  Description of Artificial Sequence: Synthetic coding sequence
atgagtctcaacaacagctcaaacgtgtttctggactccgttccaagcaataccaatcgattccaagtgagcgtgataaacgagaatcatgaatcatcagccgccgcagacgataacacagaccctccgcactacgaggaaacgagctttggcgacgaagcccagaaacggctccggatcagcttcagaccaggaaaccaggaatgttatgacaatttcttacagagtggagagacagctaagacggatgccagcttccatgcttatgatagtcatacgaacacctactacctccaaacttttggacacaatacaatggacgctgtccctaaaattgaatattaccgcaatacaggctccatctcaggcccaaaagttaatcggccaagccttctcgaaatccatgaacagctcgccaagaacgtcgccgtaacaccatcaagtgcagacagggtcgccaatggcgatggtattcccggagatgaacaggcagaaaataaggaagatgatcaggctggagtggtgaaattcggttgggtaaaaggcgtactcgtgcggtgcatgctcaatatatggggcgtcatgctgtttatccggctatcatggattgtgggtgaggcagggattggcctgggcgtgataatcatagggctgtccgtggtggtgacaaccctgacaggcatatccatgtccgcgatatgcacaaatggagtcgtgcggggcggaggagcatactacctgatttcccggtcgctcggacccgaatttggcggaagcatcggtctcatatttgcctttgccaacgctgtagccgttgccatgtacgtggtgggcttcgcagagactgttgtggatctgttgaaagaatctgatagtatgatggtggaccccacaaatgacatccggattatcggttcaatcactgtggtcatcttactgggcatttcagtggcaggaatggagtgggaagccaaggcccaggtgattctgctcgtgattctcctgatcgccattgcaaatttttttattgggacggtgatccccagcaacaatgagaaaaagtctcgcggtttttttaactaccaggctagcatcttcgctgaaaactttggtccacgcttcaccaaaggagagggttttttctccgtgttcgccatcttcttccccgccgctaccgggattctcgccggagcgaacatttccggcgatttggaggacccacaagacgcaatcccacgagggactatgctggccatatttatcacaaccgtcgcttacttgggggtggccatctgtgttggagcctgcgtagtgcgcgacgcaactggcaacatgaacgacacaatcatcagtggaatgaattgcaatggtagtgccgcttgtggactgggctacgacttttctcgctgccggcatgaaccttgccagtatggcttaatgaataacttccaggttatgagtatggtgtccggttttggcccactcattactgcaggcatcttttctgcgaccctcagctcagcactggcaagccttgtgtccgcccccaaggtgtttcaggccctgtgcaaggataatatttataaagcattgcagttcttcgccaagggctatgggaagaataatgaacctctcagaggctatattctaacgtttctgatcgctatggcatttattctgattgcagagctgaataccattgcccccatcatcagtaactttttccttgcctcttacgcgttgataaatttctcttgctttcacgcgagttacgccaaatcccccgggtggagacctgcctatggtatttataatatgtgggtttcgctgttcggggctgtactgtgctgtgctgtgatgtttgtgatcaattggtgggcagcagttattacttacgtcatagagttctttctttacgtatacgttacctgcaaaaagcctgacgtgaattgggggagctccacacaggccctgtcctacgtcagcgcacttgataacgcgctggaactgaccaccgtggaagaccatgtaaaaaactttcggcctcaatgtattgtacttaccggggggcctatgactcggcctgctcttcttgacattacccacgcttttacaaaaaactcaggactatgcatctgttgcgaggtatttgttggcccccgtaagctctgcgtgaaggaaatgaactctgggatggctaaaaagcaggcctggctgatcaaaaataaaatcaaggcattctatgctgctgtggctgcagactgcttccgggatggtgtgcgttcactcctgcaagcatctggcctaggcagaatgaagccaaataccctggtcattggctataagaaaaactggcgaaaggcgccactgactgagattgaaaattatgtgggaattatccacgacgcatttgacttcgaaattggcgtcgtgatcgttcgaatctctcagggatttgacatctctcaggtgctgcaggttcaggaggagttggagcgcctcgagcaggagaggctcgctctcgaagcaaccatcaaggacaatgagtgcgaggaggaaagcggagggatccgggggcttttcaagaaagccgggaaattaaatataaccaagaccacaccaaaaaaggacggttccataaatacctctcagagcatgcacgttggagaatttaaccagaaactggtggaagccagcacgcaatttaaaaaaaagcaggagaaaggtaccattgacgtctggtggctgttcgatgatgggggtcttactctgttgattccctatatcctgaccctccgcaaaaagtggaaggactgcaaattacggatatacgtaggggggaagatcaacagaattgaggaggagaagatcgtgatggcttctttgctgagcaaattccgcatcaagtttgcggacatacatatcatcggtgatattaacattcggcccaacaaggagagttggaaagtcttcgaggagatgatagaaccatataggctgcatgaatcttgtaaggatcttaccacagctgagaagctgaaaagagaaactccatggaaaattacagatgccgagctcgaggccgttaaggaaaaatcttaccgacaggtcaggctgaacgaactgctgcaggaacactctcgcgccgccaacttgattgtcctatctttacccgtcgcacggaaggggtcgatttctgatctcctttacatggcatggcttgaaattcttactaaaaacctgccaccggtgctactggttagagggaatcataaaaacgttcttaccttctactca

SEQ ID NO: 251111 - DNA, 3297 bp, Artificial Sequence
  Description of Artificial Sequence: Synthetic coding sequence
atgagtttgaacaactcatcaaatgtctttttggattccgtaccctccaacacaaatagattccaggtgtcagtgataaacgaaaaccatgagtcaagcgccgccgcagatgataacaccgatccaccccattatgaagaaacctctttcggggatgaggcccagaagaggcttagaatctctttccgccctggtaaccaggagtgttacgacaattttcttcagtccggagaaacagctaaaacggacgcttcatttcatgcctacgatagtcataccaacacttattacctgcaaactttcgggcacaatactatggatgcagtgcccaagattgaatattataggaacactgggagcatcagtggacccaaggtcaacaggccatccctgctcgaaatccatgagcagttggccaaaaacgtagctgtgacaccctccagcgccgatagggttgccaacggcgatgggatcccaggagacgagcaggccgaaaacaaggaggatgatcaggcaggtgttgtgaagttcgggtgggtgaaaggggtgctggtccgctgtatgctgaacatttggggggtgatgctcttcataagactgagttggattgtgggtgaggctggtatcggactgggagtgattattatcgggctgagtgtggtagtgactacccttaccgggataagtatgtccgcgatatgcacaaacggagttgtgagaggagggggcgcttactatttgatcagcagatccctcgggccagaattcggcggctccatcgggctgattttcgcgttcgccaatgccgtggccgtagccatgtacgttgtgggtttcgcagagactgtggtagacctgctcaaagagtccgactctatgatggttgacccgacgaatgatatccgcatcatcggcagtattacagtggtcatcctgctggggatctccgtggccggaatggagtgggaggcaaaggcgcaagtgattcttctggtgattctgcttattgcaattgcaaactttttcattggtactgtcatcccctctaacaacgagaagaagagccgcggtttcttcaattaccaggcttcaattttcgcagaaaacttcggccctaggttcaccaagggcgaggggttcttcagcgtgtttgctattttctttccagctgctaccggaattctggcgggcgccaatatctctggcgatttggaagaccctcaggacgccattcctaggggtactatgctggctatcttcattaccactgtggcttatctcggggtagccatctgtgttggggcgtgcgtcgtgcgcgacgccactggcaatatgaatgacactatcatctccggcatgaattgtaatgggtcagccgcgtgcgggcttgggtatgacttcagtagatgcaggcacgagccttgccaatacggactgatgaacaacttccaggtgatgtcaatggtctccggcttcggcccactcataacggctggcatattcagcgcaacgctgagcagcgctcttgcttccctcgtgtcagctcccaaagtgttccaagccttgtgcaaagataatatttataaagcgctgcaattttttgcaaagggatatgggaaaaacaatgaaccccttagggggtacatattgacattcctgatcgcaatggcctttatcctcattgcggaactcaacaccatcgccccgattatctccaatttcttcctcgcctcctacgccctgatcaatttcagctgctttcatgccagctacgctaaatcccctggctggagacccgcctatggcatctataatatgtgggtgtcacttttcggcgcagtcctgtgctgcgccgtcatgttcgtgatcaattggtgggccgccgtgattacatatgtgatagagttttttctctacgtctatgtgacctgcaaaaagccagatgttaactggggatcaagtacccaagccctttcatacgtgagtgccctcgataatgccctcgaactgactaccgtggaggatcatgtcaagaacttccgcccccagtgtatcgtcctcacaggaggcccaatgaccagacctgcactcttggatattacacatgcttttaccaaaaactccggactctgtatatgttgcgaggtgtttgttggaccccgaaaactgtgtgtgaaggagatgaatagcgggatggctaagaagcaagcgtggctcatcaagaacaagatcaaggctttctacgcagcagtggctgcagactgttttcgagacggtgtgcggtccctcctgcaagcttctgggctgggccgcatgaagccaaacacactggtgattgggtacaagaagaactggaggaaggcaccactgacagagattgagaactatgttgggattatccacgacgcgttcgatttcgagattggcgtagtgatagtccggatcagtcagggttttgatatttcccaagtgctgcaagtccaggaggagttggagcggttggaacaagagcgacttgccctggaagccacgattaaagacaatgagtgtgaggaggaatcaggggggattcgaggactgtttaaaaaagccggaaaattgaacatcacaaaaaccacacccaaaaaagacggatccatcaacacttctcagtcaatgcatgtgggggagttcaaccagaagctggttgaggcctcaactcagttcaagaagaaacaggagaaaggcactattgacgtttggtggctgttcgacgatggagggcttacccttctcatcccttatatcctgaccctgaggaagaagtggaaggattgcaaactccggatatatgtgggagggaagatcaaccgaattgaggaggagaagatagtgatggcaagcctcctctccaaatttcgaataaagtttgcagacatccatattatcggtgacataaacatccgcccaaacaaagagagctggaaggtgtttgaggagatgatcgagccctaccggctccacgagtcatgtaaagacctgactactgccgaaaagctcaagagggaaaccccctggaagataaccgatgctgagcttgaggctgtgaaggagaaaagttaccggcaagtccgcctgaacgaacttctgcaggagcacagtagagcagccaatctcatcgtgctctccctgcctgtggccagaaagggctccatctctgatctcctgtacatggcgtggctggagatattgaccaaaaatcttccacctgtgctgttggtgagaggaaaccacaagaacgtccttactttctatagt

SEQ ID NO: 251112 - DNA, 3297 bp, Artificial Sequence
  Description of Artificial Sequence: Synthetic coding sequence
atgagcttgaacaacagcagtaatgtgttcctcgactcagttccatccaacacaaaccgttttcaggtatcagtgatcaacgaaaaccatgagtcttccgccgccgctgatgataataccgaccctccccattatgaagaaacctccttcggggacgaagcccaaaaacggctcagaatttcttttcggcctggcaaccaggaatgttacgataacttcctccagtctggtgagacagccaaaacggatgcgagtttccacgcctatgacagccataccaacacatattatttgcagacattcggtcacaataccatggatgccgtacctaagatcgaatattatcggaataccggtagcatttcgggcccaaaggtgaataggccatcactgttggaaatccacgaacagctggccaagaacgtggccgttactccctccagtgctgaccgcgtggcaaacggagacgggatacccggggatgaacaggccgaaaacaaagaggatgatcaggcaggtgtagttaagtttggctgggttaagggagttttagtgcgatgtatgctcaacatctggggggtcatgctgtttataaggttgtcatggattgtaggagaggccggcattggccttggggtgattattatcggcctttcagtggtcgtgaccactctgaccggtatctccatgtctgcaatctgcactaatggtgtggtgagaggtggcggagcatattatctgatcagtaggagcctcggacccgaattcggaggctccatcggcttgatcttcgcatttgccaatgcggtcgccgtggccatgtatgtggttgggttcgctgagaccgtggtggatctgcttaaggaaagtgatagtatgatggttgatcccacaaacgatatccgcatcatagggtccattactgtagtgatcctgttgggaatctccgtcgccggcatggaatgggaggccaaggcccaagttatcctgctcgtgatcctgctgatcgccattgctaacttcttcatcggaaccgtgatacccagtaacaatgaaaaaaagagtcggggtttttttaattatcaggcttctatatttgcagagaattttggccctcggttcacgaagggcgagggctttttcagcgtgtttgccatttttttcccagctgcaaccgggatccttgcaggagctaacatttctggcgatttggaggaccctcaagatgcgataccacggggtactatgttggccatcttcattactacagtggcctacttaggagtggccatttgcgtgggtgcttgtgtggtgcgggacgctacggggaatatgaatgatacaattatttcagggatgaattgcaacggttccgcagcctgtgggctcgggtacgatttttctaggtgtcgacacgagccctgtcaatacggactgatgaataactttcaggttatgtccatggtgtcgggattcgggccccttatcaccgccggaatattctccgccaccctatcgagtgccctagcgtccttggtttcagcacctaaggtattccaagccctgtgtaaggataacatctataaagctttgcagtttttcgccaagggttacgggaagaataatgagccccttcggggttacattctaacattcttgatcgccatggccttcatactcattgcggaacttaacacaattgctccaattatatctaacttctttctggcctcatatgccctaatcaacttttcttgtttccatgcatcatacgctaagagcccaggctggcgcccggcctacgggatctataatatgtgggtgtctctgtttggagccgtcttatgctgtgcagtaatgttcgtcataaattggtgggctgcagtgataacctacgtgattgagttcttcctatatgtctatgttacttgcaaaaagcccgacgtaaactggggtagttccacccaggctctatcatacgtgtcagcactcgataatgccttggagctgacaacggtggaagaccacgtgaagaattttagacctcagtgcatagtccttactggaggtcccatgaccaggcccgccctgctggacattactcatgcattcaccaaaaacagtggtctctgcatctgttgcgaagtcttcgttggacccaggaagttgtgcgtaaaagaaatgaattctggtatggccaagaaacaggcctggctgattaagaacaaaatcaaagctttctacgcggcagttgcagccgactgttttcgcgacggggttcgctccctgctccaggcttcaggcctgggtcggatgaagcccaatacactcgtgattggatacaaaaagaactggaggaaagccccccttaccgagattgagaactacgtgggtatcatccacgatgctttcgatttcgaaattggagtcgtcatagtccgtatctctcagggcttcgacatctcacaggtgctccaggttcaggaagagttggaaagactagagcaagagagactggcgttggaagctacaatcaaagataatgaatgcgaggaggagtcagggggtattagagggctgttcaagaaggccgggaaattaaacattaccaagacaactcccaaaaaagatggaagtattaacacgtcccagtcaatgcacgtgggggagtttaatcaaaagttggtggaagcctctacccagtttaagaagaagcaggagaaggggacgatcgacgtgtggtggctgtttgacgacggagggctcacgttgctgatcccttacatattgacacttaggaagaaatggaaagattgcaaactgcgaatttacgtcggcggcaagattaataggattgaagaagaaaagatcgtaatggcatctttgcttagcaaatttcgaattaaattcgcagatatccatatcatcggcgacataaatatcaggccaaacaaggagagctggaaggtatttgaagagatgatcgagccctatagactccacgagagctgcaaagatctgacaaccgcagaaaaactaaagcgcgagacaccatggaaaatcaccgacgccgaactggaggctgtgaaagaaaaatcctaccgccaggtgaggctgaacgaactgctgcaggaacactcccgcgctgctaacctgattgtgctgtcccttccagtcgcgagaaaaggatctatatctgacctgctttacatggcgtggctggaaatcttaactaaaaatttaccacccgtactactcgtgcgaggcaatcacaagaacgtactgacgttctactct

SEQ ID NO: 251113 - DNA, 3297 bp, Artificial Sequence
  Description of Artificial Sequence: Synthetic coding sequence
atgtccctgaataactcctcaaacgtgtttcttgatagcgtgccttcgaacactaaccgttttcaagtctccgtcataaacgagaaccacgaatcatctgctgcagcggatgataatactgatcctcctcactacgaagagactagctttggtgatgaagctcagaagagactgcgcatctcctttcgtccaggtaaccaggaatgttatgataactttctgcaatcgggcgagactgccaaaaccgacgccagctttcatgcgtacgattcccacaccaacacctactaccttcagacctttgggcataataccatggacgctgtcccgaaaattgagtactaccggaataccggcagcatttcgggaccaaaggtgaatcggccaagcctccttgagatccatgagcaactcgcaaagaacgtggctgtgacccctagctccgcggaccgcgtggctaatggagacggcatccctggagacgaacaagcagaaaacaaggaggacgatcaagccggtgtggtcaagttcggatgggtcaagggcgtcctggtgcgctgtatgctgaacatatggggagtgatgctgttcattcgcctttcgtggattgtcggtgaagccggtattggtctgggtgtgatcattattgggcttagcgtggtcgtcaccaccctcaccggaatttcgatgtcagcgatttgtaccaatggtgtggtcaggggtggtggagcgtactaccttatctcccggagccttgggcctgagtttgggggttcgattggcctgattttcgccttcgctaacgctgtggcggtggcaatgtacgtcgtgggatttgccgaaactgtggtggatcttctgaaggaatcggattccatgatggtggatccaaccaacgatatacgaatcattggatccattactgtcgtgattctcctcggaatatccgtggccggtatggagtgggaagcaaaagcacaggtcatactgctcgtgatactcctcatcgcaatcgcaaacttctttattggcactgtgattccaagcaacaacgagaagaaatctcgcggatttttcaattaccaggcctcgatatttgccgagaactttggacccagatttacgaagggtgaaggcttcttcagcgtgtttgcaatctttttcccagcagcaaccggtatactggcaggagcgaacattagcggcgacctcgaggatccgcaggatgcgattccccgcggcaccatgctggccatattcataaccactgttgcataccttggtgtggcaatatgtgtgggagcatgcgtggttagagatgcaactggaaacatgaatgatactatcatttcaggcatgaattgcaatgggtcggctgcgtgtggccttgggtacgacttttcgagatgtagacatgagccctgtcagtacgggcttatgaacaactttcaggtgatgtcgatggtttcaggttttggaccgctcattacggcaggaattttctcggctactctgtcgtccgcattggcatcgctcgtctcagctcctaaggtgtttcaagccttgtgtaaagacaacatttacaaagccttgcagttttttgccaagggctacggaaaaaacaacgaacccctgagaggctatatccttacctttctgatcgcaatggcattcattctcatagcagaattgaatactatagccccaattatctcgaatttctttctggcatcatacgcattgattaacttttcgtgttttcatgcatcctacgcaaagtcgccaggatggcgaccagcatacggaatctacaatatgtgggtgtcgctgtttggtgcggtcctttgctgcgcagtcatgtttgtcatcaattggtgggcagcagtcattacttacgttatcgagttctttctgtacgtgtatgttacttgtaagaagcctgatgtgaattggggatcttcgactcaggcactgagctacgtctcagcccttgacaacgctctcgaacttactactgtggaggatcatgtcaagaattttcgcccccaatgtattgtcctgacggggggcccgatgacccgcccagctcttttggatataacccacgcatttactaaaaactcaggactgtgtatttgctgcgaggtgtttgtggggcctcgcaagctgtgcgtcaaggagatgaattcgggtatggctaagaagcaagcatggcttatcaagaacaagattaaggcattctacgcagcagtggcagcagattgctttcgagacggtgtacgatcacttcttcaagcatcaggtcttggcaggatgaagcctaatactctggtgattggatacaaaaagaactggcggaaggcccctctcactgaaatcgagaattacgtggggataatacacgatgcctttgatttcgaaattggagtcgtgatagtgcgcatttcccaaggattcgatatttcgcaagtgcttcaagtgcaggaggaactcgaaagacttgaacaagaaaggctcgcactcgaagctaccatcaaggacaacgaatgtgaggaagagtcaggtggaattcgcggcctgtttaagaaggcaggcaaacttaacataaccaagaccacgcctaagaaggatggctccattaacactagccaaagcatgcacgtcggtgaattcaatcaaaagctggtggaagcgtccacgcaattcaaaaagaaacaagagaagggtaccatcgatgtgtggtggcttttcgacgatggtggtctgactctgcttattccttacattctgacccttaggaaaaagtggaaggactgtaagctgcgcatttatgtgggcggtaagattaacagaatagaagaagaaaagatagtgatggcgagcttgctttccaagtttagaataaagttcgcagatattcatatcattggggatatcaatatccggcctaacaaagagagctggaaggtgtttgaagaaatgattgagccgtatcgactgcatgaatcctgcaaggatttgaccaccgcagaaaagctcaagagagaaactccttggaagataactgatgcagaactggaggcagtgaaggaaaaatcctaccggcaggtcaggcttaatgaacttttgcaagagcattcaagagcggctaaccttattgtcctttcgcttcctgtggctcgcaaaggatccatatcggacctcctgtacatggcatggctggaaatactgaccaaaaatctgcctccggtgctgcttgtgagaggcaaccacaagaacgtcctcactttctactcc

SEQ ID NO: 251114 - DNA, 3297 bp, Artificial Sequence
  Description of Artificial Sequence: Synthetic coding sequence
atgagcctcaacaattcctccaatgtgttcctggactccgtgccgagcaacactaataggttccaggtgtcggtgatcaatgaaaatcatgagagcagcgccgcggcagacgacaatacggatccaccacattacgaggaaacttcattcggcgatgaggcgcagaagagattgcgcatctcctttcggcctggaaaccaggaatgctacgataacttcctgcaatcgggtgaaactgccaaaaccgatgcctcgttccacgcgtacgactcccacaccaacacttactatctgcagacttttggacacaataccatggacgcggtgccaaagattgaatactacagaaacaccggctctatttcaggcccgaaggtgaatagaccgtccctcctcgaaatccatgagcagctggccaagaatgtcgcggtgaccccgtcgtcggccgatcgggtcgccaacggggacggaatcccgggagatgaacaggccgagaacaaagaggatgaccaggccggagtcgtgaagttcggttgggtgaaaggagtgctggtgcgatgcatgctcaatatctggggagtcatgctgttcatcagactgtcgtggattgtgggagaagcgggaattggcctgggtgttatcatcatcggcctgagcgttgtggtcaccacccttactgggatctccatgtccgcaatctgcacgaatggagtggtcagaggaggtggagcctactacttgatttcgcgctcactggggcccgaattcggagggtctatcggactgatcttcgcctttgccaatgcggtcgccgtcgcgatgtacgtggtgggttttgctgaaactgttgtcgatttgctcaaagagtcagattccatgatggtggaccccactaatgatatccggatcatcggaagcatcaccgtggtgatcctgctcggcatctcagtcgccggaatggaatgggaggccaaggcccaggtgatcctcttggtgatccttctcattgcgatcgccaacttctttattggcaccgtgatcccatctaacaatgagaagaaatcgcgcggattcttcaactaccaggcatcaatcttcgcagaaaacttcggaccacgcttcaccaagggagaaggattcttcagcgtgtttgcaatctttttccccgcggccaccggtatcctcgcaggtgccaacatctcaggggacctggaggatccccaagatgccattcctcgagggactatgctggcgatcttcatcactactgtggcctacctgggagtcgccatctgcgtcggagcttgcgtggtcagggacgctacgggaaatatgaatgacactatcatctccggcatgaactgcaacggctccgccgcatgcggactgggatacgacttttcaaggtgtcggcacgagccatgtcagtatggactgatgaacaattttcaggtcatgagcatggtgtccggattcgggcctctgatcaccgcaggaatcttctcggccaccctgtcgagcgccctggcctcactcgtctcagcgccaaaagtgtttcaagcgctgtgcaaagacaacatctacaaagccctgcagttcttcgccaagggctatggaaagaataacgaaccactccgcggatacatcctcacttttcttatcgccatggcttttatcctgatagcagaacttaacactatcgcgccaatcatctcgaatttcttcctggcctcatacgcgctgatcaatttctcgtgcttccacgcatcttacgccaagagccctggctggaggccggcgtacgggatctacaatatgtgggtttcccttttcggcgccgtcctgtgctgcgccgtgatgttcgtgatcaactggtgggccgccgtgatcacctacgtgatcgaattcttcttgtacgtttacgtgacttgtaagaaaccggacgtcaactggggctcgagcacccaagccttgtcctacgtgagcgctcttgataacgcccttgagcttaccaccgtcgaagatcacgtgaagaactttcgacctcagtgcatcgtgctgaccgggggaccgatgactcgcccagctctgctcgacatcacccacgcattcaccaagaattccggattgtgtatctgctgtgaggtgttcgtgggaccgagaaagctgtgcgtgaaagaaatgaatagcggaatggccaaaaagcaggcgtggctcattaagaacaaaatcaaggcgttttacgcagccgtggctgcggactgcttccgcgatggagtccggtcgctgctccaggccagcgggctggggaggatgaaaccgaacacccttgtgatcggatataagaagaactggcgcaaggccccgctgaccgagatcgaaaactatgtcggaatcatccacgacgccttcgacttcgaaattggggttgtcatcgtgcgtatctctcaaggcttcgacatctcccaggttctgcaagtgcaagaagagctggagagactcgaacaggaacggctcgcccttgaggcaacgatcaaggacaatgaatgtgaagaagagtcgggtggaatcagagggctcttcaaaaaggccggcaagttgaacatcactaagactacgcccaagaaggacggatcgatcaacacgagtcagagcatgcacgtgggagaattcaaccaaaaactggtggaagcgtcaacccaattcaaaaagaagcaggagaaggggaccatcgacgtgtggtggctgttcgatgacggtggcctcactcttctcatcccgtacatcctgactcttcgcaagaaatggaaggactgtaagctgcggatctacgtgggcggcaaaatcaacagaattgaggaagagaagatcgtgatggctagcttgctctcaaagtttcgcatcaaattcgcggacatccacatcattggtgatatcaacatccgcccaaacaaggagtcgtggaaggtgttcgaggagatgattgaaccttaccgcctccacgaaagctgcaaggacctgacgactgccgagaagctgaagcgggaaacgccgtggaagatcactgacgctgagctcgaagccgtcaaagaaaaatcctacagacaggtccgcctgaacgaattgcttcaagaacactcccgggcagcaaacctcatcgtgctgtccctcccagtggctagaaaggggtcgatcagcgacctgctgtatatggcctggctcgaaatcctcaccaagaacctccctcctgtgctcctggtgcggggaaaccacaaaaacgtcctcactttctacagc

SEQ ID NO: 251115 - DNA, 3297 bp, Artificial Sequence
  Description of Artificial Sequence: Synthetic coding sequence
atgtctctgaacaattccagcaacgtcttccttgactccgtgcctagcaacacaaaccgcttccaagtgtccgtcatcaatgagaatcatgaatcctccgccgctgccgatgacaacactgaccccccgcactacgaggagactagcttcggcgacgaggcccaaaagcgtttgcggattagcttccgacctggcaatcaagagtgttatgataactttcttcaatccggcgagacggctaagaccgatgccagcttccatgcctacgattctcacactaatacctattacctgcagacattcggccacaacacgatggatgctgtgccgaagatcgagtactaccgcaacacgggttccatctctggccccaaggttaatcgcccttcccttcttgagatccacgagcagcttgccaagaacgttgcggtaactccttcgtccgccgaccgcgtggctaacggggacggcatccctggggacgagcaggcggagaataaggaggacgatcaggccggcgtcgtaaagttcggctgggttaagggcgttctggtgaggtgtatgctgaacatctggggcgttatgttgttcatacgcctgtcctggatcgtgggggaggccggcatcggtctgggcgtcattatcatcggtctgtccgtcgtcgtcacaacccttaccggcatctccatgtccgcgatctgcacgaacggggtggtgcgcggtggaggtgcctactaccttatcagccgttccctcggcccggaattcggaggctctatcggcctgattttcgcctttgcgaacgcggtggccgtcgctatgtatgtggtcggtttcgcagaaaccgtggttgacctgctcaaggaatcggactcgatgatggtcgaccctaccaatgacatccggattattggctcgatcacggtcgttattctccttggtatctcagtggccggaatggaatgggaagccaaagcccaggtcatccttctcgtcatcttgctgatcgcgattgccaactttttcatcggtactgtcattccttccaacaacgagaaaaagagcagaggattctttaactaccaggcttcgatcttcgccgagaacttcggacccagattcacgaagggtgagggatttttcagcgtgttcgcgatcttcttccccgcggcgacgggaatcttggcgggtgcgaacattagcggggacttagaagatccccaagacgcgatcccccgaggaaccatgctcgctatcttcatcaccaccgtcgcttacctcggcgttgccatttgtgtcggggcctgtgttgtgcgtgatgccacaggcaatatgaacgacacgatcattagcggcatgaactgcaacgggtccgctgcttgcggactgggttacgatttctcccgttgccggcacgagccgtgccagtacggtctaatgaacaatttccaggtgatgagcatggttagtggcttcggtcctcttatcacagccggaatcttcagcgcgaccctgagctccgctctggcctcactcgtgtccgcccccaaggtgttccaggctctgtgtaaggacaacatctataaggcccttcagttctttgctaagggatacggcaagaacaatgagcctctgcgtgggtacatcctcaccttcctcatcgcgatggctttcattctgatcgccgagttgaatacaattgctcccattatttcgaactttttcttggcatcttacgccctaatcaactttagctgttttcatgcctcctacgccaagtcccccggctggcgtcccgcttacggaatctacaacatgtgggtgtctctcttcggcgccgtgctctgttgtgctgtgatgttcgtaatcaactggtgggctgccgtcatcacgtacgtcatcgagttcttcctgtacgtctacgtcacctgcaagaagcccgacgtgaactggggtagctccactcaagccctgagctatgtctccgcgctagacaacgcgttggagttgaccaccgttgaagaccatgtcaaaaacttccgcccacagtgtatcgtgctgaccggcggacctatgacgcgcccagctctgctggacattacgcatgccttcaccaaaaactccggcctgtgcatatgctgcgaagtcttcgtcggaccacgcaagctctgcgttaaggagatgaacagcggaatggctaagaagcaagcatggttgatcaagaacaaaatcaaggctttttacgccgctgtcgctgcggattgcttccgagacggcgtgagaagcctgctccaggcttccggcctgggtcggatgaaaccaaataccctcgtcatcgggtataagaagaactggcgcaaggctccactcacggagatcgaaaactatgttggtatcatccacgacgcgttcgactttgagattggtgtcgtcatcgttcgtatcagtcaaggtttcgatatctctcaggtgctgcaagtccaggaagagctggagcgccttgagcaggagaggctcgcactcgaagcaactattaaggataatgagtgtgaggaagagtcgggcggcatccgcggtttatttaagaaggccggaaagttaaatatcacaaagacgaccccgaagaaggacggctcaatcaacacctctcaatctatgcacgtcggagagttcaaccaaaagctggtcgaagcgtcaacacaattcaagaagaagcaggagaagggtaccattgacgtgtggtggctcttcgatgatggaggtctcacccttctgatcccgtacatactcaccctgcgcaagaagtggaaggattgtaagctacgtatctacgttggcggcaagattaaccgaattgaggaggagaagatcgtgatggcgtctctgctgtccaagttccggatcaagttcgccgacatccacatcatcggcgatatcaacattaggcccaataaggagagctggaaggtcttcgaggaaatgattgagccataccgcttgcacgagtcctgcaaggatttgaccactgcagagaaactcaagcgcgagaccccctggaagattaccgacgcggagctggaggccgtaaaagaaaagtcgtaccgccaggtccgtctgaacgaacttttgcaggagcatagtcgcgcagcgaacctcatcgtgcttagcctgccagttgctaggaagggaagcatctccgacctcctctatatggcttggctggagatcctcacgaagaatctcccgcctgtactgcttgtgaggggtaaccacaaaaacgtactcaccttctatagc

SEQ ID NO: 251116 - DNA, 3297 bp, Artificial Sequence
  Description of Artificial Sequence: Synthetic coding sequence
atgagccttaataattcctcgaacgttttccttgatagtgtgccgtctaacacaaatcgtttccaggttagcgttattaacgaaaatcatgagtcatctgcagccgcagatgacaatacagacccgccgcattatgaagaaacttcgtttggtgatgaagctcaaaagagattgagaatttcttttcggcctggtaatcaggaatgttatgataacttcttgcagagtggagaaacggccaaaacagatgcttcttttcatgcttacgactcacatacgaatacctattatttgcagacgtttgggcataacacaatggacgctgtcccgaaaattgagtattaccggaatactgggagcatcagtggaccaaaagttaaccggccttctctgctcgaaattcatgaacagcttgctaaaaacgtcgctgttacaccttcatccgctgaccgggtggctaacggagacggaataccgggcgatgagcaagccgaaaacaaagaagatgaccaggccggcgtggttaaatttggatgggtcaaaggtgtcctagttcgctgcatgctaaatatttggggagtcatgttgtttatccggcttagttggatcgttggcgaagccggcattggcctgggagtcattattatcggtctttcagttgtagttaccacgcttaccggcatttctatgtcagccatttgtacgaatggggtcgttcgtggaggcggtgcgtactatctgatttcacgctcattgggaccggaatttggtggtagtataggccttatctttgcatttgcgaatgctgtcgctgttgcgatgtatgtagtggggtttgcagaaacagtcgttgaccttttgaaagaatctgattctatgatggtggatccaacgaatgatataagaatcataggcagcatcacggtcgtgatcctgcttggtataagcgttgctggtatggaatgggaggccaaggcgcaggtcatcctgcttgtgatactgctcatcgctattgccaacttttttattggaacagtcatcccgtctaacaatgaaaaaaagtctcgtggattttttaattatcaagcttcgatctttgcagaaaactttggtccacgctttacaaaaggtgaaggcttcttcagtgtcttcgcgattttttttccagctgcaacgggcatattagctggcgcgaacatctccggagatcttgaagatccgcaggatgctataccacgcggcacaatgttggcgattttcatcaccacagtggcgtatctcggggtagccatctgcgtaggcgcatgcgttgttagggatgccaccggcaacatgaacgataccattatatcgggcatgaactgtaacggctccgccgcttgcggattagggtatgatttttcgcgatgcaggcatgaaccgtgccaatatggtcttatgaataacttccaagtgatgtcaatggtatcaggtttcggcccactgattacggcaggcatcttttctgccacactttcctcggccttagcatccttagtgtctgcacctaaagtctttcaagctctgtgtaaagataatatttataaagccctgcagtttttcgctaaaggctatggaaagaacaacgaaccactcaggggctatattcttacatttctcattgctatggcatttatccttatcgctgaattaaataccatcgctccgatcatctcaaattttttcctggcttcttacgccttaatcaattttagttgctttcatgcctcctatgcaaaatcaccgggatggcgtccagcatacggaatctataatatgtgggtatcattatttggagcggtattatgttgtgctgtcatgtttgttatcaattggtgggcggcggtcattacatatgtcatcgaattctttttatacgtttacgtgacgtgcaaaaaaccggacgtgaattggggttctagtacacaagctcttagttatgtctctgctcttgataatgcgttagaacttacaaccgtcgaagatcatgttaaaaattttcgcccacagtgtatagtgctgacggggggtccgatgactcgtccagctctgctggacatcacacatgcgttcacgaaaaatagcggactgtgtatctgctgcgaagttttcgtaggtcctcgtaaactttgcgtgaaggagatgaattccggaatggccaaaaagcaggcctggttgatcaaaaataaaattaaagcattttatgcggctgttgctgctgactgttttcgggacggtgtaaggtctctgctgcaagcgtcagggctggggcgcatgaaacccaatacgttggtgatcggatacaaaaaaaattggcgcaaagcgccacttacagaaatcgaaaattacgtcggtattatacacgacgccttcgactttgaaattggtgtagtgatagtacgaataagccaaggattcgacatctcacaagttttacaggtacaggaagaactcgagcgtttagaacaagagaggcttgccttagaagcaaccattaaagataatgaatgcgaggaagaaagtggaggaattagaggcctgtttaaaaaagcgggcaaactaaatatcactaagaccacgccgaagaaggatggcagtataaatacctcccaatcaatgcatgtaggagaatttaaccagaaattggtagaagcttcaacgcaatttaagaaaaaacaggagaaaggaacgatcgacgtctggtggttgttcgatgacggcgggctgactctgctgattccctacattttgacacttagaaaaaagtggaaagactgtaagttacgcatatatgttggtgggaaaatcaaccgtatagaggaagagaaaatcgtcatggcttctttattatcgaagtttcgtatcaagtttgcagatatccacataatcggggatattaatattcggcctaataaggaatcatggaaagtcttcgaagaaatgatcgagccgtaccgattacacgaatcatgtaaggatcttacaactgcagaaaaactgaaaagagagacgccgtggaaaatcacagacgcggaattagaggcagtgaaagaaaaatcctatagacaagttcgtttaaacgaattactgcaggaacatagccgggcggcaaatctgatcgtcttatcactccctgtcgctcgtaaaggctccataagcgatttactttatatggcttggctggaaatcttaacaaaaaacttaccacctgtactcctcgtaagaggcaatcacaaaaatgtattaacgttctattct

SEQ ID NO: 251117 - DNA, 3297 bp, Artificial Sequence
  Description of Artificial Sequence: Synthetic coding sequence
atgtcgttgaacaactcatccaatgtctttctggactccgtgccgtcgaacacgaatcggtttcaagtgtcggtaatcaacgaaaaccatgagtcctcagccgcagcagatgataatactgacccgcctcactacgaggaaacttcattcggagatgaagcccaaaagcggttgaggatttcattcaggcccggaaaccaggagtgctacgacaattttctgcaatccggagagacggccaagaccgatgcctcgttccatgcttacgattcccatactaacacgtactatctgcaaacctttgggcacaacaccatggatgcggtcccaaagatcgaatactatcgcaacactggcagcatttcgggaccgaaggtcaatcgcccatccctgcttgagatccacgaacagctggcgaagaacgtggccgtgacgccgtcatcagccgaccgagtggccaatggagacgggatcccaggcgacgaacaggcggagaataaagaagatgatcaagccggcgttgtcaagttcggctgggtcaagggagtgttggtgcggtgcatgctgaacatatggggcgtgatgctcttcatccgcctgtcctggatcgtgggagaggcagggatcggactcggcgtgatcatcatcggactgtccgtcgtggtcaccactctgactggaatttcgatgagcgcgatctgcaccaatggggtggtgaggggaggaggagcatactacttgatctcccgttctcttggcccagaatttggaggatccattggactgatcttcgcatttgcgaacgctgtcgcggtggcaatgtatgtggtgggcttcgcagagactgtggtggatctgcttaaggaatcagacagcatgatggtggatcccaccaacgatattcggatcatcggcagcatcactgtcgtcatcctgctgggcatttccgttgctggcatggaatgggaggccaaggcccaggtgatcctcctggtgatccttctgattgcgatcgccaacttcttcatcggaactgtgatcccatcgaacaatgagaagaaatcgcgcggatttttcaactaccaagcctcgatctttgccgagaacttcggcccgagattcactaagggtgagggattcttttctgtgttcgcgattttctttcctgctgcaactggaatcctggcgggagccaacatctcgggtgatctggaagatccgcaggacgctatccctcgcggtactatgctcgcgatcttcatcaccacggttgcttacctgggagtggcgatctgcgtgggtgcttgcgtcgtgcgcgacgccactggaaatatgaacgatactattatcagcggaatgaactgcaacggatcagccgcctgcggcctcggttacgatttctcacgctgtagacacgaaccgtgtcagtacggcctgatgaacaatttccaagtcatgagcatggtcagtggatttggaccgctcatcactgccggaatcttttcagccactctctcgtcggccttggcgagcctcgtgtccgctcctaaagtgtttcaagcgctctgcaaagacaatatctataaggcgttgcagttcttcgcgaagggctatggaaaaaacaatgagccgcttcggggctacatcctgacttttttgattgctatggcattcatcttgatcgcagagcttaataccattgccccgatcatctccaacttttttctggcctcctacgcgctgatcaatttctcgtgcttccacgcttcctacgctaagtcaccgggatggcgccctgcctacggcatctacaatatgtgggtgtccttgtttggcgctgtgttgtgttgcgccgtgatgtttgtcatcaactggtgggcagcagtgatcacctacgtgatcgaattcttcctttacgtctacgtcacttgtaagaaaccagacgtcaactgggggtcgtccactcaggccctgtcctacgtgagcgccctcgacaacgccctggaactgaccaccgtcgaagatcatgtgaagaacttccggccgcagtgcatcgtgctcactggaggacccatgacgcgccctgcgctgctcgacatcactcacgccttcactaaaaactccggtttgtgcatctgctgcgaggtgttcgtcggcccgcggaagctgtgcgtgaaggagatgaactcaggcatggctaagaaacaggcctggctgatcaaaaacaagattaaggctttttacgcagccgtcgccgccgactgttttcgcgacggtgttcgctcactgctgcaggcgtccggactcggacgcatgaagccgaacacgctcgtgatcggctacaagaagaactggagaaaggccccgctgaccgaaatcgaaaactacgtgggtatcatccatgatgccttcgacttcgaaattggagtcgtcatcgtccggatctcgcaaggttttgatatctcccaggtgcttcaagtccaggaggagctggaacgcctggagcaggagaggctggccctggaagcaaccatcaaggataatgagtgtgaagaggaatcgggtggtatccgcggcctctttaagaaggccgggaagctcaacatcactaaaaccactccaaagaaggacggtagtatcaacacctcgcaaagcatgcacgtcggtgaattcaaccagaaactggtggaggcttcgacgcagtttaagaaaaagcaagagaagggcactatcgatgtgtggtggctgtttgatgatggtgggctgaccctgctcattccatacattctgactctgcggaagaagtggaaagactgcaagctgaggatctacgtcggagggaaaatcaaccgcatcgaagaggagaaaattgttatggcctcgctgctgtcgaaatttcgcatcaagttcgctgacatccatatcatcggagacatcaatatccggccgaataaagagtcctggaaggtgttcgaggagatgatcgaaccgtacagactgcacgagtcctgcaaagacctcactactgcagaaaagctgaaaagagaaactccgtggaagatcaccgacgcagaactggaggccgttaaggagaagagctaccggcaagtgcgcctgaacgaacttctgcaggagcacagcagggccgcaaacctcatcgtgttgtcgctgcccgtcgcacggaaaggttctatcagcgacctgctctacatggcgtggctcgagatcttgacgaaaaatctgccacccgtccttctggtccggggaaaccataagaacgtgctcactttttactcg

SEQ ID NO: 251118 - DNA, 3297 bp, Artificial Sequence
  Description of Artificial Sequence: Synthetic coding sequence
atgtccctcaataactcgtcaaacgtgtttctggacagcgtcccgtcgaacactaatcgttttcaagtctcggtgatcaatgaaaaccatgaaagctccgccgcggcagatgacaacaccgatcctccgcattacgaagaaacctcattcggagatgaagcccagaagcgcctgaggattagttttcggcccggaaatcaagagtgttacgataactttcttcaatcgggtgaaaccgccaaaacggatgccagcttccatgcatacgattcccataccaacacctactacctgcagactttcggacacaatactatggacgcagtgcccaaaatcgaatactaccgaaacacgggttccatttccggtcctaaggtgaaccgaccttcacttctcgaaattcatgaacaacttgccaagaacgtggcggtgaccccatcatctgcagacagagtggcaaatggggatgggattcccggtgatgaacaagcagagaacaaagaagatgaccaggcaggggtggtcaagtttggatgggtgaagggtgtgctcgtccggtgcatgcttaacatttggggtgtgatgctcttcattagactgtcctggattgttggtgaggcaggaattggtttgggggtcatcattattggactcagcgtggtagtcactactttgactggaatatctatgtccgcaatttgcactaatggagttgtgcgaggcggtggggcatattaccttataagccgctcgcttggtcctgagtttggtggttcaattggtctgattttcgcattcgcaaatgcggtggcagtggcaatgtacgtggttggattcgcagaaaccgtcgtggatctgctgaaggaaagcgactctatgatggtggacccgactaacgatataagaattatcggatcgataaccgttgtgatcctcctgggcatttcagtggcggggatggaatgggaagcgaaagcacaagttatcttgctggtgatcctccttattgcaatagcaaatttctttattggaactgtgattccatccaacaacgagaagaagtcaagagggttcttcaattaccaggcatcgatttttgcagagaattttggacctaggtttactaaaggcgaaggctttttctcagtgttcgccatctttttcccagcagcaaccggaatactggcaggagccaacatttcgggtgacctcgaagatccacaggatgcaattccacgcgggaccatgctcgcgatctttatcaccaccgtcgcttaccttggagtcgctatctgtgtcggcgcatgcgtcgtgagggatgctaccggtaacatgaatgatactatcatttcaggtatgaactgtaacggatcggccgcatgtgggttggggtatgatttttcacggtgtcggcatgaaccctgtcaatacgggctgatgaacaattttcaagttatgtccatggtatccggatttggacctctgattactgctggaattttctccgcgactctctcatctgcactggcctcactggtgtcagcaccgaaggtgtttcaagccctctgtaaagacaacatctataaggcactgcagttttttgcaaagggttacgggaaaaacaatgagccgcttaggggttacatccttacttttctcattgcgatggcctttatactgattgcagaacttaacactatcgctccaatcattagcaatttcttcctggcatcctacgcccttatcaatttctcgtgctttcatgcatcctacgcaaaatcccccgggtggcgccccgcgtacggaatctacaacatgtgggtgtccttgtttggtgcagtgctgtgttgtgcagtcatgtttgtgatcaactggtgggccgcagtgatcacctacgtgatcgagttttttctgtacgtgtatgtgacttgcaagaagcccgatgtcaattggggaagctccactcaggccttgagctacgtgtccgcactggataatgcgctcgaactgaccaccgtggaggatcatgtcaaaaactttcggccccagtgcattgtcttgaccggtggaccaatgaccagacccgcattgctggatataacccatgcgtttaccaagaactcgggactctgtatctgttgcgaagtgttcgtcggcccacggaaactttgtgtgaaagagatgaactccggcatggctaagaagcaagcgtggctgattaagaacaaaatcaaagcattctacgcggcagtggccgccgattgttttcgagacggcgtccgctcactgctccaggcatccggactgggacgtatgaaacctaacacccttgtgataggttacaaaaagaattggcggaaggcaccccttaccgagatagagaattacgtgggtatcattcacgatgcatttgattttgaaataggggtggtcatagtgcgaatatcccaaggttttgacattagccaggtccttcaagtgcaggaggaacttgagcgcctcgagcaagaacgactcgcccttgaggcaacgattaaagacaacgaatgcgaggaagagtcaggaggaatccgcggtcttttcaagaaagccgggaaattgaatatcactaagactaccccaaagaaggatggttcgattaacacctcccagtctatgcatgtcggtgaattcaatcagaagctggtggaagcatcaacccagttcaaaaagaaacaagaaaagggaacgattgatgtgtggtggcttttcgatgatggagggcttactcttctgattccatacattcttactcttcggaagaagtggaaagactgtaaacttcggatctacgtgggtggaaagatcaatagaatagaagaagagaaaattgtcatggcatctcttctttcaaagttccggattaagtttgctgacatccacattatcggcgacattaacattcggcctaacaaagaatcctggaaagtctttgaagaaatgattgagccatacagactgcacgagtcgtgtaaagatcttaccaccgcagagaaattgaagcgagaaacgccttggaaaatcacggatgccgaactggaagccgtgaaggagaagtcttataggcaggtgagactgaacgaactgcttcaggaacacagccgggcagcaaacctgattgtcctctcgctccctgtggcaagaaagggatccatttcggatctcctttacatggcatggctggagatccttacgaagaacctcccaccagtgcttctggtgagaggtaaccacaagaacgtgctgacgttctattcg

SEQ ID NO: 251119 - DNA, 3297 bp, Artificial Sequence
  Description of Artificial Sequence: Synthetic coding sequence
atgtctctgaacaactctagcaatgtgttcctggattcggtaccaagtaacaccaaccggtttcaagtgtccgtcataaatgagaaccatgagagctctgccgcagctgatgacaacacagatccaccccattatgaagaaacttcattcggggatgaagcacagaagcggcttcgcatctcttttagaccagggaaccaggagtgctatgacaacttcctgcagtcgggtgagaccgcaaagactgacgcctccttccacgcttacgatagccacactaatacctattacttgcagaccttcggccacaacacaatggatgcagtgccaaagatcgagtactacagaaatactggctcaatttccgggcccaaagtcaaccgaccatctctgttggagattcatgagcagctcgcaaagaatgtcgccgtcacaccctccagtgcagaccgagtggcaaacggcgatggaattcccggtgatgaacaggccgagaacaaagaggacgatcaggcaggagtcgttaaatttggatgggtgaaaggagtgctggtgagatgtatgcttaatatttggggcgttatgctatttattcgtctgtcctggattgtgggggaagccgggattggactgggtgtgataatcattgggctttcggtggttgtgacgacacttacggggattagtatgtcggcaatatgcacaaacggcgtggtccgcggcggaggagcgtattacctgattagtaggagtctaggccctgaattcggcggtagcataggactgatctttgcctttgcaaatgccgtggctgtcgcgatgtacgtcgtgggattcgcagaaacagtggtagacctactaaaagaatccgattcaatgatggtcgatcccacaaacgatatccgtattatcggctcaatcactgtggtcatactcctgggcatttcagtcgccggtatggagtgggaagcgaaagcacaagtcattctgttggtgatccttttgatcgctatagcaaatttcttcatcggcactgtgatcccatccaacaacgagaagaagagccgaggcttcttcaactatcaggcgtccatcttcgccgaaaacttcggccctcgatttaccaaaggcgaagggtttttctccgtctttgctatctttttccctgccgcaactggaatcctggcaggtgctaacatctccggggatctggaggatccccaggacgctattcccagagggactatgctggctatctttatcaccaccgtcgcatatctgggcgtggccatctgcgttggtgcctgtgtcgtaagggatgcaacaggcaacatgaacgatacgatcattagcggcatgaactgtaacggcagcgctgcatgtgggttgggatatgacttttccaggtgtaggcatgagccttgtcagtacggcctcatgaacaatttccaagtcatgagcatggtgtccggattcggccctttgattacggcggggattttcagcgcgacgctgagctccgcactcgcatcgttggtgagcgcccccaaggtatttcaggccctatgcaaagacaacatctacaaggccttgcaattcttcgccaaggggtacggaaaaaacaacgagcctctacgcggctacattcttacttttctaattgccatggcttttatcctgatcgctgagctgaatacaattgctcctatcatcagcaacttcttcctggcttcatacgcactcattaattttagttgtttccacgctagctatgctaaatctcccggatggcgccctgcatacggcatctacaacatgtgggtgtcacttttcggggcagtcctatgttgtgccgtgatgttcgtgattaactggtgggcagcggttatcacatacgtgatcgagtttttcctgtatgtttacgtcacctgcaagaagcccgacgtgaactggggaagctctacccaggctctgtcatatgtgtccgccttggacaatgcactagagctcaccaccgtggaggatcatgtgaaaaatttccggcctcagtgtatagtgcttacgggaggacccatgactaggccagcccttttggatataacacacgcctttaccaagaattctggcctttgcatttgttgcgaggtgttcgtcgggccacgcaaactgtgcgtcaaggagatgaattctgggatggcgaaaaaacaggcctggttgatcaagaataagattaaggccttttatgccgctgtcgctgccgactgttttcgcgacggcgtacgatctcttctgcaagcgagcggcctgggcaggatgaagccaaatacccttgttataggttataaaaaaaactggagaaaggcaccgctaactgagatagaaaattatgttggaattattcatgatgcattcgacttcgaaattggcgtggttatcgtgcgtatttcacagggcttcgatatttcgcaggtactgcaggtgcaggaggagctggaaaggctggagcaagagagattggccctggaagcgacgatcaaggataatgagtgcgaggaagagtctgggggcatcagggggctctttaagaaggctggaaaattgaacattacaaagacgactccaaaaaaagatggctcaattaacacctctcagagtatgcacgtcggtgagtttaatcaaaagctggtcgaggcctccactcagttcaagaaaaaacaggaaaaggggactatcgatgtttggtggctgttcgatgatggtgggctcaccttactgatcccctacatactgactctccgcaagaaatggaaagattgtaagttgaggatatatgtcgggggaaagataaaccggattgaggaagaaaaaatcgtgatggctagtttgctgtctaagttcaggataaagttcgctgatatccatatcatcggagacatcaatatacgacccaacaaagaaagctggaaagttttcgaggagatgatcgagccgtatagactccacgagtcctgtaaagatttgactactgcggaaaagctgaagcgtgagactccctggaaaattaccgacgctgaattagaagctgtaaaggaaaagtcctaccgacaagtccgtctgaacgagctgctgcaagagcactctagagcggcaaatcttattgtgctgagtttgcccgtggccagaaaggggtctatatcagatctgctgtatatggcttggctggaaatcttaacgaaaaatctgcctcccgttctattggtgagaggtaaccacaaaaacgtactcacattctactca

SEQ ID NO: 251120 - DNA, 3297 bp, Artificial Sequence
  Description of Artificial Sequence: Synthetic coding sequence
atgtcattgaacaattcgagcaacgtgtttcttgacagcgttccatctaataccaatcggttccaagtatctgtaatcaacgagaatcatgagagttctgccgccgctgatgacaatactgatccacctcactatgaagaaacttccttcggggatgaagcccaaaagaggcttagaatcagtttccggccgggcaaccaggagtgctacgataattttctgcagtccggagaaaccgcgaaaactgacgccagttttcatgcctacgattcacatacaaacacctattacctccaaaccttcggacacaacactatggatgccgtgcccaaaattgagtactatcggaacactggaagtatatccggccctaaagtgaatagacccagcctgttggagatacatgagcagctggcaaaaaatgtagcagtgacacctagctcggccgaccgggtcgccaatggggacggaatacccggagatgaacaggctgagaataaggaggacgaccaggctggagtggttaaatttggctgggtgaagggggtcctggtgagatgtatgttgaatatctggggcgtcatgttgttcatccgcctgtcttggatagtgggtgaggccggcattggactaggtgtcatcataatcgggttgtccgtcgtcgtgacaaccctgacggggattagcatgagcgccatttgcacaaacggagttgttcggggcggcggcgcttactacctgatctcaagatctctgggacccgagttcggagggtccataggtctgatcttcgcatttgccaacgcggtcgcagtggccatgtatgtcgttggctttgccgagacagtagtggacctgctgaaggagagtgactcaatgatggttgaccctacaaacgatatccgcatcatcggaagcatcacagtcgtgatcttgctcggcatctcagtagctggcatggaatgggaggccaaagcccaggtgatactcttagtgatcttattgattgctatcgcaaattttttcatcggaaccgtaatcccttccaacaacgaaaagaagtcacgcggtttcttcaattaccaggcttcaatatttgccgaaaactttggcccccggttcaccaagggggagggatttttctctgtgttcgccatcttcttccccgcggccactgggattctggctggagcaaatatcagcggagacctagaggaccctcaggatgccattcctcggggaacgatgctggcaatattcatcacaacggtggcatacctcggggtggctatctgtgtaggagcatgtgtggtacgggacgcaacaggaaacatgaacgatactatcatcagcgggatgaattgtaacggtagtgcggcatgtggactgggatacgacttctcgcgatgcaggcacgagccatgtcaatatggattaatgaacaatttccaggtcatgagcatggtcagcgggttcgggccattgatcaccgctggcatctttagcgcaacactgagttccgccttagcttccctagtgagtgctcccaaggtattccaagccttgtgcaaggacaacatatataaggctcttcagttcttcgctaagggatacggaaagaataatgaaccactgaggggctatatactgacttttcttatcgcaatggccttcatcctcattgccgagttgaataccattgcgcctatcatatcgaacttctttttggcttcttatgctctgattaattttagttgtttccacgcctcctatgcaaagtcccctggctggcggcctgcatacgggatttataacatgtgggtgtccctctttggcgccgtcctttgttgtgctgtgatgttcgtcattaattggtgggcagcggtcatcacctatgtgatcgagttttttctgtacgtttacgtcacatgtaagaagcccgatgtcaattggggttcatctactcaagcactcagctatgtgtcagccctggacaatgcactggaattgacgacagtggaagaccacgtgaagaacttccgcccacagtgtattgtcctgacgggcggaccaatgacgcggcctgctctcctggacatcacacacgcctttaccaagaatagcgggctgtgtatttgctgtgaggttttcgtagggcctcgcaagttatgcgttaaggaaatgaactctgggatggcaaaaaaacaggcatggttgattaagaacaaaataaaggccttctatgcagccgtcgcagctgactgcttccgagatggggttcgttcgctgctccaggctagcgggctcggcagaatgaagcccaatactttggtcattggatacaaaaagaattggcgcaaggctcccctgactgagatcgaaaactacgtgggaatcatccatgacgcatttgacttcgagataggggtcgtcatagttagaataagtcagggcttcgacatcagtcaggtcctccaggtgcaggaagaactcgagaggctggagcaagagaggcttgccctggaagctactatcaaagataatgaatgcgaagaagagagcggggggatccgtggactgtttaagaaggcgggaaaactcaacataacaaaaacaactcccaaaaaagacggttcaattaacacttcgcaaagtatgcacgttggggagtttaatcagaaactggtggaggcctccactcagttcaagaagaaacaggagaagggcaccattgacgtctggtggttgtttgatgatgggggtttaacattgttaattccctatatcctcacactgagaaaaaagtggaaggattgtaaacttcggatttacgttggcggcaagattaaccggattgaggaggaaaagatagtaatggcctcattgctttccaaatttaggatcaagtttgccgatattcacataattggcgatataaacataagaccgaataaggaaagttggaaagttttcgaggaaatgatcgaaccgtacagattgcacgaaagctgcaaggatttaacaacggctgagaagctgaagagagagactccctggaagattaccgacgctgagttggaggccgtcaaagaaaagagttacagacaggtccggctcaatgagctgttacaagagcacagtcgcgccgctaatctcattgtacttagcttacccgtcgctcggaaaggctccatttccgacctgctctacatggcctggcttgagatacttacgaaaaacctgccacctgttcttctggtgcggggtaatcacaagaacgtgctaaccttttactct

SEQ ID NO: 251121 - DNA, 3297 bp, Artificial Sequence
  Description of Artificial Sequence: Synthetic coding sequence
atgtcgctcaacaattcctccaacgtctttttggattccgtcccgtcaaataccaaccgcttccaggtgtcggtgatcaacgaaaaccatgaatcctcggcagctgcggatgacaacactgacccaccccattatgaggagacttcgtttggcgatgaagctcagaagcgcctccggatcagcttcaggccgggaaaccaggaatgttacgacaactttttgcagtcgggagagactgcgaaaactgacgcatcgttccatgcctacgactcgcacactaacacctactatttgcagaccttcggacacaacacgatggacgccgttccgaagatcgagtactaccggaataccggctcaatatcaggtcctaaagttaatcggccaagcctccttgagatccatgagcagctcgcaaaaaatgtggccgtgactccgagctctgcagacagagtcgccaatggagacggcatcccgggagatgaacaggccgagaataaggaggacgatcaggcaggagtggtgaagttcggatgggtcaagggggtgctggtgcgttgtatgctgaatatctggggagtgatgctcttcatcaggctgtcatggatcgtgggagaagccgggattggactgggcgtgattatcattgggctcagcgtggtcgtgactaccctgactggaatctcgatgtcggccatctgtaccaacggagtcgttcgcggaggaggagcctactacctgatctcacgctcgctggggccggaattcggcgggtctatcggactcatatttgcgttcgcgaatgcggtcgccgtggcgatgtacgtggtcggatttgcagaaaccgtggtggatctgctgaaggaaagcgatagcatgatggtcgaccccaccaacgatattagaatcattggatcaatcaccgtggtgatcctgcttgggatcagtgtggcgggtatggagtgggaagcgaaggcccaggtgattttgctggtgattctgcttatcgcgatcgccaattttttcatcggtactgtgatcccatcaaacaacgaaaagaagtcaagaggattctttaattaccaagcgtccatctttgccgaaaatttcggtcctcgcttcaccaagggagaaggtttcttctccgtgttcgcaatcttcttcccggcggccacgggaatcctggctggagcaaacatctcaggtgatctggaggacccgcaagacgctatcccgcggggtaccatgctcgcgatcttcatcaccactgtcgcctacctgggcgtggcgatttgcgtcggagcctgcgtcgtgcgggacgccaccggtaacatgaatgacaccatcatctcaggcatgaattgcaacggaagcgccgcctgcggcctcggatacgatttctcgcgctgtcgccacgagccctgccaatacgggctgatgaacaactttcaagtcatgtcgatggtgtccggctttgggccactgatcacggccggcattttctctgctaccttgtcaagcgccctcgcttccctggtgtccgccccaaaggtattccaagcactttgtaaggacaatatctacaaggctctgcaattcttcgctaagggatatggaaagaacaacgagccacttcgcggatacatcctcacttttctgatcgcaatggccttcatcctgatcgcggaactgaataccatcgcgccgatcatctccaactttttcctcgccagctacgccctgatcaatttctcatgtttccacgcaagctacgctaagtcccctggatggcgccccgcgtacggcatctacaacatgtgggtgtccctgttcggagctgtgctgtgctgcgccgtgatgttcgtcatcaattggtgggccgccgtcattacctacgtgatcgagttttttctctacgtctacgtgacctgtaagaaacctgatgtcaactggggcagcagcacccaggcgcttagctacgtgtcggcactggataacgctctggaacttacgaccgtggaggaccacgtcaaaaatttccgcccgcagtgcatcgtccttactgggggcccgatgacccggccggctctgctcgatatcacccacgctttcaccaaaaactcggggctgtgcatctgctgcgaagtgttcgtcggaccacggaaactctgcgtcaaagaaatgaactccggtatggcaaaaaagcaggcatggctgatcaagaacaagatcaaggcgttctacgccgcagtcgccgcggattgcttccgcgatggagtgcggagcctgttgcaagcctccgggctcggtaggatgaaaccaaacactctcgtgatcggatacaagaaaaattggaggaaggcgccgcttacggaaattgagaattatgtgggcatcattcacgatgcatttgacttcgagattggggtggttattgtgcgcatctcgcagggctttgacatctcgcaagtgttgcaagtccaagaggaattggagagacttgaacaagaaagactggctctggaagctactatcaaggacaacgaatgcgaagaggaatcaggaggtatcagggggctgttcaagaaggccggcaagctcaacatcactaagactaccccgaagaaggatggatcgataaacacgagccagtccatgcacgtgggagagttcaaccagaaactcgtggaagcgtcgacccagtttaagaagaagcaggagaagggaaccatcgacgtctggtggctgttcgacgacggcggactcactctcctcatcccgtacattctcaccttgagaaaaaagtggaaggactgcaaattgcgaatttacgtaggaggcaaaattaatcgaatcgaagaagagaagatcgtcatggccagcctgctctccaagttccggatcaaattcgccgacatccacatcatcggcgacatcaacatccggcctaacaaagagtcgtggaaggtgttcgaagaaatgatcgagccatacagactgcatgagagctgcaaggaccttactacggctgagaagctgaagcgggaaactccctggaaaattactgatgcggagctcgaggccgtgaaagaaaagtcataccgccaggtgagactgaacgaactgctccaggaacactcccgggccgcaaacctgatcgtgctgtccctgcctgtggcccgcaaaggatcgatttccgacctgctgtacatggcatggctcgagatcctgactaagaatctgccacctgttctgctggtgagaggcaaccataagaacgtgctgactttctactcc

SEQ ID NO: 251122 - DNA, 3297 bp, Artificial Sequence
  Description of Artificial Sequence: Synthetic coding sequence
atgtccctgaacaattcatctaatgttttcctcgactcagttccttctaatacaaataggttccaggtgtctgtcataaacgagaatcatgaaagctccgcagccgcagatgataatacggacccaccccattacgaagaaacctcctttggagacgaagctcagaagcgattgcgtatatcctttagacccggtaaccaggaatgttacgataatttccttcagagcggggagacagcgaaaaccgacgccagcttccatgcatacgattcacataccaatacttactacttacaaacctttggtcacaataccatggatgctgttcccaagattgaatactaccgaaatactggctcaattagcggtcccaaagtaaataggcccagtcttctggaaattcatgagcagctcgccaagaatgtcgccgtcactcccagctccgcagacagggtggctaacggcgacggcattcctggggacgaacaggccgaaaacaaagaggacgaccaggctggagtagtcaagttcgggtgggtaaaaggagtcctagtacgctgcatgctgaatatctggggagtgatgctgtttatcaggttgagctggatcgtgggggaggcaggaatagggctgggcgtaatcattattggtttgtcagtggttgtaactaccctaactggtatctcaatgagcgctatctgcaccaacggagtggtcagaggcggcggcgcctactaccttatctcccggagtctagggccggaattcggcggctctattgggttgatctttgcatttgccaacgcagtggccgtggctatgtacgtagtggggtttgctgagacagttgttgacttactaaaagagagcgattccatgatggtagaccccacgaatgacatccgcatcattggctccatcaccgttgtgatactactgggcatatcagtggctggcatggagtgggaggccaaggctcaggtgattctcctggtcatcctgctgatcgcaatagcgaatttctttatcggaactgtaatcccaagcaacaacgaaaaaaagtcccgcgggttcttcaactatcaggccagcatctttgctgagaatttcggaccccggtttaccaagggggaaggttttttctccgtgtttgctatcttcttcccagcagctaccggtattctggccggcgcaaatatttccggggacctggaggacccccaagatgctatcccccgaggaacgatgttggcaattttcattacaacagtggcctatttgggcgtggcgatttgcgtaggcgcatgcgtcgttcgggacgcaaccgggaacatgaacgacaccattatctcagggatgaactgtaatggatccgcggcctgcggcttggggtatgacttctctagatgtaggcacgagccttgtcagtacggtctgatgaataacttccaggttatgagtatggtgagcggtttcggacctttaatcacagcaggaatattctctgcgaccctgtcgtcagcgctggctagcctggtcagtgcaccaaaggtgttccaagccctatgcaaagataatatttataaggcactgcagtttttcgctaaaggctatggaaagaataatgagcctctacgaggctatattctgacttttctgatagccatggcatttattctcatcgcggagctgaacacaatcgctccaatcatctccaattttttcctggctagctatgccttgattaatttcagttgttttcacgcgtcatacgctaaatcaccggggtggcggcctgcttatggtatttacaacatgtgggtttccctctttggagcggtgctgtgctgcgcggttatgtttgtcatcaactggtgggctgctgtcatcacatacgtgatcgaattctttctatatgtgtacgtgacatgtaagaaacctgatgttaattgggggtccagtacacaagcattgagttatgtcagcgccttagacaatgctctagagctgactaccgtcgaggaccacgtgaaaaacttccgtccgcaatgcatagtattgactggaggccccatgactcgccccgccttgttagacattacacacgcgttcactaagaattcagggctgtgcatctgctgcgaagtattcgttggcccaaggaagttgtgtgtcaaggagatgaattcggggatggctaagaagcaggcatggctaattaagaataagatcaaggcattctatgcggccgtggcagcagactgctttagggatggagttaggtcgttacttcaagcttctggattggggcggatgaaacccaatacactggtgattgggtacaaaaagaactggcgtaaggcgcccctgactgaaattgaaaactacgtcggcattatccatgacgcttttgattttgagatcggggtggtgattgtcaggattagtcaagggttcgatatctctcaagttctccaggttcaggaggaactcgagcgtctggagcaagaacggctggctctagaggctacgataaaggacaatgaatgtgaggaggaaagtggtgggatccgtggtctcttcaagaaagccggcaaactgaatatcacaaaaacaacccccaagaaggatgggtcaataaatacgagccaaagcatgcacgtgggagagtttaatcagaagctagtcgaggcgagtacacagttcaagaagaaacaggagaaaggaaccattgatgtatggtggctgtttgacgacggaggcttgactttgctgattccatatattcttaccctgaggaaaaagtggaaggattgtaaacttaggatttacgttgggggaaagatcaatcggatcgaggaagagaagatcgtgatggcctccctgctttcaaaattcaggatcaaattcgccgacatccacataatcggcgacatcaacattaggccaaataaggaatcttggaaggtttttgaagaaatgattgaaccatacagacttcacgagtcctgcaaggacttgacgactgcggaaaagcttaaaagggagacaccatggaaaattacagatgctgagctggaggccgtgaaagaaaagagctacagacaagtgaggttgaatgaattactgcaggagcactcacgcgctgccaacttgatcgtcctgtctctccctgttgcacgcaagggctcgatttcagatcttctgtatatggcttggctagaaattttgactaaaaatttacctcccgtgctgttagtcaggggcaaccataaaaacgtcctgacgttttattct

SEQ ID NO: 251123 - DNA, 3297 bp, Artificial Sequence
  Description of Artificial Sequence: Synthetic coding sequence
atgtccctgaataattccagcaacgtctttctggactccgtgccttctaatacaaatcggtttcaagtcagcgtgataaatgaaaaccatgaatcctctgctgccgcagatgacaatactgacccccctcactatgaggagaccagttttggagacgaagcccaaaagagactacggatatccttccgccccgggaaccaagagtgttatgataattttctacagtccggcgagacagcaaagactgacgcctcctttcacgcttatgacagccacacgaatacatattatcttcagacctttggacacaacacaatggatgccgtgcctaagatcgagtattacagaaacaccggcagtatctccggcccaaaggtgaacagaccaagcctcctcgagatccacgagcagctagccaaaaatgtcgccgtgaccccctcaagcgcagatagggtggcaaatggagacggcatcccgggagatgaacaagccgaaaataaggaagacgaccaggcgggagttgtgaagttcgggtgggtgaagggagtcctggtgagatgcatgttgaatatctggggagttatgctgttcatccgactgtcttggatcgtgggagaggctgggatcggtctcggggtgattataatcggactctctgtagttgttactacactcacaggcatctcaatgagtgccatttgcacaaatggtgtggtccgcggaggtggcgcctactatctgatcagcagatcactaggaccagaatttggcggatccattggcctgatctttgctttcgccaatgcagtggctgttgccatgtacgtggtgggatttgcagaaacagtggtggatcttctgaaagaaagtgacagcatgatggttgatccgactaatgatattaggattataggctctataaccgtggtaatcctgctgggaatatcagttgccggaatggaatgggaggccaaagcccaggtgatattactagtgatactcctgatagcgattgccaacttcttcataggaaccgtcatcccatcgaataatgagaaaaagtcccgcggcttcttcaactaccaggctagtatattcgctgaaaatttcggaccacgcttcactaagggcgagggattcttcagcgtttttgctattttctttcccgcagccacggggatcctggctggtgccaatatcagcggcgacttggaagacccacaggatgcaatcccccgagggaccatgctggcaatttttataaccactgtggcctacttaggggtggccatctgcgtcggagcttgcgtcgtgcgcgacgctacaggtaatatgaacgacacaattatctctgggatgaactgcaatggtagcgctgcatgtgggttaggctacgacttttcacgttgtcggcatgagccatgtcagtatggcttgatgaataactttcaagtcatgtccatggtgtccgggttcggccctctcatcaccgcaggtatcttttctgccacgctgtctagcgctctagcctctctggtatctgctcctaaagtgtttcaggctttgtgtaaggataatatctataaggcgctccagttctttgccaagggttatggcaaaaacaacgagcccctacgtggctatatattgaccttcctgatcgccatggcctttatcctcatcgccgagctgaataccatcgcccctattatttccaacttcttcctcgcaagttatgccctgatcaacttcagctgtttccacgcgtcctacgcgaaaagccccggatggcgcccggcctacgggatctacaatatgtgggtctctttgtttggggcagtgctgtgctgcgccgtcatgtttgtaatcaactggtgggccgccgtgatcacgtacgtgatagagttctttctgtatgtctacgtcacttgcaaaaagccggatgtgaactggggtagctcaacacaagcactcagctacgtgagtgctctcgacaatgctctggagcttacaactgtcgaggaccatgtgaagaattttcggcctcagtgcatcgttctgacaggcgggcctatgacaaggcctgcattattggatattacacacgcattcaccaaaaactctggcctgtgcatttgttgtgaggtattcgtgggacctaggaagctgtgtgttaaagagatgaatagtggcatggctaagaaacaagcctggttgattaagaacaaaattaaggcgttttacgccgccgtggcagctgactgctttcgcgatggcgtccggtccctcctgcaggcctcaggactcgggcgaatgaaacctaatactcttgtgataggctacaaaaagaactggcggaaagctcctctgactgagattgaaaactacgtcggcatcatacacgatgcttttgactttgagattggggtcgttattgtccgtatctcgcaggggttcgatatcagccaggtcctacaggtccaggaagagctggaacggttagagcaggaaaggctggctctcgaggcaacaattaaggataacgaatgtgaggaagaatctggtggcatacgtggactctttaagaaagccggaaagttgaatatcaccaaaactacccctaagaaggatggcagcattaacacttcgcagagcatgcatgtgggggagttcaatcagaaattagtcgaggcctccacccaatttaagaagaaacaggagaaagggacaattgacgtatggtggctgtttgatgatggggggctgacactgctgataccttacatattgacactgcgcaagaaatggaaggactgtaaactgagaatatatgtgggtgggaagatcaataggattgaggaggagaaaatcgtaatggcctctctcctgtcaaagttcagaataaaattcgccgatatacatatcattggggacatcaatattaggccaaacaaggaatcatggaaggtttttgaggaaatgatagagccctacaggctgcacgagtcttgcaaggaccttaccacagcagaaaagttgaaacgggagacaccgtggaagatcacggatgctgagctcgaagcagtgaaggaaaagtcataccgccaggtcagactgaacgaactgctgcaggaacactccagggcagccaatttgatagttctttccctgcctgtcgccagaaaagggagcatttctgatctgttatacatggcttggctggagatcctcaccaaaaacctccctcccgtgctgctggtgcgagggaatcacaagaatgttcttacattctattct

SEQ ID NO: 251124 - DNA, 3297 bp, Artificial Sequence
  Description of Artificial Sequence: Synthetic coding sequence
atgtctcttaacaattcatcgaacgtgtttctggattcagtcccttcaaacacgaatcgattccaggtgtccgtcattaacgaaaaccatgaatcgtccgcagccgcagacgataataccgatcctcctcattacgaagaaacctcgttcggtgatgaggcccagaagcggctcagaatatcttttcgcccaggaaatcaagaatgttacgataacttccttcagagcggagaaacggccaagaccgatgcctcattccatgcatacgatagccacactaacacttactacttgcaaacctttggtcacaacaccatggatgcagtgcctaagattgagtattaccgcaacacgggatcaatctcaggtccaaaggtgaacagaccctccctccttgaaattcacgagcaacttgcgaagaatgtcgccgtgactccaagctcagcagaccgtgtggcaaacggcgatgggattccaggagatgagcaggccgagaataaggaagatgatcaagcaggtgttgtcaaatttggatgggtgaagggggtcctggtgcggtgcatgctgaacatttggggtgtgatgctgtttatacggttgagctggattgtgggtgaagcgggaattgggctgggagtcatcattattggcctttccgtagtggtcactactctgactggcatatcgatgtcggcgatttgtactaacggggtggtgcgaggtggtggagcgtactaccttatttcgcgttccctcgggcctgaatttggaggttcgattggattgatctttgcatttgcaaacgccgtggcggtcgcgatgtacgtagtgggtttcgcagaaaccgtggtggatcttctgaaggaatcggattcgatgatggtggatccaaccaacgatataaggatcattggctcgatcaccgtggtgatattgctcggaatttcggtggccgggatggaatgggaggcgaaagcccaagtgattctgcttgtcatactcctgattgcaatagcaaacttctttatagggaccgtgatccccagcaataacgaaaagaagagccgaggctttttcaactaccaagcatccatttttgctgaaaactttggaccgcggtttaccaaaggagaggggtttttctccgtgtttgcaattttcttccctgccgcaactggaatccttgcaggtgcaaacatttcgggcgaccttgaggacccgcaggatgcaatcccacgcggaactatgctggccatctttatcaccaccgtggcctacctgggagtggcaatatgtgtcggcgcatgtgtggtgagagacgccaccggcaacatgaacgataccattatctcaggaatgaattgtaacggctcggcggcttgcggcctgggctacgatttttccaggtgtagacacgagccctgccaatacggacttatgaacaacttccaggtcatgagcatggtgtcgggcttcgggcccctcattaccgcaggtattttctcggctaccctctccagcgcacttgcatcgcttgtctcagctcctaaggtgtttcaggcgttgtgtaaggataacatatacaaagccctgcaattcttcgctaaggggtacggcaaaaacaatgaaccacttagaggatacatcctcacgtttcttattgcgatggcattcattctgattgcagaactcaacaccatcgcacctatcatttccaacttcttcctggcctcatacgcattgattaacttttcctgcttccatgcttcctacgcaaaatctccaggatggcgtcctgcatacggaatttacaacatgtgggtcagtttgtttggagcggtgctttgctgtgcagtgatgtttgtgatcaactggtgggcggcagtgattacctacgtcatagaattcttcctttacgtgtatgtgacctgcaagaaacccgatgttaactggggatcctccactcaagcactttcatacgtctcagctcttgacaacgcactcgagctgaccacggtggaggatcatgtgaaaaacttcagaccccagtgcattgtgcttaccggcggaccaatgacgcgacccgcactcctcgatattactcatgcattcactaagaattcaggactgtgcatatgctgtgaagtgttcgtgggccctaggaagctctgtgtcaaggagatgaactcaggaatggccaagaaacaggcctggctgatcaaaaacaaaatcaaggccttctacgccgccgtcgcggcagattgttttcgtgatggtgtgaggtcgctgcttcaggcctccggtctgggacggatgaaaccaaatactcttgtgattggatacaaaaagaattggcggaaagctccacttaccgaaatcgaaaactacgtggggatcattcatgacgcatttgactttgaaatcggagtcgtcatcgttagaatttcccaaggatttgatatatcgcaagtgctgcaagtccaggaagaacttgaacggcttgagcaggaacgcctggcactggaagctaccataaaagacaatgaatgcgaggaagagtcgggtgggatcaggggcttgttcaagaaggcaggtaaattgaacattaccaagactacccccaagaaggatggctccataaacacgagccaatccatgcatgtcggtgaattcaatcaaaagctcgtggaggcttccacccaattcaagaagaaacaggagaagggaaccatcgacgtgtggtggcttttcgatgatggaggactcactcttcttataccttacatactgactctccgcaagaagtggaaggactgtaagctgaggatctacgtcgggggtaaaatcaatagaatcgaagaagaaaagattgtgatggcctccctccttagcaagttcaggatcaaatttgcagacattcatatcatcggtgacattaacattcgacctaataaggaatcgtggaaggtctttgaagaaatgattgagccttaccgtctgcacgaatcgtgtaaggatctgactaccgccgagaaattgaagagagagactccttggaagattacggacgctgaacttgaggcagtcaaggaaaagagctataggcaggtccgccttaatgaactcctccaagaacattcacgtgcagcaaaccttattgtcctctcgctgccagtcgccagaaaagggtcaattagcgatcttctttacatggcatggctcgagatcctgactaagaatcttcctcctgtgctcctggtgcggggtaaccataagaatgtgcttaccttttactca

SEQ ID NO: 251125 - DNA, 3297 bp, Artificial Sequence
  Description of Artificial Sequence: Synthetic coding sequence
atgtctctcaacaactccagcaacgtgttcctggactcggtcccgtcgaacactaataggttccaagtttcggtcatcaatgagaaccacgagtccagcgccgcggccgacgacaacacggatcctccccactatgaagaaacttcattcggagacgaagcccaaaagagactcaggatctccttccgaccgggcaaccaggaatgttatgataacttcctccaatcgggcgaaactgccaagactgatgcttcgttccacgcctacgattcgcataccaacacctactacctgcagacctttggacacaatactatggacgcggtgccaaagatcgagtactaccgcaacactgggtcaatcagcgggccaaaggtgaaccgcccgtcgctcttggaaatacacgagcagctggcgaagaacgtggcggtgactccgagcagcgccgacagggtggccaacggagatggaatcccgggagatgagcaggccgaaaataaggaagacgaccaggctggcgttgtgaagttcggatgggtcaagggagtgcttgtccggtgcatgctgaatatctggggagtgatgctttttatccgactctcgtggatcgtgggagaggctggtattggactgggagtcatcatcatcggcctctctgttgtggtgaccactctgactggaatcagcatgtctgccatctgcactaacggggtggtgcggggtggtggagcatattacctgatcagccgctccttgggacctgaattcggagggtccattggactgatcttcgccttcgctaacgctgtggcagtcgcgatgtacgtggtgggtttcgccgaaaccgtggtggacctcctgaaggagtccgactccatgatggtggatccaaccaacgacatccggatcatcggatccattaccgtggtgatcctgctggggatctcggttgcgggtatggagtgggaggccaaggcacaagtgattcttctggtcattctcctgatagctatcgcgaactttttcattggaaccgtgattccaagcaataatgaaaagaagtcacggggcttcttcaactaccaggctagcatcttcgcagagaacttcggacctagattcactaagggagagggattcttcagcgttttcgctatcttcttccccgcagctactggcatcctcgcgggagccaacatcagcggagatctcgaggatccccaggacgctattccccgcggaaccatgctggccatctttattacgaccgtggcgtacctgggcgtggcgatctgcgtcggggcttgcgtggtcagagacgccactggaaatatgaacgataccatcatctcagggatgaactgtaacggctcggccgcctgcggactgggatacgatttttcacgctgcagacacgaaccgtgccagtacgggcttatgaacaatttccaggtgatgtcgatggtgtcgggattcggaccgctgatcactgctggcatcttcagcgccaccctctcctcggcgctggcctcgttggtgagcgccccgaaagtgttccaagcactgtgcaaggataacatctacaaggcgcttcaatttttcgcaaagggatacggcaagaacaatgaaccgctgcgcggctacattctgacgtttttgatcgccatggcgttcatcctcatcgccgagctgaataccatcgccccaatcatctctaactttttcctggcatcgtacgccctgatcaatttctcatgtttccacgccagctacgcaaagtcaccaggatggaggccggcttacggtatttacaacatgtgggtgtcactgtttggagcagtgctgtgctgcgccgtgatgtttgtgattaactggtgggcagcggtgatcacctatgtgatcgaattcttcctgtacgtctacgtgacttgcaaaaagccagatgtgaactggggttcatccactcaggcattgtcatacgtctcggcactggacaatgccctcgaactcactaccgtcgaggatcacgtgaagaatttcaggcctcaatgtatcgtgctgactggaggacctatgaccagaccggccttgttggacattacccatgcgttcactaagaatagcgggctctgcatctgttgtgaggtgttcgtgggacctcgaaagctgtgcgtgaaggagatgaactccggaatggctaagaagcaggcctggcttatcaaaaacaaaatcaaagcattctacgccgccgtggccgcggactgctttagagacggggtgcgctccctgctgcaagcgtcagggctgggtcggatgaaaccaaatacgctggtcatcggctacaaaaagaactggcgtaaggccccgcttactgaaatcgagaattacgtgggaatcatccatgatgccttcgacttcgaaatcggagtggtgatagtcaggatttcccaaggattcgacatttcccaggtgctgcaagtgcaggaagagctggaaagactcgaacaggaacggctggcgctggaagcaactatcaaggataatgaatgcgaagaagaaagcggaggaattcgcggcctgtttaagaaggcaggaaagctgaatatcacgaagaccactcctaagaaagacggctcaatcaatacctcccagtccatgcacgtcggagagtttaaccagaagctggtcgaagccagcacgcaattcaagaaaaagcaagaaaaaggtaccattgacgtctggtggctgtttgatgatggaggcttgaccttgttgatcccttacatcttgaccctgcggaagaagtggaaggactgcaagctccgaatctacgtgggaggaaagatcaaccggatcgaggaggaaaagatcgtcatggcgtccctgctgtccaagttcaggatcaaattcgcagacatccacatcattggcgatatcaatatccgcccgaataaggagtcctggaaagtgtttgaagaaatgatcgagccttatcggctccacgagagctgcaaggatttgaccactgcagaaaaactgaaacgcgagactccatggaagatcactgatgccgagctggaggcggtgaaggaaaaatcctacaggcaggtccgcctgaacgaactgctgcaggaacacagcagggccgccaacctcatcgtgctctcactgccagtcgcccgcaagggtagcatctcggaccttctgtacatggcctggctggaaattcttaccaaaaacctgccaccggtcctcctggtgcggggcaaccacaagaatgtccttactttctactca

SEQ ID NO: 251126 - DNA, 3297 bp, Artificial Sequence
  Description of Artificial Sequence: Synthetic coding sequence
atgtccttaaataactcctccaacgtctttttggattctgtaccttcgaacaccaatcgtttccaggtatctgtgatcaatgagaatcacgagtcttctgcggccgccgacgacaacacggacccaccgcactacgaagagaccagctttggggacgaagcccagaagcgactccggatcagttttaggccgggcaaccaggaatgctatgataacttccttcagagcggagagaccgcgaaaacggatgcatcttttcatgcctatgattcacacacaaatacgtattatcttcagactttcgggcacaataccatggacgccgtgcctaaaatcgaatattacagaaataccggaagcatctcaggccccaaggttaatcggcccagcctactggagattcatgaacagctggcaaagaacgtggcagtcactcctagtagcgctgatcgagtcgccaatggggacgggattccaggggatgagcaggcagagaataaggaagatgaccaagcaggggtggtcaagttcggatgggtcaagggtgtgctagtgagatgtatgctcaacatctggggcgtgatgttgttcatcagactctcatggatcgtaggagaagcagggattggattgggcgtcattattatcggtctttccgtcgtagttaccacccttacggggattagcatgtcagcaatttgtaccaacggcgtggtccggggaggaggcgcctactacctgattagccggagtctgggccctgagtttggggggtccattggactcattttcgcttttgctaatgcggtggccgtcgctatgtatgtcgtgggcttcgcggagacagtggtggatctcttgaaagaaagtgattccatgatggtcgaccccactaatgacatcaggatcatcggttccattactgttgtgatcttgctcggaatttccgttgccggcatggagtgggaagctaaggctcaagtgattttgttagtgattttactgatagcgatcgctaactttttcattgggactgtgatcccttccaataacgaaaagaagtcacggggctttttcaattaccaggcctcaatattcgcagagaacttcgggccacgcttcactaagggagagggctttttctccgtgtttgcaatctttttcccggccgcgactggcattttggctggcgctaacatctctggagatttagaggacccccaagacgcgattccccggggcacaatgttggccatcttcatcactacagtggcttatctcggggtggctatctgtgttggagcttgcgtagtgcgagatgcaaccgggaacatgaacgacacgataatttctgggatgaattgtaacgggtccgccgcatgtggactaggatacgactttagcagatgtcggcacgagccatgccaatatgggctgatgaacaattttcaggtgatgtccatggtctccggcttcggaccgctgattactgcaggcatctttagtgccaccttgtcaagtgcacttgcttctctcgttagtgcccctaaggtgttccaggccctgtgcaaggataacatatacaaggctctacaattttttgcgaaggggtacggaaagaacaatgaaccattgcgaggatatatcctaaccttccttattgctatggcctttatcctaatcgccgagctgaacactatcgctccaattatctccaacttcttcctcgcgtcgtacgcccttatcaatttcagttgctttcatgccagctacgcaaagtcccccgggtggcgtcctgcctacggcatctacaacatgtgggttagtctgtttggcgctgtgctgtgctgcgctgtgatgtttgtgataaactggtgggccgcagtaatcacttatgtgatcgaatttttcctatatgtgtatgtgacctgtaagaagccagacgttaattggggtagttccacccaggcacttagctatgtgtccgcactcgacaacgcgttggaactgaccacggtggaggaccatgtcaagaacttcaggcctcagtgcattgtgctgacaggaggacctatgacccgccctgctctcctcgacattacccacgctttcaccaagaattccggcctatgtatctgttgtgaggtgtttgtgggaccgcggaagctgtgcgttaaggaaatgaattccggcatggctaagaagcaggcttggcttatcaagaacaaaatcaaggccttttacgccgcagtggctgctgattgctttcgggacggcgttcgttcactgctgcaggcctccggcttgggccgcatgaaaccaaacacactggtcataggatataagaagaactggaggaaggctccactgaccgagatcgaaaattacgtcggcataatccatgacgcttttgactttgagatcggagtggtcatcgtcagaatatcacaggggttcgacatcagtcaggtactgcaggttcaagaagaattggaacggctggaacaggaaagacttgcactggaagcgactattaaggataacgaatgcgaggaagagtccggagggatcagaggcctgtttaagaaggccggaaaattaaacattacaaagactacccctaaaaaagacggatcaatcaacacaagtcagtctatgcatgtgggggagttcaaccagaagctcgtagaagcttccacccagttcaagaaaaaacaggaaaagggtacaatcgatgtatggtggttgtttgatgacggcggtctcacgctgctgatcccatacatcctgaccctccgcaagaaatggaaagattgtaaactacgcatctacgtaggcgggaagatcaatcggattgaagaggaaaagatagtgatggctagtctgctcagcaagttccggatcaaatttgcagacatccatatcatcggcgacataaatattagaccaaataaggagagctggaaggtgttcgaggaaatgattgagccctacagactgcacgagagctgcaaagacctgaccacagcggagaagttgaaaagggagacaccgtggaagatcacggacgctgagctcgaggccgtgaaagagaagtcctatagacaagttagattaaacgagctgctacaggagcattcccgggctgccaatttaatcgtgctctctcttcctgtcgctcggaaagggagtatttctgacctgctatatatggcatggctggagatcctcacaaaaaacctgccccccgtcctgctggtaaggggcaaccacaaaaatgtgctgactttttatagt

SEQ ID NO: 251127 - DNA, 3297 bp, Artificial Sequence
  Description of Artificial Sequence: Synthetic coding sequence
atgagccttaacaattcttccaacgtctttctcgacagcgtgccaagtaatactaaccgattccaggtctcagtgattaatgagaatcacgagtcttctgcagcagccgacgataatactgaccccccccactacgaggagacaagttttggtgacgaagcgcagaaaaggctgcgtatcagctttcggcctggaaaccaagagtgttacgataactttttacaaagcggcgagacagccaaaactgacgccagttttcatgcgtatgacagccataccaacacctactatctacaaacctttggccacaacaccatggatgccgtgcccaaaatcgaatattacaggaatacagggtctatctctgggcctaaagttaacaggccatctcttctagagattcatgagcagctggcgaagaacgtggctgtgactcctagctctgccgaccgggtagcaaacggcgacgggataccaggggacgaacaggccgaaaataaagaagatgatcaggccggggttgtcaagtttggctgggtcaaaggcgtgctggtcaggtgcatgttaaacatctggggtgtcatgctgttcatccgcctgagctggatcgtgggtgaagctggaatcggcctgggggtgatcattatcggactttccgtggtggtcacaaccctcacgggcatatctatgtcagcaatctgtaccaacggagtcgtccggggaggcggagcctactatcttattagcagatccttgggccccgaatttggaggctctataggtttgatatttgcgttcgcaaatgcagtcgcagtggccatgtatgtcgtgggcttcgccgagacagtcgttgacctcctgaaagagtcagactccatgatggtggaccccaccaatgatatcagaattattggatcaatcaccgtggtgatacttctgggaatttctgtggctggcatggagtgggaagccaaagcccaagtcattctgcttgttatcctcctgatcgccatcgctaatttctttattggcacagtcattccctctaacaatgagaaaaagtctcgcggtttcttcaattatcaggcatctatcttcgcagaaaacttcggccctcgtttcacaaagggtgagggtttttttagtgtgttcgccatttttttccccgctgccaccgggatcttggcaggggccaatatcagtggagacctcgaggacccccaagacgccatcccacgcggcacaatgctggctatctttatcactacagtggcttacttgggggtagcaatctgtgtgggtgcctgcgtcgtaagggacgccacaggcaacatgaacgataccattatcagtggcatgaactgtaatgggtccgccgcgtgtggactcggttacgacttctccagatgcaggcacgaaccgtgccagtacggcttaatgaataacttccaagtcatgtccatggtttccggtttcgggcccctcatcacggcaggcatcttcagcgccactctatcttccgccttggcatctttggtgtcagcccccaaagtatttcaagcattatgcaaggacaatatctacaaggccttgcagttttttgcaaaagggtacggcaagaataatgagcccctccggggatatattctgaccttcttgatcgccatggctttcatcttaattgccgagttgaacacaattgccccaatcattagcaatttcttcttggcaagctatgcccttatcaacttctcttgttttcacgcgtcatacgccaaatcacccggttggcggccagcatacggtatctacaacatgtgggtgtccctgttcggtgccgtgctctgttgcgccgttatgttcgtgattaattggtgggcagccgtgattacctacgtgatcgagttctttctgtacgtttatgtgacctgcaagaagccagacgttaactggggtagctcaacccaggctctctcgtatgtttccgcgttggataatgcccttgagctcacgactgtggaggatcacgtcaagaattttaggccccagtgcattgttctgacggggggtcccatgacacgccctgccctgcttgacatcacccacgcatttacgaagaactcaggcctgtgcatctgttgcgaggtgttcgtgggcccacgtaagctctgtgtaaaggagatgaacagcggaatggcaaagaagcaggcttggctgattaagaacaaaattaaagctttctacgccgcggtcgccgcggactgtttccgtgatggcgtgcgcagcctgctgcaggctagcggcctggggcgcatgaaacccaacacactggtcatcggatataaaaaaaattggcgaaaggcgcccctgacagagatcgagaactatgtgggtattattcatgatgccttcgacttcgagattggcgtggtcattgtgcgaataagccagggtttcgacatcagccaagttctgcaggttcaagaggagctcgagcgcctggaacaggaaaggctggcactagaagcgacgattaaagacaacgaatgcgaagaagagtccggcggtatccgcggtctgttcaaaaaagccggcaaactcaacatcacaaagaccactcccaagaaagatgggagcatcaacaccagccagtccatgcacgtaggggaatttaaccagaagctcgtggaggcttcaacccaatttaagaagaaacaggagaaaggaactattgatgtctggtggctgtttgatgatggaggactgaccctgctcatcccatacatcctgacgctaagaaaaaagtggaaagactgcaagctcaggatttacgtgggaggcaagattaacagaatagaagaagaaaagattgtgatggcctccctgctgtccaagttcagaatcaaattcgcagatatccacattataggggacattaacatacgacccaacaaagaatcctggaaggtgttcgaggaaatgatagaaccctaccgcctccatgaaagctgcaaggacctgactaccgcagagaagcttaagagagagaccccctggaagatcaccgatgctgagctggaggccgtgaaagaaaaatcatacaggcaggtgcggttgaacgagcttctccaggagcatagccgcgctgcgaacttgatcgtcctgagcctgcccgtcgcccggaaagggagcatcagcgatttgttatacatggcatggcttgagatactgactaaaaatttgccacctgtgctactggtcagaggcaatcataagaatgtgttgaccttttactct

SEQ ID NO: 251128 - DNA, 3297 bp, Artificial Sequence
  Description of Artificial Sequence: Synthetic coding sequence
atgtctctgaacaattcctctaacgtctttttggactccgtcccaagcaacactaaccgtttccaagtttccgtgattaatgaaaatcacgagtccagtgcggctgctgacgacaatacagaccccccacactatgaagagacttccttcggcgacgaagcacagaagaggcttcgtatctcattccgccccgggaatcaggaatgttatgacaacttcctgcagtcaggggaaaccgccaaaaccgatgccagcttccatgcttacgactcccacactaacacctattatctgcagaccttcggacacaacactatggatgccgttcctaagatcgagtactatcgcaacaccggaagtattagcggcccaaaagtgaaccggccctccctactcgaaatccatgagcagctagccaagaatgtcgctgtcacaccatccagcgcagatcgggtggccaatggggatgggatacccggggatgaacaagcagaaaacaaggaggacgatcaggccggggtcgtcaaattcggctgggttaaaggggtactggtgagatgtatgttaaacatttggggcgtgatgctgttcatacgtttgtcttggattgtgggagaagccggtatcggacttggcgtaataatcatcggtttgagcgtggttgtcactacactgacgggcattagtatgtcagcaatatgtacaaacggagtggtaaggggtgggggcgcctactacctaatcagtaggtcactggggccggaatttggcggctccatcggtctgatctttgcgttcgccaatgctgtggccgtggctatgtatgtggtaggattcgctgaaacagtggttgatttgctgaaagaaagcgattcaatgatggttgaccccacgaatgatattcgcatcattggatctattactgtcgttatccttctaggaatttcagtggctggcatggaatgggaagctaaggctcaggtcatcctgctggtcattctccttattgccattgcaaacttttttataggcactgtgataccgtctaataacgaaaaaaagtcaagggggttcttcaattaccaggcaagcatttttgctgaaaactttggaccccggttcaccaaaggtgaaggcttttttagtgtctttgctatattctttcctgcagccacaggcatcctggcgggtgctaacatttccggggacctggaggaccctcaggatgctatcccgagaggcacaatgctggcgattttcattacaacagtggcgtacctgggcgtggcaatttgtgtgggagcctgcgtggtccgagacgccacgggaaatatgaatgacacaattatctccggaatgaactgcaacggcagcgccgcttgcggacttggttatgatttctccagatgccgacacgaaccctgccagtatgggctcatgaacaatttccaagtgatgtcaatggtaagtggcttcggacccctaatcactgcgggaatcttctcggccaccctctcctctgccctagcaagtctggtgtccgcacccaaggtgtttcaggctctgtgcaaggataacatctacaaggcccttcaattcttcgccaaaggctacggtaagaacaacgaacctctgcgaggatatattctgaccttcttaatcgcaatggcgttcattctcattgccgagctgaataccatcgcacccatcattagcaacttcttccttgcttcctacgccctaataaacttcagttgctttcatgcgagctacgcgaagtcccctggatggagaccagcctatggtatatataatatgtgggtgtcactgtttggggccgtgctgtgttgcgcagttatgttcgtaatcaactggtgggctgcggtgattacgtacgtcatcgaattctttttgtacgtgtatgtgacctgtaagaagccagacgtgaactggggatcctcaacccaggccctcagttacgtgagcgctcttgacaatgccctagaactcactaccgttgaagaccatgtaaaaaacttcaggccccaatgtatagttctgactggaggtccaatgacaagacctgctcttttggatatcactcacgcattcacgaagaactccggactctgcatatgctgcgaggtcttcgtaggacccagaaagctgtgtgttaaggagatgaatagcggaatggccaagaaacaggcctggctgattaagaataagattaaagccttttatgctgcagtggctgccgattgttttcgagatggggtccggtctctactgcaagcaagtggactcggccgaatgaaaccgaataccctggtgatagggtataaaaaaaactggcgaaaggccccactgaccgaaatagagaactacgtcggcattattcacgatgctttcgacttcgaaattggggtcgtgattgtgagaattagtcaggggttcgacatcagtcaggtgcttcaggtgcaggaggaactcgaacgtctggagcaggagaggctcgcgttagaggctaccattaaagacaatgaatgcgaggaagaatccggggggattaggggtctatttaagaaagccggaaagctcaatataaccaagaccacacccaagaaggacggctctattaacactagtcagagtatgcatgtgggtgaattcaaccagaaactcgtcgaggcgagcacgcaattcaagaagaaacaggagaagggaaccatcgacgtgtggtggctctttgatgacgggggacttaccctgctgatcccctatattctcacgctgcgcaagaaatggaaagattgtaaactgagaatctatgtgggcggaaagatcaatagaatagaggaggagaaaatcgttatggcatcactgctgtctaagtttcgaattaaattcgccgatatccatatcatcggcgacatcaatatacgaccgaacaaggaatcctggaaagtctttgaagagatgatcgaaccttataggctgcacgagtcctgcaaagacctgaccacagcagagaaactgaagcgagagaccccctggaagatcaccgatgccgagcttgaggcggtgaaggagaaaagctatcgacaggtgagactcaatgagctgcttcaggagcacagcagagccgctaatctgatagtgttgtcgctgccggtcgccaggaaaggttcaataagcgatctgctgtacatggcttggctggagatcctgactaagaacttaccacccgttctgttggtaagaggtaatcataagaacgtgttgactttttattcg

SEQ ID NO: 251129 - DNA, 3297 bp, Artificial Sequence
  Description of Artificial Sequence: Synthetic coding sequence
atgtccctgaacaattcttctaatgtgttcctcgattccgtgccatctaatacaaatcgatttcaggttagtgtcatcaacgagaatcatgagtcctctgcagccgccgacgacaataccgatccacctcactacgaggaaacctcctttggagatgaagctcagaagagactgagaattagtttccgtcccggaaatcaggaatgttacgacaatttcctgcagtccggcgaaaccgcgaagacggatgcgagctttcatgcttacgattcccatacgaatacatattatctgcaaactttcggccacaataccatggacgctgtgccaaagatagagtactacagaaacacgggttcaatttcaggtcccaaagtaaatagaccaagtctgctggagattcacgagcagctggcaaaaaatgtggctgtaactcctagctcagcagaccgagtcgccaatggggacggtataccaggggatgagcaggccgagaacaaggaggatgaccaggctggcgtggtcaagttcgggtgggtgaagggcgttttggtccgatgcatgttgaatatttggggtgttatgctctttattagactgagctggatcgtgggagaagccggtataggcctcggagtgatcatcataggattaagtgttgtggttaccaccttaacagggatctccatgtccgcaatttgcacaaatggcgtggtaaggggcggaggcgcctattacctaatcagccgaagcctggggccggagtttggcggcagcatcgggctcatctttgcatttgcgaacgctgtggctgtcgccatgtacgtggtcggcttcgcagagactgtcgtggacctgttaaaagaatcagattccatgatggttgaccctacaaacgatatccggatcatcgggtctattaccgtggtgattctccttggaatttcagtggccggcatggagtgggaagctaaagcccaggtaattctcctggtcattctccttatcgctatcgccaatttttttatcggcacggtgatacccagcaacaacgagaagaagagtagggggttctttaattaccaggctagcatttttgcagagaacttcggccctcggttcaccaagggggaaggttttttcagcgtatttgcaatctttttcccagccgctactgggatcctcgctggtgccaacatctctggggacttagaagatcctcaagatgctatcccccgcggcactatgttggcaatcttcattacgacggttgcctacctgggcgtagccatctgcgtgggagcgtgcgtcgttagggacgccactggcaatatgaacgacactattatctctggcatgaactgcaatggaagcgcagcatgcgggcttgggtacgacttttctcgttgcaggcacgaaccctgtcagtacgggctgatgaacaacttccaggtgatgtccatggtctctggcttcggccctctcatcaccgccggaatattcagtgcgacgctctcctccgctctcgcctctcttgtgtcagcacccaaagtctttcaggccttatgcaaggataatatttacaaagccttacaattcttcgctaaagggtacggaaaaaataacgagcctttgcgggggtacatcctaacgttcctgattgccatggcctttattcttatcgccgagctgaacaccatcgcacctattattagcaacttctttttagcttcctatgccctgataaattttagctgcttccatgcttcctacgcaaagtcccccggctggcggcctgcatatgggatttataatatgtgggtgagcctctttggcgcagtgttatgctgtgcggtaatgtttgttataaactggtgggccgctgtcataacttacgtgatcgagttttttttgtatgtgtacgtcacttgcaaaaagcctgatgtgaattgggggagctccactcaggccttgagctatgtgagtgctctggataacgcacttgagttaaccacggtggaggaccacgttaaaaactttagaccacagtgtattgtgctgacaggtggccccatgaccaggcctgcactgttggatatcactcacgcctttaccaagaactcaggactttgtatttgttgtgaagtgtttgttgggccccgcaagctgtgtgttaaagaaatgaactcaggcatggccaagaaacaggcgtggctcattaagaacaaaataaaggcgttctatgccgccgtggcagccgactgcttcagagatggggtacggagcctgctccaggcttccgggttaggcaggatgaagcctaacactctggtcatcgggtataagaagaattggcggaaagcaccactcacagaaattgagaactatgtgggaataatccacgatgcctttgatttcgaaatcggggtagttatcgttcggattagccagggattcgatatttctcaagtgttgcaggtgcaggaggaactcgagaggctcgagcaggagcgcctggccttggaagccaccatcaaagacaacgaatgcgaggaggagtctggcggcatccgaggattgttcaaaaaggccggtaagttgaatatcaccaagaccaccccaaagaaagatggttctattaacacctctcagtcaatgcacgttggggaatttaatcagaagctggtagaagcgtccacccagtttaagaaaaaacaggagaagggtacgatcgatgtgtggtggttgtttgacgatgggggtctgactctgctcataccttatattctgactctgagaaagaaatggaaggactgcaagctgaggatctatgtgggcgggaaaattaataggatcgaggaggaaaagattgttatggcttccctgttgtcaaagtttcgcatcaagtttgccgatatacatatcataggtgatattaacatccgtccgaataaggagagctggaaggtgttcgaggaaatgattgaaccatacaggttgcacgaatcttgcaaagacttgactaccgccgagaagctaaaaagggagaccccctggaaaataactgacgctgaattggaggccgtgaaagaaaaatcgtatagacaggtcagactcaacgagcttctccaggaacactcccgggccgccaatctgatagttctgagcttgccggtggcaagaaagggttccatttcggatttgctctacatggcctggctcgagatcctcaccaaaaacctcccacccgtgctcctggtaaggggcaaccacaagaatgtcctgactttctattct

SEQ ID NO: 251130 - DNA, 3297 bp, Artificial Sequence
  Description of Artificial Sequence: Synthetic coding sequence
atgagcctcaataacagtagcaacgtgtttctggactccgtgcccagcaacactaataggtttcaggtgtcggtgatcaatgagaaccacgagtcatcggcagcagcagacgataatacggatcctccccattacgaggaaactagcttcggagatgaggcgcaaaagcgccttcgtattagcttcaggcctggaaaccaggaatgttacgacaattttcttcaatccggtgagacggccaagactgatgcatcttttcatgcttacgattcacataccaatacctactacctgcaaacttttggacataatactatggacgcagtgccgaaaatagaatactaccggaataccggatcgatttcgggacctaaggtgaacagaccatccctccttgagatacatgaacagctggcaaagaatgtggcagttaccccttcctccgcagatcgcgtggcaaacggggacggtattccaggggatgaacaggccgagaacaaagaagatgatcaggcaggagtggtgaagttcggatgggtgaagggagtcctggtgaggtgcatgctcaacatttggggcgtcatgcttttcatacgactcagctggatagtcggtgaggcaggcatcggactgggagtgattatcattgggcttagcgtggtggtgactaccctgactggtatctcgatgagcgcaatttgtactaatggtgtggtgcgcgggggcggcgcctactacttgatctcaaggagcttgggaccagaattcggtggttccatcggactgatcttcgcctttgcgaatgcagtggcagtcgccatgtacgtcgtgggttttgcagaaacggtcgtggacctgctgaaggaatccgactccatgatggtagatccaaccaatgacattcgcatcataggatcgattaccgtggttattctcttgggaatttccgtggcaggaatggaatgggaggccaaggcacaggtgattcttcttgtgattctgctgatagctatcgcaaacttcttcataggaaccgtgattccttcgaataacgagaagaaaagcaggggattctttaactaccaggcaagcattttcgccgagaactttggtccaagatttaccaaaggagagggctttttcagcgtgtttgcaatattctttcccgcggctaccgggattcttgcaggcgccaacatatcgggggatctggaggatcctcaagatgcaatccctcgggggactatgctggcaatctttatcaccaccgtcgcctatcttggggtggcaatttgcgtgggagcatgcgtggtgcgagatgcaactggaaacatgaacgacactatcatttcgggtatgaattgtaacggcagcgccgcgtgcggactgggttatgatttttcgcgctgccgccacgagccgtgtcagtacggactcatgaataactttcaagtgatgtcgatggtcagcggatttggccctctgatcacggcaggcattttcagcgcaacgctctcaagcgcacttgcctctcttgtcagcgccccaaaggtctttcaggcactttgtaaagacaatatctacaaggccctccaattctttgcaaaaggatatggtaagaataacgaacccctgaggggatacattctcacctttctcattgcaatggcttttatcctgattgcagagcttaacacgatcgcacctatcatcagcaactttttcctcgcaagctacgccctgatcaacttttcctgttttcatgcctcgtacgcaaagtcgcctggatggcggccagcatatggaatctacaacatgtgggtgtccctgtttggtgcggtcctttgttgcgccgtaatgttcgtgattaactggtgggcagccgtgatcacttacgtgatagaattctttctttacgtgtacgtgacttgcaagaagcccgacgtgaactggggatcgtcgacccaagcgctgagctatgtgagcgcacttgacaatgcactggaactcactaccgtggaggatcacgtgaagaatttcagacctcaatgtatcgtgttgacggggggtccgatgaccaggccagctctcctggatatcactcatgcgtttacgaagaatagcggactttgcatctgctgtgaagtctttgtcggtcctaggaagctgtgtgtcaaggaaatgaatagcggtatggcgaagaagcaagcatggctcattaagaacaagattaaagcattttacgcagcggtggccgcggattgttttagagacggggtcagatcactcctgcaagcctcgggactgggtaggatgaaaccaaacaccctggtgattggttacaagaaaaactggcggaaggcaccactgaccgaaatcgaaaactatgtcggaattatccatgatgcatttgacttcgagataggggtcgtgattgtgcggatatcacaaggattcgatatctctcaggtgctgcaggtgcaggaggaactggaacgcctcgagcaggaacgccttgcacttgaggcaaccattaaggacaacgagtgtgaggaagaatccggaggtattcgtgggctcttcaaaaaggcaggaaagctgaatatcactaagacgacccccaagaaggatgggagcattaacacgtcgcagtcgatgcacgtgggagaattcaaccagaaattggtcgaggcatcgacccagttcaaaaagaagcaagaaaagggaaccatagatgtgtggtggctttttgatgatggcgggctcactctgctgatcccttacattttgaccctgcgcaaaaagtggaaagattgtaagctcagaatttacgtcggaggaaagataaacagaatcgaggaagagaaaattgtgatggcatcgctgcttagcaaatttcgaataaagtttgcggacattcacatcattggagacatcaatatccgcccaaacaaggaatcatggaaggtctttgaggaaatgatcgaaccttacagacttcatgaatcctgtaaggatctgactaccgcagaaaaactgaagcgcgaaaccccatggaagattactgacgcagagctcgaggcagttaaagaaaagtcctaccggcaagtgcgacttaatgaactgctgcaagaacactcgcgggccgctaacctgattgtcctttccctgccggttgcccgtaagggttcaattagcgacctcctctacatggcgtggctcgaaatacttaccaaaaacctgcctccagtgcttctggtcaggggaaaccacaagaacgttctcactttctacagc

SEQ ID NO: 251131 - DNA, 3297 bp, Artificial Sequence
  Description of Artificial Sequence: Synthetic coding sequence
atgtccctgaacaattcctctaatgtgttcctcgactcagttccttcaaacaccaaccgcttccaagtgtccgtgatcaatgagaaccacgagtcaagcgcagcagcggacgacaatacggacccgccgcattacgaggaaacttcgttcggggacgaagcgcagaagcgcctgcgcatttccttcagacccgggaatcaggaatgctacgacaatttcctgcagtcgggagagactgctaagactgacgcctcgttccacgcatacgattcccacaccaacacctactatctgcaaaccttcggtcataacactatggacgctgtccctaaaatcgagtactatcgcaacaccggatcaatcagcggtccgaaggtcaacagaccgagcctgctggaaattcacgaacagctcgccaagaatgtggcagtcactccctcaagcgctgacagagtggccaacggcgacggcatcccaggagacgaacaggcggaaaacaaggaagatgatcaagcgggtgtggtcaagttcggatgggttaaaggagtgctggtgaggtgcatgctgaatatctggggagtcatgctgtttatcaggctttcctggatcgtgggagaagccggtattggattgggagtcatcattatcggactctcggtggtcgtcaccaccctcaccggcatctcgatgtcggcgatttgcactaatggggtggttcgtggcggtggagcctactacctgatcagccggtcgctcggcccggaattcggtggcagcattggactcatttttgctttcgcgaacgcggtggcagtcgccatgtatgtggtggggtttgcagaaaccgtggtcgatctgcttaaggagtcagactcgatgatggtggatccgaccaacgacatccggatcatcggctccatcaccgttgtcatcctgttgggaatctcagtggccgggatggaatgggaagctaaggcacaggtgatcctgctcgtgatcctgctgatcgccatcgctaacttcttcatcggaaccgtcatcccatctaataacgagaagaaatcgcgagggttcttcaattaccaggcttcaatcttcgccgaaaactttggcccgcgcttcaccaaaggagagggatttttcagcgtctttgccatctttttcccagccgccactggaattcttgctggcgcgaacatctcgggtgaccttgaagatccacaagatgccatccctcggggcaccatgctcgcgatattcatcactaccgtggcataccttggggtggcaatttgcgtcggtgcctgtgtcgtccgcgatgcaactggcaatatgaatgacactatcatcagcggtatgaattgcaatggcagcgccgcttgcggactgggatacgacttttcgagatgtcgccacgaaccttgccagtacggactcatgaataacttccaagtgatgtctatggtgtccgggttcggtccgctcatcaccgctggcatcttctcagctactctttcctcggcactggcgtcccttgtgtcagcccctaaagtgtttcaggccctgtgtaaagacaacatctacaaggcgttgcagttcttcgccaaagggtatggcaaaaacaacgaacctctgcggggttatatcctgactttcctgattgctatggcattcatcctcatcgccgagctcaacacgatcgccccaattatctcgaacttcttcctcgcgtcgtacgcgctcatcaacttctcctgcttccacgccagctacgctaaatctcccggttggcgccctgcatacggaatctacaatatgtgggtgagcctgttcggcgcggtgctctgctgtgcagtcatgtttgtgatcaactggtgggctgcagtgatcacttatgtcatagagttttttctctacgtttacgttacttgtaagaagccggatgtgaactggggatcgtcaacccaggctctcagctacgtgtcagccctcgacaatgcgctggaattgactacggtggaggatcacgtcaagaacttcaggccgcagtgcatcgtgctgacgggtggacccatgacccgcccagcacttctggacatcacccacgccttcaccaaaaactcaggactgtgcatctgctgcgaggtgttcgtgggccctaggaagttgtgtgtgaaagagatgaattccggaatggcgaagaagcaggcctggctgattaagaacaagatcaaggcgttttacgccgcggtggccgccgactgtttcagagacggcgttcggagccttttgcaagcgtcgggactcggacggatgaagccaaacacgctcgtcatcggctacaaaaagaattggcgcaaggcgccgctgactgaaatcgagaactacgtggggattatccatgacgctttcgatttcgagatcggcgtcgtgattgttagaatctcacaaggtttcgatatatcacaggtcctccaagtgcaggaagagctggaacgactggagcaagagcggcttgcccttgaggccacgataaaggacaatgagtgcgaggaagaatcgggcggcatccgcgggctgtttaagaaagcaggaaagctgaacatcactaaaaccactccgaagaaggatggctcaatcaacacctcgcaatccatgcacgtgggcgagtttaaccaaaagctggttgaagcgtctacccagttcaagaaaaaacaggagaaaggtaccatcgatgtgtggtggctcttcgatgatgggggactgaccctgctgatcccatacattctcacgttgcggaagaagtggaaggactgcaagctccggatctacgttggaggtaagattaatcgcattgaagaggagaagatcgtgatggcttccttgctgtccaagttccggatcaagttcgccgatatccacatcatcggagacatcaacattcggccgaacaaagaaagctggaaagtgtttgaggaaatgatagaaccctaccgcctccatgaatcgtgcaaggatttgactaccgctgaaaaactgaaaagagaaactccgtggaagattaccgacgccgagctggaagccgtgaaggagaaatcctacagacaggttagactcaatgagctgcttcaggaacattcacgcgcggcaaatctcatcgtgctgtcacttccggtggctaggaagggaagcatctccgacctgctttacatggcttggctggaaatccttaccaaaaatctgccgccggtgctgctcgtgcggggcaatcataagaacgtgctcaccttttactcc

SEQ ID NO: 251132 - DNA, 3297 bp, Artificial Sequence
  Description of Artificial Sequence: Synthetic coding sequence
atgagcctgaacaattccagcaacgtgtttctcgattcagtgccatccaatactaacagatttcaagtgtcggtgattaacgaaaatcacgaaagcagcgctgccgccgatgataacaccgatcctccacactacgaggaaactagctttggtgatgaagcacagaagagacttcgaatcagctttagaccggggaatcaagaatgttacgacaactttctgcaatcaggtgaaactgccaagaccgacgcatcgtttcatgcctacgactcgcatacgaatacctactaccttcaaacctttgggcacaataccatggatgccgttccaaagattgagtactacaggaataccggatcgattagcggtcctaaagtaaacaggccttctctgttggaaattcatgaacagctggcgaaaaatgtggccgtgacgccctccagcgccgatagggtggcaaatggagatggaattccaggagatgagcaagcagagaacaaagaggatgatcaggcaggtgtcgtgaagttcggttgggtgaagggagtgttggtccggtgtatgctgaacatatggggcgtgatgctcttcatccggctttcgtggattgtaggcgaagccggaatcggtttgggtgtcatcataataggactcagcgtcgtggtcactaccctgaccggaatctccatgtcggctatttgtaccaatggcgtggtccgcggtggtggagcgtactatcttatttccaggagcctgggtcctgagttcggaggctccatcggtcttatctttgcattcgcgaacgcagtggcagtcgctatgtacgtggtgggatttgctgaaactgtggttgatctcctgaaagagtctgattccatgatggtggatcctactaatgacattcgcatcattggatcaataaccgtggtcattctccttggtatatcagtggcaggaatggagtgggaagcgaaggcccaggtcattcttctggtcatcctccttatcgccatcgccaatttcttcatcggcaccgtcattccttcaaacaacgaaaagaagtctcgtggattctttaactaccaagcatccattttcgcagagaatttcgggcctcggtttaccaaaggcgagggatttttctccgtgttcgcaattttcttccctgcagctactgggatccttgcaggagcaaacatatcgggggacctcgaagatccgcaggatgctatcccccgcggaactatgctcgccatcttcataacgactgtcgcatacctcggggtggccatttgtgttggtgcatgtgtggtgagagacgccaccggaaatatgaatgacacgattatctccggaatgaactgtaatggctcggcagcatgcggtctgggctatgacttttctcgatgcagacatgaaccttgtcagtacggactcatgaacaacttccaagtcatgtccatggtatccggattcggacctctcattacggcgggtatcttctcggcgacgctttcgagcgcactcgcatccctggtatcagcacctaaggtgttccaagccctgtgcaaggacaacatctataaggcactgcagttttttgcaaagggatacgggaaaaacaacgaaccattgagaggttacatccttaccttcctcattgcaatggcatttatccttatcgcagaactcaacacgatcgcacctatcattagcaatttctttctggcaagctacgcactgatcaacttctcatgttttcatgcgtcctacgcaaagtcgcccggatggcggccagcatacgggatttacaatatgtgggtgagcctttttggagccgtgctctgttgcgctgtgatgtttgtgattaactggtgggccgcggtgattacttacgtgattgaattctttttgtacgtgtacgttacgtgtaagaaacctgatgtcaactggggatccagcacccaggcactttcgtacgtgtcggccctggataacgcgcttgagctcaccactgtggaggaccacgtcaagaacttcagacctcagtgtatagtcctcaccggaggtccaatgacgaggccggcacttctggacattacccacgcatttaccaagaactcgggtctgtgtatctgttgtgaagtgtttgtgggaccacggaaactctgcgtgaaggaaatgaactcaggcatggccaaaaagcaagcctggctcatcaaaaacaagattaaagcgttttacgctgccgttgcggccgattgtttccgggacggagtgaggtcactgctccaagcatcgggacttggacgaatgaaacccaacaccctcgtgatcggttacaaaaagaactggaggaaggccccacttacggagatagagaactacgtgggtatcatacatgatgcctttgattttgaaatcggagtcgtgatcgtgcgtatttcgcaaggttttgacattagccaagtgttgcaggtgcaagaagaacttgagcgactggaacaggaacgcctggcactggaagccactattaaggacaacgaatgtgaagaggaatcaggtggaattcgaggtctgtttaagaaggcaggaaaactcaacatcaccaagaccaccccgaaaaaggatgggtccattaacacttcgcagagtatgcatgtcggtgaattcaatcaaaaactggtggaggcaagcactcagttcaaaaagaagcaagagaaaggaactatcgatgtgtggtggctgttcgatgacggaggccttactctgctgatcccttatatcctgactcttcgtaagaagtggaaggattgcaagctgcgcatctacgttgggggtaagattaacagaatcgaggaagaaaagatcgtcatggcatcgcttctgagcaagttccgcataaagttcgcggacattcacattatcggagatatcaatattcgtcctaacaaagaatcatggaaggtgttcgaggaaatgatcgaaccatacagactgcacgagtcttgcaaggacttgactactgcagagaagctgaagcgagaaaccccatggaagattaccgacgcagaattggaggcagtgaaggagaaaagctatagacaggttagactgaacgaacttctgcaggaacattcaagagcagccaacctcatcgtcctttcacttccagtcgcacggaagggttccatttcggacctcctgtacatggcgtggctcgaaatccttaccaaaaacctgccccctgtgctgctggtgcggggtaatcataagaacgtgctgactttttactca

SEQ ID NO: 251133 - DNA, 3297 bp, Artificial Sequence
  Description of Artificial Sequence: Synthetic coding sequence
atgtcactgaataactcgtcgaatgtgtttctcgattcagtcccttccaatactaacaggtttcaggtgtcggtcattaacgaaaaccacgagtcgtccgcggcagcagatgacaatactgatccaccgcactacgaggaaacctcattcggggacgaagctcagaaacggttgcggatctcgttccgaccggggaaccaagagtgctacgataactttcttcaatccggagagactgcaaaaaccgacgcatcttttcatgcatacgatagtcacaccaacacctactaccttcagacctttggacataacaccatggatgcagttcccaaaattgaatactaccgaaataccggatcgatttccggaccgaaggtcaatagaccttccctgctggagatacatgaacagcttgcgaaaaacgtggcggtgacccctagctctgccgacagagtggcaaacggcgacggtatcccaggggatgagcaggcagaaaacaaggaggacgaccaggcaggagtcgttaagttcggttgggtgaagggcgttttggtgcgctgcatgctgaacatttggggagtcatgttgttcatccgattgtcctggattgtcggtgaagcaggaattggccttggcgtaatcattatcggtctttcagtggtggtgactactctcactgggatctccatgtcagcaatctgtactaacggtgtggtcaggggcggaggtgcgtattacctgatctcaagaagccttggacccgaattcggaggttccatcggattgattttcgcctttgcaaacgccgtggccgtcgctatgtacgtggtgggttttgcagaaactgtggtagatctcctgaaagaatcggactccatgatggtcgatccaactaatgatataaggatcattggctcaataaccgtggtgatcctgctcgggatctcagtagcagggatggagtgggaagcaaaggcacaggtgatacttcttgttatcctcctcattgcaattgccaacttctttatcggaaccgtgatcccttcgaacaatgaaaagaaatccagaggattctttaactaccaagcatccatatttgcagagaactttggaccaagatttaccaaaggagaaggtttcttttcggtgttcgccattttcttccctgcggccaccggcattctggccggagccaacatctctggtgatctcgaggacccgcaagatgctattcctagagggacgatgcttgcgatcttcattactaccgtcgcatacctgggggtcgctatttgtgttggagcatgtgtggtgcgcgatgctactggcaatatgaacgatacgattatctctggaatgaactgtaacggttcggcggcgtgtggcctcggatacgacttttcgaggtgcaggcacgagccttgtcaatacggactgatgaacaactttcaggtgatgtctatggtcagcggatttggtccacttattacggcagggatctttagcgcaaccctgtcctcagccttggccagcctggtcagcgcccctaaggtgtttcaagcactgtgcaaggacaatatctacaaggcgcttcagtttttcgcgaaggggtacggtaagaacaatgagcctctgcgcggctacattcttactttcctgattgcaatggcgtttatacttatcgcagaattgaacactatcgcgccaattatctcaaatttcttcttggcgtcttatgccctgatcaatttctcctgttttcacgcgagctacgctaagtcccccggatggcggcctgcatatgggatttacaatatgtgggtcagcctttttggcgcagtgctgtgttgcgcagtcatgttcgtgatcaattggtgggcagcggtgatcacttacgtgattgagttttttctgtacgtgtacgtgacttgtaagaagcctgatgtgaactggggatcctccactcaggccttgagctacgtgtcagctctggacaacgcacttgaactcaccaccgtcgaggaccacgttaagaatttcaggcctcaatgtatcgtgttgacgggtgggcctatgacccggcctgcactcctggatataactcatgcttttacgaagaacagcggactctgcatctgttgtgaggtgttcgtgggtccacgaaagctctgtgtgaaggagatgaactccggcatggcaaaaaagcaagcatggctcataaagaataagatcaaggcattttacgccgcagtggcagcagattgctttcgagacggtgtcagatcattgcttcaagcatcaggcctgggtcgcatgaaaccaaacactctggtcatcggttacaaaaagaactggcggaaggcacccttgaccgagattgagaattacgtgggaatcattcatgatgccttcgactttgaaatcggcgtggttatcgtgcggatttcgcaaggatttgacatatcgcaagtcctccaagtccaggaagaacttgaacgacttgaacaagaaagactcgcactcgaagcaactattaaggataatgagtgtgaagaggaatcgggaggaatccgtgggctgtttaagaaggctggtaagctgaacattaccaagaccacccccaagaaggacgggagcattaacacctcgcaatctatgcatgttggtgaattcaaccagaaacttgtagaagcatcgacccagtttaagaaaaaacaagaaaagggaaccattgacgtgtggtggctctttgatgatggcggactcactctgctgattccttacattctgacgctgcgcaagaaatggaaggattgtaagctgagaatatacgtcggtggaaagattaacagaattgaagaggaaaagattgtcatggcatcccttcttagcaaatttcggatcaaatttgcagatatacatatcattggggatatcaacatacgcccaaacaaagaatcatggaaagtgtttgaagaaatgattgaaccctacaggcttcatgaatcgtgcaaagatttgaccacggcagaaaagctgaagcgtgaaactccatggaagatcaccgatgccgaactggaggcggtcaaggagaagagctacagacaggtgagacttaatgaacttctccaagaacattccagagcagccaacctgatcgtgttgtccctcccagtcgcccgcaaggggtcgatatccgatcttctgtatatggcctggttggaaatcttgaccaagaatctgcctcccgtgcttctggtccggggaaatcataagaatgtcctgaccttttactcg

SEQ ID NO: 251134 - DNA, 3297 bp, Artificial Sequence
  Description of Artificial Sequence: Synthetic coding sequence
atgtcgctgaacaacagctcgaacgtgtttctggactccgtgccctccaacaccaaccggtttcaggtgagcgtgatcaacgaaaaccacgagtcgtccgccgctgccgacgacaataccgaccctccacattacgaagaaactagcttcggagatgaagcacagaagcggctcagaatcagctttcgcccaggtaaccaggaatgctacgataacttcctgcaatcaggtgaaactgctaagactgatgcatcgtttcacgcgtatgactcccataccaatacctactacctgcagaccttcggacacaataccatggacgccgtgccgaagatcgagtactaccggaataccgggagtatctctggaccaaaggtgaaccggccgtcgctgttggaaatacacgaacaactggcaaaaaacgtcgctgttaccccatcctcagctgaccgcgtcgccaatggcgatggaatcccgggagacgaacaggccgagaacaaggaggacgaccaggcgggtgtcgttaagttcggttgggtgaagggagtgctcgtgagatgcatgttgaacatatggggggtcatgctcttcattcgcctttcgtggatcgtgggcgaagcgggaattggacttggggtgatcatcatcgggctctcggtggtggtgacgaccctgaccggaatctccatgtcggccatctgcacgaacggggtcgtgaggggaggtggggcatactacctgattagtcgctcgctgggtccggagtttggcggaagcatcggactcatcttcgcgttcgcaaacgccgtggcagtggccatgtacgtcgtgggattcgctgagactgtggtggatctgctgaaagaatccgactccatgatggtcgatccgactaatgacattaggatcataggatccatcactgtggtgatcctcctcggcatctcggtggccggaatggaatgggaggcaaaggcgcaggtgatcctgctggtgattctgctgatcgcaatcgccaacttcttcatcggaaccgtgattccatcaaataacgaaaagaagtccagaggcttcttcaactaccaggctagcatcttcgcggagaatttcggaccgcgcttcactaagggagaaggattcttcagcgttttcgccatcttcttcccagcggcgacggggatccttgccggagcaaacatttccggagatctggaagatccgcaagatgcgattccacgcggaactatgctcgccatcttcatcaccaccgtggcgtacctgggagtggccatttgcgtgggtgcctgcgtggtgcgcgacgccaccggtaatatgaacgataccatcatctcggggatgaattgtaacggctccgccgcctgcgggctggggtacgacttctcccgctgtagacatgaaccgtgccagtacggattgatgaacaactttcaggtgatgtctatggtcagcggattcggcccgctgattaccgcgggcatcttctcagccaccctctcgagcgctctggcctcgttggtgtcagccccgaaggtgtttcaggcgctgtgcaaggacaacatttacaaggccctccaattcttcgcgaagggctacggcaagaacaatgaaccacttcggggttatatcctgaccttcctgatcgcgatggcgttcatcctgatcgcagaactgaatactatcgcccccatcatttcgaacttcttcctggctagctacgcgctgatcaacttttcgtgcttccacgcaagctacgccaagtcgccgggttggaggccggcctatggcatctacaatatgtgggtgtcgctcttcggagcggtgctttgttgcgcggtgatgttcgtgatcaactggtgggccgctgttatcacctacgtcattgagtttttcctgtatgtctacgtcacttgtaagaaaccggacgtgaattggggatcgagcactcaagccctcagctacgtgtcagcgctcgataatgcgttggagctgacgaccgtcgaggaccatgtgaaaaactttcgccctcagtgtatcgtgctcaccggcggtcccatgacgcggcccgccctgctggatatcactcacgccttcaccaagaattccgggctgtgcatctgttgcgaggtgttcgtgggtccgcggaaactgtgcgtgaaggagatgaattcaggaatggcaaaaaagcaagcgtggttgatcaagaacaaaatcaaggccttctacgctgcggtcgccgctgattgcttcagagacggggtcagatcgctgttgcaagcctcaggactgggacgcatgaaacctaacaccctcgtcattggctacaagaaaaactggcgcaaggccccgctcaccgaaattgaaaactacgtcggcatcatacatgatgcatttgacttcgaaatcggagtggtgatcgtgcggatcagccaggggttcgacatctcgcaagtgctgcaggtgcaagaagaactggaacgcctggagcaggaaagactcgccctggaagcaactattaaggataacgagtgcgaagaggaaagcggaggtatcaggggactcttcaagaaggcgggaaagctcaacatcaccaagacgactccaaagaaggacggctcaatcaacacgtcacagtccatgcatgtgggagagttcaatcagaagttggtggaggcgtcaactcagtttaagaagaaacaggaaaaaggcactatcgacgtctggtggctgttcgacgacggaggccttactctgctcatcccgtacatccttactctccgcaagaagtggaaggactgtaagctgcgcatctacgttggaggcaaaatcaaccgcatcgaagaagagaagattgtgatggcctcactcctgtcaaaattccggattaagtttgccgatatccacatcattggagacatcaatattcgccctaataaggagtcgtggaaagtgttcgaggaaatgatcgaaccataccggctccacgagagctgtaaggacctcactactgccgaaaagctgaagcgcgaaaccccatggaagatcactgacgctgagctggaagcggtgaaggaaaagtcataccgtcaggtgaggctgaacgaattgctccaagagcacagcagagccgccaacctgatcgtgctgtcgctcccagtggccagaaagggaagcatctcggacctgctgtacatggcatggctggagattctgactaagaacctgccgccggtcctgcttgtccgggggaatcataagaacgtgttgactttttactca

SEQ ID NO: 251135 - DNA, 3297 bp, Artificial Sequence
  Description of Artificial Sequence: Synthetic coding sequence
atgtccctcaacaattccagtaatgtattcctggacagcgtgccatccaacacaaaccgctttcaagtatccgtgatcaacgagaaccacgagtcctcagctgccgctgacgacaatacagatccgcctcactacgaggagacaagtttcggggatgaagcccagaagcgcttgcgcatttccttcaggcccgggaatcaagaatgctacgacaacttcctgcagtctggcgagactgctaagacagacgctagcttccatgcttatgactctcacacaaacacttactacctgcagacattcggtcacaacaccatggatgcggtgcctaagattgagtattacagaaataccggatctatttctgggccaaaggtgaataggccttcccttctcgaaatccacgagcaactggcaaagaacgtggctgtgaccccaagttccgctgaccgagtggccaatggagatggcatccctggcgatgagcaggctgaaaataaggaggacgaccaggcaggcgtagtgaagtttggctgggtgaaaggggtcctggtgagatgcatgctgaatatctggggggtgatgctgttcatccggctctcctggattgttggggaagcaggaattggtctcggcgtcattatcatcggactttctgttgtagtgacgaccctgaccggcatctctatgtcagccatttgcactaatggcgtggtccgcggcggaggcgcatactatctcatttcccggagcctcggccccgagtttgggggtagtatcggtctcatcttcgccttcgcaaacgcggtggccgtcgcaatgtacgtcgttggtttcgccgagaccgtggtggatctgcttaaagagtcagactctatgatggtggatcccaccaacgatattcggattattggaagcatcactgtggtgattctgctgggaatttctgtcgctggaatggaatgggaggcgaaggctcaagtcatcttgctggtaattttgttgatagcaatcgccaatttttttatcggcacggtgattccatccaataacgagaagaagagtcgggggttctttaattaccaggccagcatttttgcggaaaactttgggcctcggttcaccaagggagaaggattttttagcgtgtttgccatctttttccccgcagctaccgggattctggctggggcaaatattagcggggatcttgaggaccctcaagacgccatcccgcggggcacaatgcttgctatcttcatcaccaccgtggcctacctgggcgtggctatttgtgtaggcgcctgcgtggtgagagatgcaaccgggaatatgaacgatacgatcatttcaggtatgaactgcaacggctccgctgcctgtggcctggggtatgatttttcaagatgtcgacatgagccatgccagtatggactgatgaacaacttccaggtcatgagcatggtgtcaggattcggtcccctgatcaccgctggtatattctccgccaccttgtcctcagccctcgcgagccttgtcagtgcccctaaagtattccaggcactgtgtaaggataatatatataaagcgctgcagttttttgccaagggctacggaaagaacaacgagcctctgagagggtatattctgacatttctcattgcaatggccttcattctcattgccgagctgaatacaatagctcctatcatatccaacttctttctggcgagttacgccctgatcaatttcagctgtttccacgcctcatacgccaagtcccctggctggaggccagcctacggcatctacaacatgtgggtaagcctgttcggcgctgtgctgtgctgcgctgtgatgttcgtgatcaattggtgggccgcagtgattacatacgtcatcgagttttttttgtacgtctacgtgacctgtaaaaagccagacgtgaactggggtagctccacacaagctctgagttatgtgtccgctctcgacaatgccctcgagttgaccaccgttgaggaccatgtcaagaattttcggccccaatgtattgtgctcaccggcggacccatgactaggcctgcgttgcttgacatcacccacgctttcactaagaatagtggtctgtgcatctgttgtgaagtatttgtgggtccacggaaactgtgtgtgaaggagatgaattccggcatggcaaagaaacaggcctggctgattaagaataaaataaaggcattttatgctgctgtggcagccgattgctttcgggacggcgtgcgatccctcctgcaggctagcgggctgggcaggatgaaacccaataccctggtgattgggtataagaagaattggcgaaaagctcccctcactgagattgaaaattacgtgggaatcattcacgacgccttcgatttcgagattggagttgttatagtccgaatctcacagggctttgacatcagtcaggtccttcaggttcaggaggagctcgagcggctcgaacaggagaggttggccttggaagctaccattaaagacaatgagtgtgaagaggagtcaggcggtatccgaggccttttcaaaaaggcagggaaactgaacatcactaaaaccactccaaagaaagacggaagcattaacacatcacagagtatgcacgtaggcgaatttaatcagaagctggtggaagcctctacgcagttcaagaagaaacaggagaaagggaccatcgacgtgtggtggctctttgacgacgggggtcttacattgctgattccatacatcctgaccctgagaaaaaaatggaaggactgcaagctgagaatctacgtgggcggcaaaataaaccggattgaagaggaaaagatcgtaatggccagcttgctctccaagtttcgaataaaattcgcagacatacacatcattggagacatcaacattcgaccgaacaaggagagctggaaggtgtttgaagagatgatcgagccttatagactgcatgagtcatgcaaggacctgacgactgccgaaaagctgaagcgcgaaacaccatggaagatcactgatgcagagctggaggccgttaaagagaagtcttatcgacaagttaggctcaatgaattgttgcaggaacatagccgggcggccaatctgatcgtcctttccctgccagtggccaggaaggggtccatctcagacctgctctatatggcatggctggaaatcctcacaaagaatctgccccctgtgctgttggtgaggggaaaccataagaatgttctgactttttattca

SEQ ID NO: 251136 - DNA, 3297 bp, Artificial Sequence
  Description of Artificial Sequence: Synthetic coding sequence
atgtctctaaataacagctccaatgtgtttttggacagcgtcccttccaatactaaccggttccaagtctccgtgattaacgagaatcacgaatcttccgctgctgctgatgataacaccgacccacctcactatgaagagaccagcttcggcgatgaagcacagaagagactgcgaattagttttcggccaggaaaccaagaatgctacgataacttcctgcagtccggggagaccgcaaaaacggacgcttcattccatgcatatgacagccataccaacacgtactacctccaaacctttggccacaacaccatggacgccgtcccaaaaatagaatattaccggaacacaggaagtatcagcggaccgaaagtgaatcgaccctcccttctggagatccatgaacagttggcgaagaacgtagccgtgactccatcctctgccgaccgcgtagctaacggcgatgggattccaggagacgaacaagccgaaaacaaagaggacgatcaagccggagtggttaaatttgggtgggtcaaaggtgtccttgtgcgctgcatgctaaacatatggggcgtaatgctgttcatacgcctgagttggatcgttggagaggcgggaataggactcggcgtgataatcatcggactatctgttgttgttactacccttactgggatctcaatgtccgccatatgtactaacggggtggtgaggggcggaggcgcctactatttaatcagtaggtctctcggcccagagttcggcggaagcatcggattgatcttcgcattcgccaacgcagtcgccgttgctatgtacgtggtgggattcgctgagacggtcgtggacctactgaaagaatccgatagtatgatggtggaccctactaatgacattcgaataatagggagcataacagttgtgattctcctgggcattagtgtggcggggatggaatgggaagccaaggcccaggttatcctcttagtgatccttctcattgctattgctaatttcttcatcggaacggtcatcccatccaataatgaaaagaagagccgcgggtttttcaactatcaggcttctatttttgcagaaaattttggtcccagattcactaaaggtgagggttttttttccgtgtttgctatcttctttccagcagcaaccggtattctcgctggggcaaacatttcaggcgacctggaggatcctcaggacgccattccgaggggcactatgctggcgatatttatcacaacagtggcctatctaggtgttgcaatatgcgtcggagcctgcgtggtgcgtgacgccacagggaatatgaacgatacgattatttccgggatgaactgtaatgggtccgctgcgtgcggtctgggttacgacttttcccggtgtaggcacgagccatgccagtatggactcatgaataatttccaagtgatgagcatggtcagcgggttcggccccctgataaccgccgggattttttcagccaccctgagcagtgctcttgcttccctcgtgtctgctcctaaagtcttccaggccttatgtaaagataatatttacaaggcccttcaatttttcgcaaaaggatatggtaaaaacaacgaaccgttgcggggctatatcctcacgttcctgatcgctatggcatttatactgatcgccgagttaaatacaatagctcccatcatttcaaatttctttctcgcctcttacgcacttattaacttctcttgtttccacgcctcatatgcaaagagtcctgggtggagaccagcatacggtatttacaacatgtgggtgagtctgttcggagcggtgctgtgctgcgccgtgatgttcgtgatcaactggtgggcagccgtaattacctatgtgattgagttctttctttacgtttacgtgacctgcaaaaagccagatgtcaactggggaagcagtacacaggccctttcctacgtaagcgctttggacaacgcccttgagcttaccaccgtggaggatcatgttaaaaattttcggccacagtgtattgtactgactggggggccaatgacaaggcctgcgctgctggatatcacacacgcctttactaaaaacagcgggctctgtatttgctgtgaggtctttgtaggacctagaaagctctgtgtgaaagaaatgaacagtggaatggctaagaaacaggcctggcttataaagaacaagattaaagctttttacgccgccgtggccgctgattgttttcgggatggggtcagatcattgttgcaggcatcaggcctcgggcgcatgaagccaaacacactggtcatcggatataagaaaaactggcggaaagcaccactcacagagatagagaactacgttggaattatccacgatgcatttgatttcgagatcggggtagtgatcgttaggatctctcagggattcgatatttcgcaggtactccaagtgcaagaggaactcgaaaggctcgagcaggaacgactcgctctggaagccaccatcaaagataacgagtgtgaagaagaatcaggtggcattaggggtctgtttaagaaagcaggcaagctgaacatcaccaagaccactccaaagaaggatgggagtatcaacacctcacagtccatgcacgtgggagaatttaaccagaaattggtggaagcctctacacaatttaagaaaaagcaagagaaaggtacgatcgatgtctggtggctgttcgatgacggcgggctgacactgctgattccatacatcctgactcttcggaaaaagtggaaagattgtaagctgaggatttacgtaggagggaagattaacagaattgaggaggaaaaaatcgtcatggccagccttttatctaagttccggatcaaatttgcggatatccacattatcggcgacattaatattcgccccaacaaagaaagttggaaggttttcgaagagatgatcgagccttatcggctccatgaaagttgcaaagacttgacgactgcagagaaactcaaaagggagacgccctggaaaatcactgatgcggagcttgaggccgtcaaggaaaagagctaccggcaggttcgattaaacgagctgctgcaggaacattcgagggcagcaaacttgatcgtcttgtctttgcccgtcgcccggaagggttccatctcagacctcttgtatatggcgtggctcgagatactgaccaaaaacctgccacccgttctgcttgtcagggggaaccacaagaacgtattaacattttactca

SEQ ID NO: 251137 - DNA, 3297 bp, Artificial Sequence
  Description of Artificial Sequence: Synthetic coding sequence
atgtccctgaataactcctcgaatgtgttcttagattcggtgccctctaatacgaaccgattccaagtgtcggtgatcaacgaaaatcatgaaagcagcgcggcagcagatgacaacaccgaccccccccattacgaagagaccagtttcggagatgaggctcaaaagcgcttgcggatctcatttagaccaggtaaccaggagtgttacgataatttcctgcaatctggggagacggctaagaccgacgccagtttccacgcatacgattcgcatacgaacacatattacctccaaaccttcggccacaacacgatggacgccgtgccgaagattgagtattaccgaaataccggctcaatctccggaccaaaggttaacaggccctctctactggagatccacgagcagctggccaagaatgtggctgtgacgccctccagcgctgaccgcgtcgctaatggcgatggcatccccggtgatgaacaggcggagaacaaggaggacgatcaagctggagtggtaaagttcggatgggtgaagggcgtcttagttagatgcatgctcaatatctggggtgtcatgctgttcatccggctgtcgtggattgtgggcgaagccggaattggactcggcgttatcattatcgggctgtccgttgtcgtcacgactttgacaggtatctcgatgtcggcaatatgcacaaatggcgttgtgcgtggcggcggagcgtactacctgatatcgaggagtctcggacccgaatttggtggttccataggtctgatctttgcttttgcaaacgccgttgcggtggccatgtatgtggtcggcttcgctgagaccgtggttgacttattgaaggagagcgattcgatgatggtggatcccacgaacgatatacgtatcattggcagtattaccgttgtcatcctgctggggataagtgtggccggcatggagtgggaggccaaggcccaagtcatcctgctggtgattttgctcatagccattgctaacttcttcattgggacggtgatcccgtccaacaatgagaagaaatcacgaggcttttttaattaccaggcctctatcttcgcggagaattttggcccacgcttcaccaagggcgaggggtttttttctgtgtttgccatttttttccccgcggccactggcatcctggctggtgcaaatatctccggagatctggaggatccccaggatgcaatcccgcggggaacaatgctggctatcttcatcaccacagttgcctatctgggcgtcgccatctgcgtcggtgcatgtgtggtaagagatgcaacaggtaacatgaacgacaccattatcagcggcatgaactgcaacggctccgctgcctgcggactgggctacgatttttctcgttgcaggcatgagccgtgccagtacggcttaatgaataatttccaagtgatgtccatggtctcgggcttcggccccctgatcacagccggaatattcagcgccacgctgagttccgccctcgccagcctggtatcggccccaaaagtgttccaggccttgtgtaaggataatatctacaaagctttgcagttcttcgccaaggggtatggtaagaataatgagcctttgcgcggttacatcctgacgttccttattgctatggccttcatactgattgccgaattgaatactatcgctccaatcattagcaacttcttcctcgcgtcctacgcactgatcaacttctcttgcttccacgcctcttatgctaaatccccgggctggcgccctgcgtacggtatatataatatgtgggtttctctgttcggcgcggtactctgttgcgccgtgatgtttgttatcaactggtgggccgccgttattacctacgtgattgagttttttctttacgtgtacgtcacatgtaagaagcccgatgtgaattggggatcgagtacacaggccttgtcctacgtctctgccctggataatgccttggaattgacaactgtcgaagaccacgtgaaaaacttcagaccccagtgtatcgtccttacaggtggaccgatgacccggcccgcactactggatattacccacgctttcaccaagaatagcggcttgtgcatttgctgcgaggtcttcgtgggccctcgcaagctctgcgtgaaggaaatgaattctggcatggcgaagaagcaagcatggttgatcaagaacaagattaaggccttttatgccgcagtggcagctgattgctttcgagatggagtgcgaagccttttgcaggcgtcaggcttgggccgtatgaagcctaataccctagtcataggctacaagaagaattggcgcaaggcacccttgaccgagatcgagaactacgtgggcatcatacatgacgcgttcgatttcgaaataggcgtcgtcattgtaaggataagccagggattcgatatatcccaggtgctgcaggtgcaggaggagctcgagcgcttggaacaggaacgcttggccttggaagctaccattaaggataacgagtgcgaggaggagagcggcggcatccgaggtctgttcaagaaagcgggcaagctgaacataacgaaaactaccccgaagaaggatggatccataaacactagtcagagcatgcatgtgggcgaattcaaccaaaagctggtggaagcgtcgacacaatttaaaaagaagcaggagaaaggaaccatcgatgtctggtggcttttcgacgatggcggccttacactactgatcccatatatcctgacgttgcggaaaaagtggaaggattgcaaactccgaatatacgtcggaggcaagattaataggatcgaggaagagaagatcgtgatggcatccttactgtccaagttccgaataaagttcgccgacattcatatcataggagacataaacatccgaccgaataaggagagctggaaggtgtttgaggaaatgatcgaaccctaccgattgcacgagagctgcaaggatctcaccacagctgagaagctcaagcgggagactccatggaaaatcaccgatgcggagttggaagccgttaaagagaagtcctataggcaagtgcgtctcaatgagctgctgcaggagcacagccgcgccgctaacctgattgtcctcagtttgccggttgcccgtaaaggaagcataagtgatctgttgtatatggcctggctggagatcctgaccaagaatctgccccccgtgctgctagtgaggggaaatcacaagaatgtgttgaccttctactcc

SEQ ID NO: 251138 - DNA, 3297 bp, Artificial Sequence
  Description of Artificial Sequence: Synthetic coding sequence
atgtcattaaataactcttccaacgtctttctggatagtgtgccctccaatactaaccgatttcaggtgtcagtgatcaatgaaaaccatgaatcttctgccgctgccgatgacaatactgaccctccccactatgaggaaacatcttttggggacgaggctcagaaaaggttgagaatctcttttcggcctggaaaccaagaatgttacgataacttcctccagtctggagagacagccaaaactgatgcaagttttcatgcctatgattcccatactaacacatattatctgcagacatttgggcataatacaatggatgctgtgcccaagatcgaatattatcgcaacacagggtccatatctgggcctaaagtgaatcgccccagtctcctggaaatacatgaacagctcgctaaaaatgtagcggtaacacccagttccgccgacagagtggccaatggagatgggatccccggagacgaacaggccgagaataaagaagatgatcaggctggggtggttaaatttggatgggtaaagggagtcctggtccggtgcatgctaaatatatggggggttatgctctttattcgactgtcgtggatcgttggagaagctggaatagggttaggggtaataattataggactctccgtggtagtgacaactctcactggaatctctatgagtgctatttgcactaacggagtggtacgagggggaggagcgtattatttaataagtagatccctcgggcccgaattcgggggaagtatcggattaatattcgcttttgcaaatgccgtcgctgtggcaatgtatgtggtcgggttcgctgaaacggtcgttgaccttctcaaagaatccgattctatgatggttgatcctactaacgatataaggattataggatctatcacagtggtgattctgctcggaatttcggtggcagggatggaatgggaagctaaagcacaggtcatcctactggtaatccttctgatcgctatagctaacttctttatcggaacagtgattccatccaacaatgaaaagaaatcacggggattcttcaactatcaggcttcaatctttgcagagaatttcgggcctagatttactaagggagaagggtttttctctgtgttcgccatatttttccctgctgcgactggaatcctagctggagccaatatatctggagaccttgaagatcctcaggacgccatccctcgagggactatgctcgcaatattcataacgactgtggcatacctcggagttgcaatctgtgtaggagcatgcgtggtgagagatgccacaggaaatatgaacgatactataatatcagggatgaactgtaacggaagtgctgcatgtgggctcggatatgatttctccaggtgtcgccacgagccatgccagtatgggctgatgaataattttcaggtgatgagtatggtgtcaggattcgggcctctaatcactgccgggatcttcagtgcaacactctcttctgcattggctagtctggtatcagcccctaaagtgttccaggctctctgtaaagataatatatataaagccttgcagttttttgccaaaggatacggaaagaataacgaaccccttcgggggtacatcctcacatttctaatcgctatggcttttatcctcatagcagaattgaacactatcgccccaatcatatccaatttctttctggcttcttacgcgctcataaacttctcctgcttccacgcctcctatgctaaatcgcccggatggcggcctgcctatgggatttataacatgtgggtgtccctatttggagcagtactttgttgcgctgtgatgtttgtcataaattggtgggccgctgtgatcacatatgtgatcgaatttttcttgtacgtctacgtgacttgcaagaaacctgatgtgaactgggggtcaagtacacaggcactatcttatgtgtcagcactcgataatgcacttgaattaactactgttgaagaccacgtgaaaaattttcgaccccagtgcatagtcctaacaggaggaccaatgactcgacccgcgttattagatatcacacacgcctttacaaaaaactctgggttatgcatttgttgtgaagttttcgtcggaccaaggaaattatgcgtcaaagagatgaactccgggatggcaaaaaaacaggcctggctgataaaaaacaaaataaaagccttttatgcagcggttgccgctgattgtttccgtgatggagtaagatcactcttacaggcttcggggctggggcgtatgaaacccaatactcttgtgatcggatacaaaaaaaactggcggaaggctcccctgacagagatcgagaattatgtaggaattatccacgatgcatttgactttgaaataggagtggtgattgttcgtatatctcaggggtttgatatatctcaggtcctccaggtgcaggaagaactcgaacgcctagaacaagagagactggctctggaagccacaatcaaagacaatgaatgcgaagaagaatcaggagggatcagggggctcttcaaaaaggctgggaagctgaacataacaaagactacaccaaaaaaagatgggtccatcaatacatcgcagtcaatgcacgttggagagttcaaccagaaattggtggaagcttcaactcagtttaaaaaaaaacaggaaaaggggactatcgatgtatggtggttgttcgatgatggaggacttacactgctaataccctatatcctcactctccgcaagaaatggaaggattgtaaactccggatctatgtgggagggaaaataaatcgcatagaagaagaaaagatcgtcatggcctccttactctctaaattccgcatcaaattcgcggatatacatattattggggatatcaacattcgcccaaataaggaatcttggaaggtatttgaagaaatgatagaaccctacaggctgcatgaaagttgtaaagatctaacaactgccgaaaaattaaagagggaaacaccttggaaaatcacagatgcggaattggaagctgtcaaagaaaaatcttacaggcaggtgcgacttaatgagctcctccaggaacattcacgggcagccaatctcatagtactgtctttacctgtagcccggaaagggtccatcagtgacctcctctatatggcatggttagagatactcactaaaaatctgccacctgttctgctggtccgcggaaaccataagaatgtcctcacattctattct

SEQ ID NO: 251139 - DNA, 3297 bp, Artificial Sequence
  Description of Artificial Sequence: Synthetic coding sequence
atgtctctgaacaactcatccaacgtgttcctcgattcggtgccctcgaataccaacaggttccaagtcagcgtgattaacgaaaaccatgagagctcagcagcagcggatgacaatactgatccaccccactacgaagaaacctcgttcggagacgaagcccagaaacgcctgagaatcagctttaggcctggaaaccaagaatgctacgacaacttcctgcaatccggagaaacggccaagaccgacgcgagctttcacgcatacgattcccacaccaacacctactacctgcagactttcgggcataacacgatggacgccgtgcctaagatcgaatactacagaaataccgggagcatctcagggccgaaggtgaatagaccctccctgctggaaatccacgagcagttggctaaaaacgtggccgtcacgccgtcatctgccgacagggtcgccaacggagacggtatccctggagacgaacaggccgagaataaggaggacgaccaggccggagtggtgaaattcggctgggtgaagggagtgctggtgcggtgtatgctcaacatctggggagtgatgctctttatccggctctcgtggatcgtgggggaagctggaatcggactgggcgtcatcatcatcggactctcggtggttgtgaccactctgaccggcatttcgatgagcgccatctgtactaacggagtggttcgcggagggggcgcttactacctcatctcgagatccctcggcccagaattcggaggatcgatcggactgatctttgcctttgccaatgccgtggcagtggccatgtacgtcgtggggttcgctgaaactgtggtggacctgctgaaggaaagcgattccatgatggtggacccgactaatgacatcaggatcatcggatcaatcactgtcgtgatcctgctcggcatctcggtcgccggcatggaatgggaggcgaaggcccaagttattctgctggtgatcctcttgattgccatcgcgaacttcttcatcgggactgtgatcccaagcaataacgaaaagaagtcgaggggcttctttaactaccaggcttcaatctttgcggagaacttcggccctcgcttcaccaagggagagggattctttagcgtctttgctatcttcttccccgctgcgactggcatcctcgccggagcgaacattagtggcgatcttgaagatccacaggacgcaataccacgcggcaccatgcttgctatcttcatcaccacggtcgcgtacctgggcgtggccatctgcgtgggagcctgtgtggtgcgggacgcgaccggaaacatgaatgatactataatctcgggtatgaattgtaatgggtccgccgcatgtggactgggatacgatttcagccgctgtcgccacgagccctgccagtacggtctgatgaacaatttccaagtgatgtcgatggtgtcgggcttcggtccgttgatcaccgccggaatcttttcggctaccctttcttccgccctcgcgtcactggtcagcgctccgaaggtctttcaagcactttgcaaggataacatttacaaagccctgcagtttttcgccaagggatacggaaagaataacgaaccactgcggggctatatactgaccttcctgatcgctatggctttcattcttatcgctgaactgaatacgatcgcccctatcatttccaactttttccttgcctcgtacgccctgatcaacttctcatgtttccatgcatcctacgccaaaagcccggggtggcgaccagcttacgggatctacaatatgtgggtcagtctgttcggtgctgtgctgtgttgcgcagtcatgttcgtgatcaattggtgggccgccgtgatcacttacgtgatcgagtttttcctgtacgtgtacgttacttgcaagaagccagacgtgaactggggttcgtcaactcaggccctgagctacgtcagcgctctcgacaatgccctggaactgacgaccgtggaggatcatgtgaagaattttcggcctcagtgcatcgtcctgaccggaggcccgatgacccggcctgcacttctggacattactcatgcgttcactaagaacagcggactgtgtatctgctgcgaagtgttcgtcggcccgagaaagctctgcgtcaaggaaatgaattccggaatggccaaaaagcaggcgtggctgatcaagaacaagatcaaggcattctacgccgcggtggcagcagattgcttccgcgacggtgtcagatcactgctccaggcctcaggactcggaagaatgaagccgaacaccctcgtgatcggctacaagaagaactggcgcaaagccccactcaccgagatagagaactacgtggggatcatccatgatgcattcgacttcgaaatcggtgtggtgatcgtgagaatctctcaaggctttgatatctcccaggtcctgcaagtgcaggaagaactcgaacgcttggagcaagaaagactggctcttgaggccactatcaaagataatgagtgcgaggaggaatcaggaggaatccggggcctcttcaaaaaggcaggaaagctgaatatcaccaagactaccccaaagaaggatggaagcattaacacctcgcagtccatgcatgtgggagaattcaaccaaaaactggtcgaagcctcgacccagttcaagaagaagcaggagaagggaactatcgacgtgtggtggctcttcgacgacggcgggctcactctcctgataccctacatccttaccctgaggaaaaagtggaaggactgtaagctgagaatctacgtgggcggcaaaatcaaccggatcgaagaggagaaaatcgtgatggcatcactgttgtccaagttccggatcaagttcgcggacatccacatcatcggcgatatcaatattcggccgaacaaggaatcgtggaaggtgtttgaagaaatgatcgagccctaccgcctccacgagtcctgcaaggatctgaccactgcagaaaagctgaaacgcgagactccgtggaagatcaccgacgccgaactggaggccgtgaaggaaaaatcctaccgccaggtccgccttaacgaactgctgcaggagcattcgcgcgccgcaaatctcatcgtgctctcgctcccggtggcgcgcaagggatcaatttcggatctgctctacatggcgtggctcgagatcctgaccaagaacctcccgccagtcctgctggtccgcggaaaccacaagaacgtgctgactttctactca

SEQ ID NO: 251140 - DNA, 3297 bp, Artificial Sequence
  Description of Artificial Sequence: Synthetic coding sequence
atgtccctgaacaactcgagcaacgtgtttttggactctgtcccctccaatactaatcgctttcaggtgtcggtgataaatgagaatcatgaatcatcagcggccgccgacgataatactgatcctccgcattacgaagagacttcgttcggcgatgaggcccagaaacggctgaggatttcgtttcgcccgggaaatcaggagtgttacgacaacttcctgcagagcggggaaaccgcgaaaaccgatgcatcttttcacgcgtacgactcccacactaacacctactacctccaaacttttggacacaacactatggacgcagtaccgaagatcgaatactatcggaataccggcagcatcagcggccctaaggtgaaccgtccatcgctcttggaaattcatgaacaattggccaagaatgtggcggttacgccttcgtcagccgatcgcgtggctaacggtgacggaatccctggagacgaacaagctgagaataaagaagatgatcaagccggggtggtgaaatttggatgggtgaagggagtgctcgtgaggtgcatgttgaatatctggggagtcatgttgttcattcgcttgtcctggatcgtgggcgaagccggaatcggacttggtgtcatcatcatcggactgtccgtcgtggtgactactctgactggaatttccatgagcgcaatctgtactaacggagtggtgcgcggaggcggagcgtactacctcatctcccgctccctgggaccggaatttggtggatccatcggactgattttcgcgttcgctaacgccgtggcagtggccatgtacgtggtgggattcgccgaaactgtggtggaccttcttaaagagtcggacagcatgatggtcgacccgaccaatgacatcagaatcatcggtagcatcaccgtggtgatcctgctgggaatctcggtggccggcatggagtgggaggccaaggctcaggtgattctcctggtcattctgctgatcgctatcgctaacttctttatcgggaccgtgatcccgagcaacaacgaaaagaaatcacggggctttttcaattaccaggcttcgattttcgcagagaactttggtccgcggttcaccaagggcgagggattcttcagcgtgttcgctatctttttcccggcggcaaccggaatcctggccggagcaaatatctcgggagatctggaagatccgcaggacgccatcccgagaggaaccatgcttgcaatcttcatcactactgtcgcatacctcggagttgccatctgcgtgggagcatgcgtggtccgagacgccacgggaaacatgaatgacactatcatctcagggatgaattgcaacggatcagccgcatgcggactgggatacgatttttcgagatgtcgccacgaaccatgccagtacggactgatgaacaatttccaggtgatgtcgatggtatcaggattcggaccactcatcactgctggaatcttctcagcaactctctcgtcagcactggcctccctggtgtcagccccgaaagtctttcaggcgctgtgcaaggataacatctacaaggctctccagtttttcgcaaagggatacggaaagaacaatgaaccgctccgggggtacatcctgactttcttgatcgccatggcctttattctgatcgctgagctgaatacgattgcacctatcatctccaatttcttcctcgcgtcctacgccctcatcaatttctcctgtttccatgcttcatacgctaagtctccaggatggcggcccgcctatggcatttacaacatgtgggtgtccctgtttggagccgtgctgtgctgtgccgtcatgttcgtcattaactggtgggcggctgtgatcacctacgtcatagaattctttctgtatgtctacgtcacttgcaagaaaccggacgtgaattggggctcatcgacgcaagcgctctcgtacgtcagcgccctggataacgcccttgagctgactaccgtggaagatcatgtcaaaaactttagaccgcagtgcatcgtcctgaccggcgggccgatgacccgcccggcgctgctcgatatcactcacgccttcaccaagaattcgggactctgtatctgctgcgaagtctttgtgggcccgagaaagttgtgtgtgaaggaaatgaattccggaatggccaagaagcaggcctggctcatcaagaataagattaaagcgttctatgcggcggtggcggctgattgtttccgcgatggcgtgcggagcctgctccaagcctccggactgggcaggatgaagcctaacacgttggtgatcggttacaagaaaaactggcggaaggccccgcttactgagatcgagaactacgtgggaattatccatgatgcattcgacttcgaaatcggagtggtgattgtcaggatctctcaaggcttcgatatcagccaggtgcttcaggtccaggaagagctcgagaggctggaacaagaacggctggctttggaagcgactatcaaagataatgaatgtgaggaagagtctggaggaatcagaggtctgtttaagaaggctggaaaactgaatatcaccaaaaccacccctaagaaggatgggtcaatcaacacgtcgcaaagcatgcacgtgggcgaattcaaccagaagctggtggaagcgagcacccaattcaagaaaaagcaagaaaaaggaaccatcgatgtgtggtggctgttcgacgacggtggattgactctcctgatcccgtacatattgaccttgagaaagaaatggaaggactgtaagctcagaatctacgtcggaggaaaaatcaacagaatcgaagaggagaagatcgtgatggccagcctgctgtccaagttccgcatcaagttcgcggatattcatatcatcggggacatcaacattcggccaaacaaggaaagctggaaagtgttcgaggagatgatcgagccatacaggctgcacgaatcgtgtaaggatctgaccaccgccgagaagctcaagcgggaaactccatggaagatcaccgacgcagaactcgaagcagtgaaagagaagtcctacagacaggtgcgcctgaacgaactgctgcaggaacattcccgcgccgcaaacctcatcgtgctgtcgctcccagtggcgaggaagggaagcatcagcgacctcctctatatggcctggttggagattctgaccaagaacctgcccccggtcttgctggtccggggaaatcacaaaaatgtcctgactttttactct

SEQ ID NO: 251141 - DNA, 3297 bp, Artificial Sequence
  Description of Artificial Sequence: Synthetic coding sequence
atgagcttgaacaactcaagcaatgtgtttctcgactccgtgcctagcaacactaacaggtttcaggtgagcgttatcaacgagaatcatgaatcttcggccgctgcggatgacaacacagatcctccccattatgaagaaaccagtttcggagatgaggcccagaaacgcctgcgcatctctttccgcccgggaaatcaggaatgttatgacaactttctgcaatctggtgagacggctaaaactgatgcttcctttcacgcctatgattctcacactaatacgtattacttacagacattcggtcacaacacaatggatgccgttcccaagatcgaatattacaggaataccgggagtatctcaggccccaaggtgaaccggccctccctcttggagatccatgagcaactggccaaaaatgtggccgtgacgccttccagtgcagacagagtggctaacggagatggcatccccggcgatgagcaggccgaaaataaagaggacgatcaggcaggcgtggtcaagttcgggtgggtcaagggggtcctggtccgctgcatgctgaacatatggggcgtgatgctgtttatccggctctcttggattgttggcgaagctggcatcggactgggggtcataatcattggtctgtctgtagtggtaaccaccctgacaggcatctccatgtcagcaatctgtaccaatggtgtggttagaggaggcggagcctactacctgatcagtcgatccctaggcccggagtttgggggaagcattgggctgatttttgcctttgccaacgcagtggcagtggccatgtacgttgtgggtttcgccgaaactgtcgtggacctactcaaggagagtgattctatgatggtggatccgaccaacgacattcggatcattggctcaattacagttgtcatccttctcgggatctccgtggcggggatggagtgggaggccaaagcccaggtgattcttcttgtgattctcctgatcgctattgccaatttcttcatcggtaccgtgatcccttctaacaacgagaagaagtcgcgaggtttctttaactaccaggcaagcatctttgccgagaactttgggccacggttcacgaaaggtgaaggtttcttcagtgtcttcgcgatcttctttcctgctgcaactgggatactggccggcgcgaatatttcaggggatctcgaggatcctcaggacgcaatcccaaggggaacaatgctggcaatctttataactaccgtcgcctacttgggcgttgctatctgtgtaggcgcctgcgtcgtccgcgatgcaaccggcaatatgaacgacaccatcatttccggtatgaattgtaatggaagtgcagcctgcggtttgggatacgatttctctaggtgccggcatgaaccatgccaatacggactgatgaataacttccaagtgatgtctatggtcagtggcttcggccctctgataacggctggaatcttcagcgcaacgttgtccagcgctcttgcctcacttgtgtctgcgccaaaggtctttcaggcgctgtgcaaggacaacatttataaagcattacaattcttcgctaaggggtatggtaagaacaacgaaccccttcgcggctatatcctaaccttccttatagcaatggccttcatcctgattgccgagctcaataccatagctccaataattagtaacttttttctggccagctacgccctgataaactttagttgctttcacgcctcctacgcgaagtcccctggatggagaccagcttacgggatctacaacatgtgggtgagcctgttcggcgccgtgctgtgttgtgctgtcatgttcgttattaactggtgggccgctgtgatcacctatgtgatcgaatttttcctgtatgtgtacgttacttgtaagaaacctgacgtcaactgggggagcagtacacaggctctcagctatgtgtccgctctggacaacgccctggagctgactaccgttgaggatcatgtgaagaacttccgcccgcagtgcatagtgctaactggtggcccaatgactagaccggcgctgttggacatcacgcacgctttcacaaaaaacagcgggttgtgcatatgctgcgaggtttttgtcggtccacgtaaactgtgtgtaaaagagatgaattccgggatggctaaaaagcaggcatggctgattaaaaataagatcaaggcattctatgccgccgtggccgctgactgcttccgcgacggggtgcggtcattgttacaggcctcaggtctcggcaggatgaagccgaataccctggtgatcgggtacaaaaagaactggaggaaagctcctttgacagaaatcgagaactatgtcggcatcatccacgacgcgttcgacttcgagatcggggtggtgattgtcaggatcagccagggctttgatatcagccaagtccttcaggtgcaggaagagctggagaggctggaacaggaaagactagcccttgaggccaccatcaaagacaacgagtgtgaggaggagtccggcgggatccgcggactttttaagaaggcagggaaattgaacattactaagacaacccctaagaaggatggaagtatcaacaccagccagtctatgcatgtgggagaatttaatcaaaagctggtcgaggccagcacccagttcaaaaagaagcaggaaaaagggacaattgatgtctggtggctgtttgatgacggtgggctgacactgctgatcccatacatcctgacactaagaaagaagtggaaggattgcaagctgcggatctatgttggtgggaagatcaaccgcatcgaagaggaaaagatcgtcatggcaagtttgctttcgaaattccggattaagtttgcagacatacacatcattggtgacatcaacatcaggccaaataaggagtcttggaaagtctttgaggaaatgattgagccctaccgactgcacgagtcctgtaaggacctgaccacggctgaaaaactgaagcgcgaaaccccctggaagattacggacgcggaacttgaagccgtgaaagaaaaaagctaccggcaggtccgcttaaacgaactgttgcaagaacactctagggcagcaaatctaattgtcctttcactgccagtggccaggaagggttctatcagtgatctgctttatatggcatggctcgaaatactgactaaaaatttgcctcctgtgttgctcgtgcggggtaatcacaagaacgtgctgacgttttatagc

SEQ ID NO: 251142 - DNA, 3297 bp, Artificial Sequence; identical to SEQ ID NO: 251087
  Description of Artificial Sequence: Synthetic coding sequence

SEQ ID NO: 251143 - DNA, 3297 bp, Artificial Sequence
  Description of Artificial Sequence: Synthetic coding sequence
atgagcttgaataactcatcgaatgtgtttctggactcagtgccgtcaaataccaatcggttccaagtctctgtaatcaatgaaaatcacgaatcaagcgccgccgcagatgacaatactgatccgccacactacgaggagacgtcattcggagatgaggcccaaaagcgcttgcgcatctcgtttagacccggcaaccaggagtgctacgacaacttcctgcaatcgggtgaaaccgctaagacggacgcgtcgttccacgcctacgattcccataccaacacctactatctgcagacttttgggcacaatactatggatgcagtgccgaaaatcgaatactaccgcaatactggatccatcagcggcccaaaggttaaccggccatcgctgctcgagatccatgaacaacttgcgaagaacgtggctgtgaccccgagctcggccgacagagtggctaacggagacggaatccccggtgacgagcaggccgagaacaaagaggacgaccaggctggagttgtcaaattcggatgggtgaagggagtcctggtgagatgcatgctgaacatctggggggtgatgctcttcatccggctgtcgtggatcgtcggagaagccgggatcggcctcggagtgatcatcatcggcttgtcggtggtggtgaccactttgaccggaatctccatgtcagccatctgtactaacggagtggtgcgcgggggcggagcctactacctgatctcgcggtcgctgggacctgaattcggcggaagcattggactgatcttcgcgttcgcgaatgcggtagccgtcgctatgtacgtcgtcggcttcgccgaaaccgtggtggacctgctcaaggagtccgactcaatgatggtggatcctaccaatgacatacgtatcataggatctatcaccgtcgtcattctgctgggaatcagcgtcgctggcatggaatgggaggccaaagcccaagtgatccttctggtgattctccttatcgcgatcgctaatttctttattggcaccgtcatcccaagcaacaatgaaaagaagtcacggggcttcttcaactaccaggcctctattttcgcggagaacttcgggcctcggtttactaaaggagaaggtttcttcagcgtgttcgcaatattctttccagcggctactggaattctggccggtgccaacatttccggcgacctcgaggatccgcaagatgcgatcccaagagggaccatgctggcaatcttcatcaccactgtggcctatctcggcgtggcgatctgcgtgggggcgtgtgtggtcagggacgctaccggaaacatgaacgacactattatctccggaatgaattgtaacggctccgcggcctgcggactcggatacgatttctcacgctgccgccacgaaccttgccaatatggactgatgaacaatttccaggttatgtcgatggtttcgggatttggtcctctgattactgccggaatattctcagcaacgttgtcatccgccctggcttccctggtgtcagcaccaaaggtgtttcaagcgctgtgtaaggacaatatctacaaagcactgcagttttttgccaagggctacggaaaaaacaacgaacccctccggggttacatcctcactttcctgatcgccatggcattcatcctcattgcagaacttaacaccatcgctccaatcatctccaacttctttctcgcatcgtacgcccttatcaacttttcctgcttccacgcctcttatgcgaagagcccaggctggcggccggcttacggaatttacaacatgtgggtgagcctgtttggagccgtcctctgttgcgcggttatgttcgtgatcaactggtgggcagcagtgatcacttacgtgatcgaattctttctgtacgtctacgtgacgtgcaagaaacctgatgtgaattggggaagctctacgcaagctcttagctacgtctcagctctcgataatgctctggaattgacgactgtcgaggatcacgtgaagaatttcagaccgcaatgcattgtgctgactgggggaccaatgacccggccggcactgctggacattactcacgcattcaccaagaactctggactctgcatctgctgcgaagtattcgtcggtcctagaaaactctgcgttaaggagatgaattcaggaatggcgaagaagcaagcgtggctgatcaaaaacaagataaaagccttctacgcggccgtcgcagcggattgcttcagagacggagtgcgctcgctcctccaggcctcgggcctgggacggatgaaaccaaacaccctggtgatcggatacaagaagaactggagaaaggcgccgctcactgagatcgaaaactacgtgggcatcatccacgacgccttcgacttcgaaatcggagtcgtgattgtgcgcatttcgcaaggattcgatatctcgcaggtgttgcaggttcaggaagagttggaaagattggagcaggaacggctggccctcgaggcaaccatcaaagataatgaatgcgaggaagaatccgggggaatacgcggtctgttcaagaaagccggcaaactcaacatcaccaagaccacgccgaagaaggacggatcgatcaatacttcccagagcatgcacgtcggagagtttaaccagaaactggtggaggcctcgactcagttcaagaagaagcaagaaaaggggaccatcgacgtgtggtggctcttcgacgacggcggactgactctgctgatcccgtacatcttgactctgaggaagaaatggaaggactgcaagctgcgcatctacgtgggcggaaagatcaaccgcatcgaagaggagaaaatcgtgatggcttcccttctctcgaaatttcgcatcaaatttgcggacatccacatcatcggagatatcaacatacgacctaacaaggagagctggaaagtgttcgaggaaatgatcgaaccatacaggctgcatgagtcgtgtaaagacttgaccaccgccgaaaaactgaaacgcgaaactccgtggaagatcacggatgccgagctggaggcggtcaaggaaaagtcataccggcaggtcaggctgaatgagctgctccaggaacactcccgcgccgcgaaccttatcgttctttcccttccggtggcacggaagggatcgatctcggatctgctttacatggcctggctggaaatcctgactaagaatcttccgccggtgctcttggtccgcggaaaccataagaacgtgctcaccttctactcc

SEQ ID NO: 251144 - DNA, 3297 bp, Artificial Sequence
  Description of Artificial Sequence: Synthetic coding sequence
atgtccttgaataactcgtccaacgttttcctcgattcagtcccatccaatactaatagattccaagtctccgtcatcaatgagaaccacgaaagttcggcggccgctgacgacaacactgacccaccgcactacgaagaaacttcgtttggagacgaggcgcaaaagagactgcggatctcattccggccggggaaccaggagtgctacgataacttccttcagtccggagaaaccgcaaaaactgacgcgagctttcatgcgtacgactcgcataccaatacctactacctgcaaactttcggacataacactatggacgccgtgcctaagatcgagtattatcgaaacacgggaagcattagcgggccgaaagtgaatcgccccagcctgctcgaaatccatgaacagctcgcaaagaacgtcgcagtgaccccttcatccgccgatcgcgtggcgaacggagacggaatcccaggcgacgaacaggcggagaacaaggaagatgaccaagccggcgtggtcaaatttgggtgggtgaaaggagtgctcgtgaggtgcatgctcaacatctggggagtgatgttgtttatccgcctgtcgtggatcgttggcgaagccggaatcggtctgggggtcatcattatcggactgtcggtcgtggtgactaccctgaccggcatttcgatgtccgcgatctgcaccaatggagtggtgcggggaggcggagcttactaccttatctccagatccctcggcccggaattcggcggtagcatcggcctgatcttcgccttcgctaacgccgtcgccgtggcgatgtacgtggtgggattcgccgaaaccgtggtcgacctgcttaaggagtcggatagcatgatggttgacccgaccaatgatatccgcatcatcggaagcattacggtggtgatccttttgggtatcagcgtggcgggtatggagtgggaggctaaggcccaagtcattttgctcgtgatcctgctgatcgctattgctaacttcttcatcgggaccgtcattccgagcaataacgaaaagaagtcacgtggattcttcaactaccaggcttcgatattcgcggaaaactttggccctaggtttactaaaggagaaggattcttctcagtatttgccatcttttttccagccgccactggaatcctggcgggtgccaacatctcgggagatctcgaggacccacaagatgccatccctcgggggaccatgctggctatcttcatcaccaccgtcgcgtacttgggagtcgctatctgcgtgggagcctgcgtggttcgggacgctactggcaacatgaacgacaccataatctcaggcatgaactgcaacggctcggcagcttgcggactgggatatgacttctcaagatgccggcacgaaccctgccaatacgggctgatgaataacttccaggtgatgtcaatggtgtccggcttcggaccgcttatcactgcgggaattttctcggcaactctgtcgtcggccctcgcctccctggtgtcggcccctaaagtgtttcaggcgttgtgcaaggataacatctacaaagcactgcagttcttcgccaaaggatacggtaagaacaatgaaccactgcggggctacatcctcaccttcctcatcgcaatggccttcatcctgatcgctgaattgaacacgatcgcgccgatcatctcaaacttcttcctggcatcctacgctttgatcaatttctcgtgctttcacgcctcctacgcgaagagccccggatggcggccggcgtacggaatatacaacatgtgggtgtcactcttcggggccgtcctctgttgcgcagtgatgtttgtcattaactggtgggcagccgttattacctatgtgatcgaattctttctgtacgtctacgtcacttgcaagaagccagatgtcaactggggtagctccactcaggctctgtcctacgtgagcgcactcgacaatgccttggaacttactaccgtggaggatcacgtaaagaacttcaggccgcaatgtattgtgctgacgggcgggccaatgaccaggccagctctgctcgacatcactcacgccttcaccaagaattcgggattgtgcatatgttgtgaagtttttgtcggcccgcgcaaactttgtgtcaaggaaatgaacagcggaatggccaagaagcaggcgtggctcatcaagaataagatcaaggctttttacgccgctgtcgccgctgactgtttcagagacggggtgagaagcctgttgcaggcgtctgggctcggcaggatgaagccgaacaccctggtgattggctacaagaaaaactggcgcaaggcacctctcaccgagatcgagaactacgtgggcatcatacatgacgcgttcgacttcgaaataggagtggttatcgtgcggatcagccagggcttcgacatttctcaagtgctgcaggttcaggaagaactcgaaagattggagcaggagcgcctggcgctggaggccacgatcaaagacaatgagtgtgaggaagagtccggaggaatccgcggtcttttcaaaaaggcaggaaagctcaatatcactaagactacccccaagaaggacggatcaatcaacacctcgcagtcgatgcacgtcggagagtttaaccagaaactggttgaagccagcacgcaattcaaaaagaagcaagagaaagggactatcgatgtgtggtggctgtttgacgatggtggcctgaccctgcttattccctatatcctcaccttgcgcaaaaagtggaaagattgtaaattgagaatttacgttggaggaaagatcaaccggatcgaggaagagaagatcgtcatggcaagcctcctgtccaagttccgtatcaaatttgcagatatccacattattggagacattaacattcggccgaacaaggagagctggaaggtgttcgaggaaatgattgagccctacaggctgcacgaaagctgcaaggatctgaccaccgcagagaagttgaagcgcgaaacgccttggaagatcaccgatgcggagctggaagctgtcaaagagaagtcataccgccaggtgcgcctgaatgagctcctccaagagcactcccgggccgccaacctgatcgtgctctccctcccggtggctcgtaaaggatcgatctccgatctgctgtacatggcgtggctcgaaattctcactaaaaacttgccgccggtgctgctggtacggggaaaccataagaatgtgctgaccttctactcc

SEQ ID NO: 251145 - DNA, 3297 bp, Artificial Sequence
  Description of Artificial Sequence: Synthetic coding sequence
atgtctcttaacaatagtagtaacgtcttccttgactccgtgccgtctaacaccaatcggtttcaagtgtccgttatcaacgagaaccacgaaagtagcgctgccgcagacgacaacaccgatcctccccactacgaggagactagctttggcgacgaggctcagaaacggctacggatttcttttcgtccaggaaatcaggagtgctatgataattttctgcagtccggcgaaaccgctaagaccgacgctagttttcacgcctatgattcccacactaatacttattatctgcagacatttgggcataacacgatggatgccgtcccaaaaattgagtattatcgcaacactggatcaattagcggtcccaaggtaaatcgtcccagtctcctcgaaatccacgagcagctggccaaaaatgtggcggtgacaccaagtagtgccgacagggtggcgaatggggatgggatccctggtgacgaacaggccgagaataaagaggacgaccaggctggggtggtgaagttcggctgggtaaagggggttctggtgagatgcatgctgaacatctggggagtcatgctcttcattcggctgtcatggattgttggcgaagcaggcatcgggctgggtgtgattatcattggattgtctgtggtcgtgaccactctgacaggcatctccatgtcagcaatctgcaccaatggggtggtaaggggagggggtgcctattacctgatcagcagatccctaggacctgagtttggtggttctattggcctgatcttcgcttttgccaatgctgtcgcagtagcgatgtatgtggtgggtttcgctgaaacagtggtggatttactcaaagagagcgactctatgatggtagaccccaccaatgacataaggatcatcggctctataaccgtggtgattctgcttggcatcagcgtcgctggcatggagtgggaggctaaggcccaggtgattctgctggtgatcctcttgattgcaatagccaattttttcattggaactgtgattccttccaacaatgagaaaaagtctcgaggctttttcaattaccaggccagcattttcgccgagaatttcgggcccagatttaccaagggcgagggattcttcagtgtatttgctattttcttcccggctgccacgggcattctggccggcgccaatatttcaggtgatctagaggatccccaggacgctataccgcgggggaccatgctcgccattttcattaccacagttgcctacctgggcgtggcgatctgtgtgggcgcgtgcgtagtgcgagatgccaccgggaacatgaacgataccatcatctcaggcatgaactgtaacggctctgcggcctgcggtctggggtatgattttagtagatgcaggcacgagccatgtcagtacggactgatgaacaatttccaggtgatgtctatggtgagtggcttcggccccttgataactgcgggaatattcagtgcaacactatcttccgcactggctagcctggtcagcgccccgaaagtgttccaggccctttgtaaagacaatatctacaaggcattgcagttcttcgctaagggatatggaaaaaataatgagcccctccgtggttatatcctcacattcctgatcgccatggcattcattttgatcgccgagctgaacactatcgccccaataatctcaaactttttccttgcaagctacgccttaatcaatttttcctgtttccacgcttcctatgctaaaagtccagggtggagacccgcctatggtatctacaatatgtgggtctctctcttcggagccgtgctgtgttgtgcagtaatgttcgtcatcaattggtgggccgctgtcatcacctatgtaattgagttcttcctgtatgtgtacgtcacatgtaagaaacccgacgtaaattggggcagctccacacaggccctaagctatgtcagcgccctggacaacgctcttgagctgaccaccgttgaagatcacgtgaaaaatttcaggccacaatgcatcgtgctgaccgggggacctatgacccggccggcccttctggatattacacacgcatttaccaagaactctgggttatgcatatgctgcgaggttttcgtggggcctcgcaaactttgtgtgaaggagatgaacagcggcatggccaagaagcaggcctggttaatcaaaaataagataaaagccttttatgcagccgtggctgcagactgctttagagatggtgttaggagcttattgcaggccagcgggctgggtcggatgaagccaaacaccctggttattggttataagaagaactggaggaaggcgcctcttactgaaatagaaaactatgttggaattattcatgatgctttcgacttcgagattggagtggtaatcgttagaatcagtcaaggatttgacatttctcaagtgctgcaggtgcaggaggaattggaacggctggaacaggagcgcctggccttggaggctacgattaaggacaacgagtgcgaagaagagagtggcggtattcgggggctctttaagaaggcagggaaactgaatatcaccaagaccacacccaaaaaagatggctctataaatacttcacagtccatgcacgtgggagaattcaaccagaaattggttgaggcctccacccagttcaaaaaaaagcaggaaaagggcactatagacgtgtggtggctgtttgatgacggtgggctcactttactgattccctacatcttgactttaaggaagaaatggaaggactgcaaactgaggatatatgtcggcggtaagatcaaccgcattgaggaggagaagatcgtgatggcatccctgttgtccaaattccgcattaaatttgcagatatccatataatcggcgatattaatattcggcctaataaggaatcttggaaagtcttcgaggaaatgatcgagccttatcgacttcacgaatcgtgcaaggatctgaccactgccgagaaactgaagagagagacaccctggaaaattacagatgccgagctggaagctgtcaaggagaagtcttatagacaggtgcgtctgaacgaactcttgcaggaacatagccgtgccgccaacttgatagtactgtctctgcctgtagcccgcaagggctctatctcagatctgttatacatggcctggctggagatactcactaaaaatcttccccctgtattgcttgtgcgcggaaatcacaaaaacgtgctcactttctactca

SEQ ID NO: 251146 - DNA, 3297 bp, Artificial Sequence
  Description of Artificial Sequence: Synthetic coding sequence
atgtcactgaataacagctctaatgtgttcctggacagtgtgccctcaaacacaaaccggttccaggtatctgtgatcaacgagaatcatgaaagttccgcggccgccgacgacaacaccgaccctccccattatgaggagacaagtttcggtgatgaagcccaaaaacggcttagaatctcgttccgtccaggaaaccaggaatgttatgacaattttctccagtccggagaaacggccaaaaccgacgcaagtttccacgcctatgactcccacaccaatacttactaccttcagacctttggccataacacaatggacgcggtcccaaagatagaatattatcgtaacaccggatccatctccggtccaaaggtgaatcggccttcacttctcgagatacacgagcagctcgctaaaaatgtggccgttacgccctccagcgccgatcgagtggcaaacggtgacgggatcccaggggatgagcaggctgaaaacaaagaagatgaccaggcaggggtggttaagttcgggtgggtcaagggagtgctcgttcgctgtatgctgaatatctggggggtcatgctctttatccgcctgagctggatagtgggagaagcgggtataggtcttggggtgatcattatcggtctgtctgtcgtggttactactcttacaggtatttctatgtctgccatttgtactaacggcgtggtgagaggcggcggggcatattacctgatttccagaagtctggggcctgagttcgggggatccatcggccttatcttcgcgtttgccaacgcggtggctgttgccatgtacgtcgttggatttgccgaaacagtcgttgatttgctgaaggaaagcgactccatgatggtggaccccacgaacgatattcgtataatagggtcaatcacggtggttattctgcttggaatttctgtcgctggcatggagtgggaggccaaagctcaggttatcctgctcgtgatactgttgatcgccattgccaacttttttatcgggacagtgatcccctctaacaatgaaaaaaagagtcgggggttcttcaactatcaagccagcatctttgccgagaacttcggaccaaggttcaccaaaggtgagggcttcttttccgtcttcgccatcttttttcctgccgccacaggaattctcgctggcgcgaacatcagtggagacttggaggatccgcaggacgctatccctaggggtacaatgcttgccatattcattacaaccgtcgcctacctgggcgttgcgatctgcgtaggggcatgcgtggtgcgagatgccactggtaatatgaacgacaccattatttccggcatgaattgcaacggaagtgcagcgtgtggtttggggtacgatttcagcagatgtagacatgagccctgccagtatggtcttatgaacaatttccaagtgatgtccatggttagcggattcggcccactgattaccgccggaattttcagcgccacgttatcgtcagctctcgctagcttggtctctgcccccaaagtctttcaagccctatgtaaagacaacatctacaaggctcttcagtttttcgcgaagggatacggcaaaaacaatgagccgctgagagggtatatactcacttttctaatcgccatggcgttcatcttgattgctgagttaaatacgatcgcgccgataatcagcaactttttcctggcctcatatgccctcataaattttagctgctttcatgctagctacgcaaagagtcccggttggcgccctgcctacggcatctataatatgtgggtgtccctgtttggggccgttctctgctgcgcagtgatgtttgttattaactggtgggctgcggtgatcacgtatgtcatcgagttttttctgtacgtctatgtgacctgcaagaaacccgatgtgaactggggctcgtccacgcaggcgctgtcgtacgtgtctgccctagacaatgctcttgaattgactactgttgaggaccatgtgaaaaactttagaccacagtgcattgtcctgactgggggcccgatgactcgccccgctctgctggatattactcacgcattcaccaagaattccgggctctgcatttgttgcgaggtttttgttggtcccagaaaactgtgtgtgaaagaaatgaactcagggatggccaagaagcaagcctggttgataaaaaataaaattaaggctttctacgccgccgtcgccgctgattgcttcagggatggcgtccgtagtcttctgcaggcgtccggccttggccggatgaagcctaacaccttagtcatcggctataagaaaaattggaggaaagcccccctgacagagatagaaaactacgtgggaatcattcacgacgcttttgacttcgagattggagttgtaattgtccgcattagccagggtttcgacatctcgcaggtactgcaggtgcaggaagagcttgagcgtctggaacaggagaggctcgccctagaggctaccattaaagacaacgagtgcgaagaggagtcgggaggcattcgcggcctgttcaaaaaagcaggcaagttgaacattacgaaaaccacccctaaaaaagacggctctataaacaccagtcagagcatgcatgtcggtgagttcaatcagaagctggttgaggccagcacacagtttaaaaagaaacaggagaagggaaccatcgatgtatggtggctgtttgacgacggagggctgacattactcattccctacatcttgactctcagaaaaaaatggaaggactgtaaacttaggatttacgtcggaggtaagatcaaccgcatagaggaggagaaaattgtgatggcttctctgctctctaagtttcgcattaaattcgctgatattcacattatcggtgatattaacattagacccaataaggagtcctggaaagtgtttgaagagatgatagagccctaccgtctgcacgagagttgcaaagatctaacaactgccgagaagctgaaacgcgagacaccatggaagattaccgacgctgaattggaggccgttaaagagaaaagttatcgtcaagtacgcctaaacgaactcttacaggagcacagccgggctgctaatttgatcgtgttgtctttaccggtggcgcgtaagggatcaatttccgacctgttgtatatggcgtggctcgagatcctcaccaagaaccttccccctgttctgttggtgaggggtaaccacaagaatgttctcacattctatagc

SEQ ID NO: 251147 - DNA, 3297 bp, Artificial Sequence
  Description of Artificial Sequence: Synthetic coding sequence
atgagtcttaataactccagtaatgtatttcttgattctgtaccatcaaacacaaaccgattccaggtttctgtaatcaatgaaaaccacgaatctagtgctgcagctgatgataacactgatccccctcactacgaagaaacatcctttggagacgaagctcagaaaagactccgcatttcttttaggcctggaaatcaggagtgctacgacaacttcctgcagtcgggagagacagccaaaacagatgcttcctttcatgcttatgattcacatactaatacatattatctccagacattcggacataacacaatggacgctgtgcctaaaattgaatattataggaacactgggtctatctccggacctaaagtaaacagaccctctctcctagaaatacacgaacagctagccaaaaacgttgcggtcactccatcctctgccgatcgcgtggccaatggagatggaatacccggagatgaacaggctgaaaacaaagaagatgaccaggcaggggtcgtaaaattcgggtgggtcaagggagttctggtaagatgtatgctaaacatctggggagtgatgctgtttatacggctatcctggatcgtaggagaagccggaatcgggctcggagtaattatcattggactgtcggttgtggtgactactcttactggaatctccatgtctgccatatgtacaaacggggtggttcggggagggggggcctattatcttatctctcgctccttggggcccgaattcggagggtctatcggactgatcttcgcttttgctaacgccgttgctgtggctatgtacgtcgttggattcgctgaaacagtcgtcgatctgctcaaggaaagtgattcaatgatggtggatcccacaaacgatatcaggattattgggtctataacagtggtgatacttttagggatctcagtggccggaatggagtgggaagctaaggctcaggtaattcttcttgttatactcctaatagcgatcgccaatttcttcattgggactgtgataccttcgaataatgaaaaaaaatcgaggggatttttcaattaccaggcctcaatctttgctgaaaatttcgggcccaggtttactaaaggggaaggatttttttcagtcttcgctatattttttcctgccgccacagggatcttagccggagctaatatctccggagacctcgaagatccccaggatgcaatacctagggggacaatgctcgccatcttcataactacagtggcttatttaggagtagctatatgcgtaggggcttgtgtcgtgagggatgcaactggaaacatgaatgatacaatcatctccgggatgaactgcaacgggagtgctgcatgtggactggggtatgatttttctcggtgtagacacgaaccttgtcagtatgggttaatgaacaacttccaggtcatgtcaatggtgagtgggttcgggcctctgataactgccgggatattctcggccacactgtcctccgctctcgctagtcttgtgtctgcccctaaagtctttcaggccttgtgtaaagataacatctacaaagcactacagttcttcgcgaaagggtatgggaaaaacaacgaaccacttaggggatacatccttacattcctcatagccatggcttttatactcattgccgagctgaatactatcgcacctattatttctaacttctttttagcgagttatgccctcattaacttcagttgtttccacgccagttatgccaagtcccctggatggcgccccgcttatgggatatataacatgtgggtatctctatttggggctgtgctgtgctgtgcagttatgtttgttattaattggtgggccgctgtgatcacttatgtcatcgagttcttcctgtatgtgtatgttacatgcaaaaaacctgatgttaactggggatcctcaactcaggccctctcttatgtgtctgctctggataacgcattagaactcactacagtggaggaccacgtgaaaaattttaggccccagtgtatagtgcttactggaggacccatgactcggcccgcactactcgatatcacacatgcatttacaaaaaattccggattgtgcatatgctgtgaagtgttcgttggacctaggaaactctgtgtgaaagaaatgaattcaggaatggccaagaaacaggcctggctaataaaaaataaaattaaagccttttacgcagcagtagccgcagactgcttccgcgatggggtccgttctctgctccaggcttcggggctggggcgtatgaaacctaacactttagtgatcggatataagaaaaattggcgcaaagccccactcacagaaatcgaaaactatgttggaataattcatgatgcattcgactttgaaatcggggtagtgatagtacgaatcagtcaggggttcgatataagtcaggtgttacaggtgcaggaagagcttgaacgccttgaacaggaacggctggctttggaagcaacaattaaagacaacgagtgcgaagaagaatctggaggaatccgggggctttttaaaaaggccgggaaactaaatattactaaaactactccgaaaaaagatggatctataaacacttcacagtccatgcacgtcggagagtttaatcagaaactcgttgaagcatcgacacagttcaaaaaaaaacaagagaaaggaacaatcgacgtttggtggctctttgatgatggaggactgactctattgattccttatattctcacgctaagaaaaaaatggaaggattgtaaactgaggatctatgtgggggggaaaatcaataggatcgaagaagagaaaatcgttatggccagtctactatctaaatttcggataaaatttgcagatatacacattataggggatattaatataagaccaaataaagaatcatggaaagttttcgaggaaatgattgaaccttatcgactccatgaatcttgcaaagacctgacaactgctgaaaagctcaaaagggaaacaccatggaaaatcacagatgccgaactggaagctgtgaaagaaaaatcctatagacaagtgaggctgaatgaattgcttcaggagcactcccgcgccgcaaatttaatagttctttcacttcctgtggccaggaaaggatctatcagtgacctgctctatatggcctggctggaaatactcacaaaaaacctccctcccgttttgcttgtgcgagggaatcacaaaaatgtgctgacattctatagt

SEQ ID NO: 251148 - DNA, 3297 bp, Artificial Sequence
  Description of Artificial Sequence: Synthetic coding sequence
atgtcgctcaacaattcatcgaacgtctttcttgattccgtcccatcgaatacgaatagattccaggtgtcggtaatcaacgagaatcatgaaagctccgcagcagcggacgataacaccgatcctccgcactacgaagagacgtcattcggagacgaggcgcaaaagaggcttagaatctcatttcgccctggcaatcaggagtgttacgataacttcctgcagtccggagaaactgccaagaccgatgcctctttccacgcctacgacagccatactaatacttactaccttcaaaccttcggacataacaccatggatgcagtgcctaagattgagtactaccgaaacacggggagcatctcaggccctaaggtgaaccgaccatcgcttctggaaatacacgagcagttggccaagaacgtggcagtcaccccctcgagcgccgacagagtggctaacggggacggtattcctggcgatgaacaagcagaaaacaaagaggacgaccaagcgggagtggtgaagtttgggtgggtgaagggtgtgctggtgcggtgtatgctgaatatctggggtgtgatgctctttattcggctctcctggatcgtgggagaagcagggatcggactcggagtcatcattattggtctttcagtggtggtcaccacccttaccggtatctcaatgtcagccatttgtactaacggtgtggtcagaggtggaggagcgtactacttgatttcgagaagcctcggacccgaatttggtggaagcattgggttgatcttcgcatttgctaacgcggtggcggtggcaatgtacgtggtgggatttgcggagactgtggtggatctgctgaaggagtcggactccatgatggtggatcctaccaatgatattagaatcatcggttcgattactgtggtcattcttcttggaatcagcgtggccggtatggagtgggaagccaaggcacaagtcatcttgctcgttattctccttatcgcaattgcaaatttctttatcggaacggtgatcccttccaataacgaaaagaagtcacgcgggttcttcaattatcaggcttccatctttgcagagaatttcggacctcgatttaccaaaggggaaggttttttctctgtgtttgcgattttctttccagcagcaaccggcattctcgccggtgcaaacatttcaggagatcttgaagatccgcaagatgccatacccagaggcaccatgctggcaattttcattactaccgtggcataccttggcgtggcaatctgtgttggagcgtgcgttgtgagagacgccaccggtaacatgaacgacactatcatttcgggcatgaactgcaatggttcagcagcatgtggactcgggtatgatttttcaagatgtaggcacgagccttgtcaatacggcctgatgaataactttcaggtgatgtcaatggtgtccggctttggacccctcatcaccgcagggattttctcggccaccctgtcctctgcactcgcgagcctcgtcagcgctccgaaggttttccaggctctttgcaaggataacatctacaaggctctgcaattcttcgcaaagggatatggcaagaataatgagccccttaggggctacatcctgacttttcttatcgccatggcatttatccttattgccgagcttaataccattgcgccgataatctccaatttctttctcgcatcctatgcattgatcaacttcagctgtttccacgcttcctacgctaagagccccgggtggcggcccgcgtacggcatttacaacatgtgggtcagcctctttggagccgtgctgtgttgtgcagtgatgtttgtgattaactggtgggcggcagtcattacttacgtgattgaattcttcctttacgtgtacgtcacctgtaagaagcctgacgtgaattggggctcctcaacccaagcactgagctacgtctcggcacttgacaatgcccttgaattgaccacggtcgaagatcacgtgaagaactttcgcccacaatgtatcgtgctcaccggaggtccaatgactcggcctgcacttctggacattacgcacgcatttactaagaattcaggtctttgcatatgttgcgaagtgtttgtgggtccaagaaagctgtgcgtgaaggagatgaactcgggaatggccaaaaaacaggcgtggcttatcaagaataagatcaaggcattttacgcagcagtggcagcagattgtttccgggatggggtgcgctcgctgctgcaagcaagcggactcggacgcatgaagcctaatactctcgtcattggttataagaagaattggagaaaggcgcccctgactgagattgaaaactacgtcggaataatccatgatgcattcgactttgagatcggtgtggtgatagtgcggatatcccaaggatttgacatcagccaagtgctgcaggtgcaagaggagctggaacggctggaacaggagcgattggcactggaagcaaccatcaaagataatgaatgtgaggaagaatccggtggtattcgcggtttgtttaagaaggctggaaagctgaacatcaccaagaccacccccaaaaaagatggatcgataaacacctcccaaagcatgcacgtcggcgagtttaatcagaagctggtggaagcaagcacgcaattcaagaagaagcaggaaaagggcactatcgacgtgtggtggctgtttgatgacgggggcctgacgctgctgattccatacatactgaccctccggaaaaagtggaaagattgtaagctgcgaatttacgtcggaggaaagattaaccgcattgaggaagaaaagatagtgatggcaagcctgttgagcaaattccgcatcaagtttgctgatattcacatcattggagacattaacattagacccaataaagaaagctggaaggtgtttgaggaaatgatcgaaccgtaccgcctccacgaatcgtgtaaagatctgaccactgctgaaaaacttaagcgcgaaaccccatggaagattactgatgcagagctggaggccgtgaaggaaaagagttaccgacaagtgagacttaacgaactgctccaggaacactcgagagcggcaaaccttatagttctttcgctgccggtggcgcgtaagggatcaatcagcgatctcctttacatggcatggctcgagattcttacgaagaaccttcctcccgtgcttctcgtccgtggaaaccataagaatgtccttacgttttactct

SEQ ID NO: 251149 - DNA, 3297 bp, Artificial Sequence
  Description of Artificial Sequence: Synthetic coding sequence
atgtctctgaataactcaagtaatgtgtttttggactccgtcccgtccaataccaaccgctttcaggtgtccgtcatcaacgaaaaccacgaaagctccgcagcagccgacgataataccgatccgccccattacgaagaaacctcctttggagatgaagctcagaagcgacttaggatttcctttaggccaggtaaccaggaatgctacgataacttcctgcagtcgggggaaaccgcaaagaccgacgcatcattccatgcgtacgacagccataccaacacttactacctgcagacttttggacataacactatggatgcagtgccaaagatcgagtactaccgcaataccggaagcatcagcgggcccaaggtgaatcgtccttcgctgctcgaaatccacgagcaacttgcaaagaacgtcgcagtgactccatcatcggccgacagagtggcaaatggagatggaatcccaggagatgagcaagcagaaaacaaagaggacgatcaagccggagtcgtgaagttcggttgggtgaagggagtccttgtgcggtgtatgctgaacatttggggggtcatgctgttcattaggctttcgtggatagtgggcgaagccggaattggcctcggagtgatcatcattggactgtcagtggtcgtgaccacccttaccggaatcagcatgagcgcaatatgtaccaacggtgtggtgaggggaggcggagcatactacctcatttcgaggtcacttgggccagagtttggtggctccattggacttatcttcgcctttgccaacgccgtggccgtcgcaatgtacgtcgtgggttttgcggagactgtcgtggaccttctcaaggagtccgacagcatgatggtggatccaactaatgacataagaatcatcggttcgataacggtggtgatccttcttggtatttcggtggcaggcatggaatgggaggcaaaggcccaggtgattctgcttgtcatactccttatcgcaatcgcaaacttctttattggcactgtgatccctagcaacaatgaaaagaagtcaagaggattctttaactaccaagcaagcatctttgccgagaattttggtccacggttcactaaaggggagggattcttctcagtctttgccattttctttcctgctgcaacgggtattcttgccggagccaacatttcaggcgatttggaggatccccaagacgcaattccacggggaaccatgcttgcaatcttcattaccaccgtggcataccttggtgtggccatttgcgtcggagcatgcgtggtgcgagatgcaactggtaatatgaatgacactattatctccgggatgaattgcaacggatcggctgcatgtggactgggctacgattttagcagatgccgacacgagccttgtcagtacgggctcatgaacaacttccaagtgatgtcgatggtgagcggtttcggacctcttattaccgcgggaattttctccgcaactctttcctcggcactggcctcccttgtgtcggctcccaaggtgtttcaggcgctttgtaaggacaacatctacaaggcgctgcagtttttcgcgaaaggttatggcaagaacaatgagcccctgaggggatacatcctcacttttcttattgcaatggcatttatccttattgcagaactgaacactattgcgccaattatctctaactttttcctcgcatcctacgccctgataaacttttcctgttttcatgcctcgtacgcaaaatcacctggctggcggccggcatacggcatatacaacatgtgggtcagcctttttggagccgtgctttgttgcgcagtcatgttcgtgattaactggtgggccgcagtgataacgtacgtgattgaattcttcctgtacgtgtacgtgacctgtaagaagccagacgtgaattggggtagctctactcaggccctttcatacgtgtcagcactggataatgctctcgaacttactaccgtcgaagatcatgtgaagaatttccggccgcagtgcattgtgctgaccgggggacccatgaccagaccagcgctgcttgatattacgcatgcatttactaagaattcgggtctgtgcatttgctgtgaagtgtttgtgggaccacgcaaactgtgcgttaaggaaatgaattcggggatggccaaaaaacaagcatggctgataaagaacaagatcaaagcattttacgcagcagtggcagcagactgctttagagatggagtgagaagccttcttcaagcatcgggcctggggagaatgaagcctaataccctggtgattggatataagaagaattggcgaaaagcacccctcaccgaaattgaaaactacgttggcattattcacgacgcgtttgattttgagattggtgtggtgatcgtgagaatctcgcagggctttgacatctcgcaggtgttgcaggtccaagaagagcttgaacgtctggagcaagagagacttgcactggaggccactattaaggacaatgagtgtgaagaggaatcgggtgggattcgcggtttgtttaagaaggcagggaaactgaacattaccaaaaccacccccaagaaggatggcagcattaacacgagccagtcgatgcacgtgggcgaattcaaccagaagctcgtggaagcatcaacccagtttaagaagaagcaagaaaaggggactatcgatgtgtggtggctttttgatgatggagggcttacgctgttgatcccatatatccttactctgcggaagaagtggaaggattgcaagctcagaatatacgttggtggcaaaatcaatagaatagaggaagagaagatcgtgatggcaagtctgctgtcaaagtttcgaatcaagttcgcagatatccatatcattggagacattaacatccggcctaacaaagaatcgtggaaagtgtttgaagagatgattgaaccatacagacttcacgagtcgtgtaaggacctcaccaccgccgaaaaacttaagagggagactccttggaaaatcactgacgctgaactcgaagctgtgaaggagaaatcataccgacaggtgcgacttaatgagcttctccaggaacacagcagagccgcaaatctgattgtcttgagcctcccagtggccagaaagggtagcataagcgatcttctctatatggcttggctggagattctcaccaagaatttgcctccagtgctgttggtgcgtggtaaccacaaaaacgtgctcactttctactca

SEQ ID NO: 251150 - DNA, 3297 bp, Artificial Sequence
  Description of Artificial Sequence: Synthetic coding sequence
atgtccctgaacaactcaagcaacgttttcctcgactctgtacccagcaatactaaccgctttcaggtgagcgtgatcaacgagaaccacgaaagcagcgcagctgccgatgataatacggaccccccccattacgaggagacttcttttggcgacgaggcccagaagcggctgagaatctcctttcggccaggcaatcaggagtgttacgacaacttccttcagtcaggcgagacagcaaagaccgacgcatcctttcacgcctacgactcacacacgaacacgtactacctgcaaacattcggacataacacgatggatgccgtcccgaaaattgaatactatcggaatacagggtctataagtggcccaaaggtgaatcgaccttctctgctggaaatccacgaacagcttgctaagaacgtcgccgtaacccctagttcagcagatcgggtggccaatggcgatggtatcccaggtgacgaacaggctgagaataaagaggacgaccaagctggggtcgtcaaattcggctgggttaagggtgtgctggtgaggtgtatgctgaatatatggggtgttatgctgttcatacggctcagctggattgtgggcgaagccggcataggactgggggttatcatcataggcctgagcgtagtggtgacaactctgacagggatcagcatgagtgctatttgcaccaacggtgtggtccggggtggtggcgcatactacctgattagccggagtttggggccggagtttgggggctctattggtctgattttcgcctttgccaacgccgtggccgtcgcaatgtatgtagtaggcttcgcggaaactgttgtggacctgttgaaagagtctgacagtatgatggtggatcccacaaatgatatacgcattatcggctctatcaccgtggtgattctgctcggaatttcagtggcagggatggagtgggaagcgaaggcacaggtgatcctcctggtgatcctgctgatcgctatagcgaactttttcatcggcaccgtgatcccttccaacaacgaaaaaaagagcagaggttttttcaattatcaggcaagtatttttgccgagaattttggacctagattcactaagggggagggattctttagtgtgtttgcgatcttttttccggccgccaccggaatactggcgggagcaaacatctctggagatttggaggatccacaagatgccattccaaggggtaccatgcttgccatttttatcaccacagtcgcatacctgggggtggccatttgcgtgggagcttgtgtcgtgcgcgatgccacgggaaatatgaacgacaccattatatcaggaatgaactgtaatgggtctgccgcatgcggcttggggtatgactttagcaggtgtcggcatgaaccctgccagtatgggctgatgaacaactttcaggtgatgtccatggtgtccggatttggacctctgatcaccgccggcatatttagcgcaacactgtcatcagctctcgcttcacttgtgtcagctccaaaggtttttcaggccctgtgcaaggacaatatttacaaggccttgcaattcttcgctaagggatacggaaagaacaacgaacccctgagggggtatatcctgacattcctcattgcaatggcctttattctcatcgcagaacttaataccatcgcacctataatttcaaacttcttcttggcaagctacgccctgatcaacttttcatgcttccatgcttcatatgccaagagccccggctggagacccgcgtatgggatctataacatgtgggtttcacttttcggtgcagtactctgctgcgccgtaatgttcgtgatcaactggtgggccgctgtgattacctatgtcattgagttttttctgtacgtatacgtgacttgcaagaaacccgatgtgaactggggcagcagcactcaggctctgagctacgtgtcagcactggacaatgcattggagcttaccaccgtggaggaccacgttaagaacttcaggccacagtgcatcgtgttgaccgggggtccaatgacgcgccccgctctgctggatataactcatgctttcaccaagaattccggcctgtgcatctgctgcgaagtcttcgtaggcccccggaagctctgcgtgaaggaaatgaattccggaatggcaaagaaacaggcctggctcattaaaaacaagattaaggctttctatgcggccgtcgcggctgattgttttcgagatggcgtccgcagcctccttcaggcaagtggactgggccgcatgaagcctaacacccttgtgattggctacaagaagaactggaggaaggccccattgaccgaaattgagaattatgtggggattattcacgacgcatttgattttgaaattggcgtggtgattgtcagaatctctcaggggtttgacatcagtcaggtgctgcaggtgcaagaagaactggaaagactggaacaggagaggttggccctggaagccacgatcaaggacaatgagtgcgaagaggagtcaggaggcatccggggactgttcaaaaaggccggtaagctcaatatcactaaaaccacacctaagaaggatgggagtattaatacctcccagtctatgcatgtcggagagttcaatcagaagctggtggaggcatcaacacaattcaaaaaaaaacaggagaagggcaccatcgacgtttggtggttgtttgatgatgggggcctgacattgctcatcccgtacattctgacattgcggaaaaagtggaaggattgtaaattgcggatttacgtgggaggcaaaattaaccggatcgaggaggaaaagatcgtcatggcctctctgctgtccaagtttcgaattaagtttgcggatattcacatcatcggggatataaatatccgccctaataaagagagttggaaggtgttcgaggaaatgattgagccataccggcttcacgagtcctgcaaagatcttactacagccgagaagctgaagcgagagacgccgtggaagatcacagatgccgaactcgaagccgtcaaagaaaaatcataccggcaggttagacttaatgaacttctgcaagaacacagtagggcggccaatctgatcgtgctctctcttcccgtcgccaggaaaggaagcatatccgatctgctttatatggcgtggctggaaatactgacaaagaatctgccacccgtgttgttggtccggggcaatcacaagaacgtgctgaccttttattca

SEQ ID NO: 251151 - DNA, 3297 bp, Artificial Sequence
  Description of Artificial Sequence: Synthetic coding sequence
atgagcctcaataactcgtccaacgtgttccttgattcagtgccaagcaatactaaccgatttcaagtcagcgtcatcaacgagaaccatgaatcatcggcagccgcagatgataatacggatccgcctcattatgaggagacttcctttggcgatgaagcacagaaaaggcttcgcatttcgttccgccccggaaaccaagaatgctacgacaactttctgcagtctggcgaaactgcaaaaactgatgcctcatttcatgcatacgactcacacaccaacacctattacctccaaacctttggacacaacactatggatgcagttcctaagattgagtactacagaaacaccggatccatttccggacctaaagtgaacagacccagccttctggaaattcatgaacaacttgcaaagaacgtggcagtgactccctcgtccgcagaccgggtggcaaacggcgacggtatcccgggagatgaacaagctgaaaacaaagaagatgaccaagcaggtgtggtcaaatttggatgggtgaaaggcgtcctggtgcgatgtatgcttaacatctggggagtgatgttgttcataagattgtcgtggatagtgggtgaggcaggtatcggattgggtgtgatcattattggtctttcggtggtggtgactaccctgactgggatttccatgtcagccatttgcaccaatggagtggtgaggggcggtggagcctactacctgatttcaaggtcgctcggtccagaatttggtggatccattggactcatttttgccttcgctaacgcagtggcggtggcaatgtacgtcgtgggctttgctgagacggtggtggatctccttaaggaatcagattcgatgatggtcgacccaactaatgatattagaatcatcggttccatcactgtcgtcatactgctgggcattagcgtcgcaggtatggaatgggaggctaaagcccaagtgatactgctggtgattctgctgattgccattgcaaacttctttataggcaccgtgattccttccaataacgaaaagaagtcgagaggcttcttcaattaccaggcatcaattttcgcagagaattttggaccacgcttcactaagggagaagggtttttcagcgtctttgcaatcttttttcctgcagcaaccgggatccttgccggagcaaatatctctggagatctggaagatccgcaagacgccattccccgcggaacgatgttggcgatcttcataactactgtggcataccttggtgtggcaatttgtgtcggtgcctgtgtggttcgtgatgcaactggaaacatgaatgataccatcatatccggcatgaattgcaacggtagcgcggcctgcggtctgggctacgatttttccagatgtcggcatgaaccctgccagtacggacttatgaacaatttccaagttatgtcaatggtttccggttttggaccactgatcaccgcaggcatattctcagcaactctcagctccgctcttgcttccctcgtgtccgctcccaaggtgtttcaagccctttgtaaggacaacatttacaaggcactgcagtttttcgccaaggggtacggcaagaacaacgaaccactcagaggctacattcttacgtttcttatcgcgatggcgtttatcctgattgccgagcttaacaccatcgcacccatcataagcaacttttttctggcatcgtacgcactgatcaatttcagctgtttccatgcatcatacgcaaaatccccgggttggaggcctgcctacgggatctacaacatgtgggtgagcctgtttggcgcggttctgtgttgcgctgtgatgttcgtcattaactggtgggcggctgtcatcacttatgtcatcgaattcttcctgtacgtgtacgttacttgcaagaagcctgacgtcaactggggctcgtcgactcaggcactcagctacgtgtcagccctcgacaatgcgctggagctgaccaccgtggaagatcatgtcaagaatttccgccctcagtgtattgtcctgaccggaggaccaatgacccggccagcacttcttgatataactcatgcgttcaccaagaacagcggactttgcatttgctgtgaggtgtttgtggggccacgcaagctgtgtgtgaaggagatgaactccggaatggctaagaagcaggcctggctgatcaagaataagatcaaagcattttacgcggcagtggcagccgattgttttagagatggagtgagatctttgcttcaggcatcgggactcggacggatgaaacctaacacccttgttatcgggtataagaagaattggcgaaaagccccacttactgaaatcgagaactatgtgggaatcattcatgatgcgtttgacttcgaaattggagtggtcatcgtgcgcatctcacaaggtttcgacatttcgcaagtgctgcaagtccaagaagaactcgaacggttggaacaagaaagacttgcactggaagcaacgatcaaggacaatgagtgtgaggaggagtcaggtggcattcggggactctttaagaaggccggaaaactcaacataactaagacgacccccaaaaaagacggttccattaacacctcacaatccatgcatgttggtgaattcaatcagaagttggtcgaagcatcaactcagtttaagaagaaacaggagaaaggtactatagatgtctggtggctgttcgacgatgggggtcttacgctgcttattccgtacattctcacccttagaaagaaatggaaggattgtaaacttagaatctacgtcggaggaaagattaacaggattgaggaagagaagatagtgatggcatcactgttgtcaaagtttagaattaagttcgccgatatacatatcattggagacattaacatacgacccaataaggagtcgtggaaggtgttcgaggaaatgatagaaccctataggcttcatgaatcgtgcaaagatcttaccactgctgaaaagctcaagagagaaactccttggaagatcaccgatgcggagctcgaagctgtcaaggaaaagtcgtaccgccaagtccggctcaacgaattgctgcaggagcattcacgggcagctaaccttatcgtgttgagcctgcctgtggcaaggaagggcagcatatcggacctgctgtacatggcttggctggaaattctgaccaaaaatcttcctccagtgcttcttgtgcgaggaaatcataagaatgtcctcactttttactcg

SEQ ID NO: 251152 - DNA, 3297 bp, Artificial Sequence
  Description of Artificial Sequence: Synthetic coding sequence
atgagcttgaacaattcctcgaacgtattcttggactcggtcccatccaataccaacagattccaagtgtcagttatcaacgagaaccatgaatcctcagcagcggccgatgacaataccgatccgccacactacgaggaaacctcattcggcgatgaagcgcagaaacggctccgcatctcattccgaccgggcaatcaggagtgttacgacaatttcttgcaaagcggagaaacggccaagactgacgccagctttcacgcttacgactcacatactaatacttactacctgcaaaccttcggacacaacaccatggacgcagtgcctaagatcgagtactatcgcaatactgggtcaatctctggtccgaaggtcaatcggccttcgctcctggaaatccacgaacaactcgcaaagaacgtggccgtcaccccatcgtcagccgaccgggtggcaaacggcgatgggattccaggggatgagcaggctgaaaacaaggaggacgatcaggctggggtcgtgaagttcggctgggtcaaaggagttctggttcgctgcatgctcaacatctggggggtgatgcttttcatcagactgtcctggatcgtgggagaggccggaatcggactgggagtgattatcataggactttccgtggtcgtgactaccctgaccggaatatccatgtccgctatctgtacgaacggcgtggtgcgagggggaggggcctattacctgatttccagaagcctgggaccggaattcggcggatccatcggcctcatctttgcattcgctaacgcggtcgctgtggctatgtacgtcgttggatttgccgaaaccgtggtcgacctcctgaaggaatccgattcgatgatggtggaccccaccaatgatatccgcatcattggatctatcacggtcgtcattctcctgggcatctcagtagcgggcatggagtgggaggctaaagcacaagtgatcctgctcgtaatcctcctgatcgctatcgccaactttttcatcggcactgtcattccctcgaacaacgagaagaagagcaggggcttcttcaattatcaggcctcaatctttgctgagaatttcggaccgcgcttcaccaagggagagggtttcttctcggtgtttgctatcttctttccggcggccactggcatcctcgcgggcgccaacatcagtggagacttggaggacccacaggacgccattcctaggggaactatgctggcaatcttcattaccactgtcgcatacctgggggtcgcgatctgcgtgggagcatgtgtggttagagacgctaccggaaacatgaatgataccatcatttctggtatgaactgcaatggttcagcggcatgtggtttgggctacgattttagcaggtgccggcatgaaccttgtcagtacgggctgatgaacaacttccaggtcatgtcgatggtcagcggatttggtccgctcatcactgccggtatcttctcggctacgctgagctccgcgctggctagcctcgtcagcgcaccaaaagtgttccaggcactgtgcaaggataacatatacaaggcccttcaattcttcgcgaaaggatacgggaaaaacaatgaaccccttcgtggatacatcctgacctttctgatagccatggccttcatcctgatcgccgagctgaacactattgcgcctatcatctccaacttttttctcgcctcgtacgccctgatcaacttctcatgcttccacgcgtcttacgccaaatcgcctggatggcggccggcctacggaatctacaatatgtgggtgagcctcttcggcgctgtcctttgctgcgctgtgatgtttgtgatcaattggtgggctgcggtcattacttacgtcatcgagttctttctgtacgtgtacgtgacctgcaagaagccggatgtgaattggggatcttcgactcaggctctttcctacgtgagtgcactcgataacgccctcgaacttaccactgtggaggaccacgtgaaaaacttccggccgcagtgcatcgtgctgaccggaggcccaatgaccagacccgcattgctggacatcacccatgcattcactaaaaactccggtctgtgcatttgctgcgaggtgttcgtgggaccgcgcaaactctgcgtcaaggaaatgaattcaggaatggccaagaaacaagcctggctgattaagaataagattaaggctttttacgcggccgtggccgcagactgcttcagggatggagtgagatccctgctccaggcgtcggggctggggcgcatgaagccgaacacgctcgtgatcgggtacaaaaagaactggaggaaggcccctctcaccgaaattgagaactacgtaggaatcattcatgatgctttcgacttcgaaatcggagtcgtgatcgtccggatttcgcaaggatttgacatctcgcaagtgctccaggtgcaggaggagctggaacgcttggagcaagaacggctggcgttggaggcaaccatcaaggacaacgagtgtgaagaagaatcaggaggcatccgcggactgttcaagaaggcaggcaagttgaacattactaaaactaccccgaagaaagacggtagcatcaacacttcccaatccatgcatgtcggagagtttaatcagaagctggtggaagcctctacccagttcaagaagaagcaggaaaaaggaactatcgatgtgtggtggctctttgatgacggcggtctgaccctgctgatcccgtacatcctcactctcagaaagaagtggaaggattgcaaattgcgcatctacgtgggaggtaagatcaaccggatcgaagaggagaaaatagtgatggcgtccctcctctcgaagttccgcatcaaattcgcagacatccacatcatcggcgacatcaatatccgaccgaacaaggagtcgtggaaggtattcgaagaaatgattgaaccgtaccgcctgcacgagtcatgcaaagacttgactaccgccgaaaaactgaagcgggagactccatggaagatcaccgacgccgaactggaagcagtgaaggaaaagtcgtatcgccaagtgcggctgaacgaactcctgcaggaacactcgcgcgccgccaaccttatcgtgctgtccttgcctgtggccaggaagggaagcattagcgacctgctgtacatggcctggctggaaatccttactaagaacctgcccccagtgctgctggtgcggggaaatcacaaaaacgtgctgaccttctacagc

SEQ ID NO: 251153 - DNA, 3297 bp, Artificial Sequence
  Description of Artificial Sequence: Synthetic coding sequence
atgagcctgaataactccagcaatgtttttctagatagcgtgccttccaacaccaaccgatttcaggtgtccgttattaatgaaaatcatgagtcctcagccgctgccgacgataataccgaccccccccactatgaagagacgagcttcggggacgaagcgcagaaaagactgcgtatctcttttcggcccggcaaccaggagtgctacgacaatttcctgcagtccggtgagaccgcaaaaaccgacgcatcatttcatgcgtatgattctcacacaaacacctactatcttcagacttttgggcacaataccatggacgcggtgccaaagattgagtattatcgtaacactgggtccatatctggccccaaagtgaacaggccctcactactcgaaattcatgaacagctggccaagaatgtggctgtgactcctagtagtgcggacagagtggccaatggagatggaattcccggcgacgagcaggcagaaaataaagaagatgaccaggccggagtagtgaagttcggatgggtgaaaggcgttctggttaggtgtatgcttaacatctggggggtcatgctcttcatccgcctgagctggattgtcggggaggcaggtatcggcttgggcgtgattataataggccttagcgtcgtggttacaacccttaccggaatatctatgtctgccatctgtaccaacggcgtggtccggggaggcggcgcgtactatctgatttctaggtctctaggtccagagtttggcggctctattggcctcatatttgcctttgcgaacgccgtggctgtggccatgtatgtggtggggttcgccgagacggtggtagatctcctgaaggagtctgactctatgatggtcgatccgactaatgatatccgaatcatcggttcaatcacggtggttattttgctagggattagcgtagcaggaatggaatgggaggcaaaagctcaggttatcctcctggtgattttattgattgccattgctaacttcttcatcgggaccgtgatcccctccaacaatgagaaaaaatctagagggttcttcaattatcaggccagtatattcgcggagaactttggtcctcgattcactaagggcgagggattctttagcgtctttgcaattttttttcccgccgcaaccggcatcctggcgggagccaacataagcggcgacctggaagatcctcaggacgctattcctcggggaacgatgctggctatttttatcactactgtcgcttatctcggcgtggccatctgcgtgggcgcctgcgtcgttcgggatgccaccggaaacatgaacgatacaatcatatccgggatgaactgcaacggctcagcggcatgcggactagggtacgactttagccggtgcaggcacgagccatgccagtacgggcttatgaataacttccaggtgatgtcaatggtctccggcttcgggccactcattacagccggaattttcagcgccacactctcctctgcccttgccagtctggtctcagccccaaaggtctttcaagccctttgtaaggacaacatttacaaggccctgcaattctttgccaaagggtatggaaagaataacgagcccttgcgaggatatattctcacctttctgatagccatggcattcattttgattgctgagttgaacacaattgccccaatcatttctaactttttcctggccagctacgcactgatcaacttctcttgctttcatgcctcctacgcaaagtcccctgggtggagacccgcgtatggcatatacaacatgtgggtgtctttgtttggcgccgtactgtgctgcgccgtgatgttcgtgatcaattggtgggctgccgtaataacctacgttatagagtttttcctgtatgtatatgtcacatgtaagaaacctgatgtgaattggggttcatcgacccaggccctatcttacgtctccgcgctggataatgccctcgaactgaccaccgtggaggatcacgtcaagaacttccgcccccagtgtatcgtcttgacaggcggacctatgactaggcctgcccttctcgatataactcacgcattcaccaaaaattcagggctctgcatctgttgtgaggtcttcgttggaccgaggaagctgtgtgtgaaggagatgaactctggaatggctaagaaacaggcttggctcattaagaacaaaattaaggcgttttatgcagctgtagcagctgactgttttcgagatggcgtgaggtctctgcttcaggctagtggcttgggcaggatgaaaccgaacaccctagtgattggttataaaaaaaattggcgtaaagctccactgacagaaatagagaattacgtggggatcattcatgatgcatttgatttcgaaataggagttgtaattgtgagaatctcacagggctttgatatttctcaggtgctacaggtccaggaagaactggagcgcctagaacaggagcggcttgccctggaggctacgattaaagacaacgagtgcgaggaagagagtggtgggattcgcgggctgttcaaaaaggccggtaaactgaacatcaccaagaccactccaaagaaggacggatctataaacacgagtcagtcaatgcacgttggagagtttaatcaaaaactagtggaagcgtcaacccagtttaaaaaaaaacaggaaaaaggcacgatcgatgtatggtggctatttgatgatggtggcctcactttgctgattccgtacattcttaccctgcgaaaaaaatggaaggactgtaagttaagaatctacgtgggcggtaagatcaatcggatagaggaagagaaaatcgttatggcctcccttctgagcaagttccgcatcaagttcgccgacattcacattatcggagatatcaacattcgtcccaacaaagagtcatggaaggtattcgaggagatgattgagccatatcgactgcatgagagctgcaaggatctgactacagccgaaaaactgaaacgtgagacaccttggaagattacggacgcagaattagaagctgtgaaggagaaaagttaccgccaggtacgtttgaatgaactgctccaggagcattcaagggccgctaacctgatcgtcctgtctctgcctgtggctcgtaaagggtctatttctgacttactttatatggcttggctcgagattctgacaaagaatctgccccctgttctgttagtgcgggggaaccataaaaacgtgttaaccttctactct

SEQ ID NO: 251154 - DNA, 3297 bp, Artificial Sequence
  Description of Artificial Sequence: Synthetic coding sequence
atgtccctcaataactcatcgaacgtctttttggattcagtgccttcgaacaccaacaggttccaggtgtcggtgattaacgagaaccacgaatcgagcgctgcagcagatgacaatacggatcctccacattacgaggaaacctcgttcggggatgaagcccaaaagagactgagaatctcgttccgacccggaaaccaggaatgttatgataactttctgcaatcaggggagactgcgaaaaccgacgcctcctttcacgcatacgatagccatactaacacttactaccttcagactttcggacataacaccatggacgcagtgcctaagatagaatactatagaaatactggatcaatttcaggaccaaaggtgaaccggcccagcctgctggaaattcatgagcagttggcaaagaacgtggcggtgaccccatcctcggccgatcgggtggcaaacggtgatggcattcccggggacgaacaggcagagaataaggaggacgaccaggcaggtgtcgtcaaatttgggtgggtgaagggcgtgctggttaggtgtatgctcaatatctggggggtgatgcttttcatccggctgagctggattgtcggagaagcgggaatcggacttggtgtgatcattattggcctctcggtggtggtgactacgttgactgggatatcgatgtccgccatctgtaccaatggtgtcgtgcgcggaggaggtgcatactacctgatttcccgctccctgggtccagaatttgggggatcaatcggactcattttcgcttttgcaaacgcagttgcagtggcgatgtacgtcgtgggttttgcggagactgtggtggacctgctgaaagagagcgattcgatgatggtggatccaaccaatgatataaggattattggatcgataaccgtggttatccttctcggaatatctgtggcaggtatggagtgggaggcaaaggcacaagtgattctcctggtcatcctgcttattgcgatagcaaatttctttattgggaccgtgattccttcgaataacgagaagaagtcgcgcgggttctttaactatcaagcatcgatttttgcagagaactttggacctcgatttaccaaaggggagggatttttctcggtctttgcgatattcttccccgccgcaacggggattctggcaggtgccaatatcagcggagatctggaagatcctcaagatgcgataccccgaggaactatgctggcgattttcattaccactgtcgcgtacctgggagtggccatctgtgtgggtgcgtgtgtggtgagggacgccactggcaacatgaatgacaccattatctccggaatgaactgcaacggatcggcagcctgtggccttggatatgatttcagccggtgtcgacatgagccttgtcagtacggtctgatgaacaactttcaggtcatgagcatggtgtcagggtttggccctctcattaccgcagggattttcagcgcaactctttcgtccgcactggcatcgcttgtgtccgcacctaaggtgttccaggctctgtgcaaagacaacatttacaaggcccttcagttttttgcgaaaggttacgggaagaacaatgaaccccttagggggtacattcttacctttttgatagcaatggcattcattttgattgcagaactgaacaccatcgctcctataatctcaaactttttcctcgcgagctacgctctgatcaatttctcgtgtttccacgcctcttatgcaaaatcgcctggttggcggccggcatacgggatatacaacatgtgggtgtccctgtttggcgcagtgctctgttgcgcggtgatgtttgtgatcaactggtgggcagccgtcattacttacgtgatcgaattctttctctacgtgtacgtcacttgcaagaaacctgacgtgaactggggatcaagcactcaagctctgagctacgtgtccgcgctcgacaacgcgctggaactgacgaccgtggaagatcatgtcaagaacttccgccctcaatgtatcgtgctgaccggcggaccaatgaccagacctgcacttctcgacatcacccatgcctttaccaagaattcaggtctgtgtatctgctgcgaggtctttgtcggtcctcgaaagctctgtgtcaaggaaatgaactccggaatggcgaaaaagcaggcctggctgatcaagaacaagatcaaggcattttacgcagcagtggccgcagattgttttagagacggcgtccgctccctcctccaagcctccggtctgggtcgcatgaaacccaacactctggtgattggttacaaaaagaactggcgtaaggcaccactgaccgaaatcgaaaactacgtgggcattattcatgatgcgtttgactttgagatcggcgtggtcatcgtccggatcagccagggttttgatatttcacaagtgcttcaagttcaagaggaacttgagaggctggagcaggaaagattggcactcgaggcgacgattaaagataatgagtgcgaggaagaatcaggaggaattagagggctgttcaagaaagcaggaaaactcaacataactaagaccactccgaaaaaagacggttccattaacacctcgcagtcaatgcatgtgggagaattcaatcagaagttggtggaagcatccacccagttcaagaagaagcaggagaaaggaaccattgacgtgtggtggttgtttgacgatgggggacttactcttcttattccatacattcttacgcttagaaaaaagtggaaggactgtaagctgcggatctacgtgggtggcaagattaatcgaatcgaagaggaaaagatcgtcatggcctcgcttctgagtaagtttcgaatcaaattcgcggacatccacataatcggggacattaacattagacctaacaaagagagctggaaggtgtttgaagagatgattgaaccttaccgcctgcatgaatcatgcaaggaccttacgacggccgaaaaactgaaaagggagactccgtggaagataaccgatgccgaactcgaggctgtgaaggaaaagagctacaggcaggttcgactcaacgaacttctccaggagcactcgcgcgccgcgaatctgatcgtcctcagccttccagtcgcgcggaaaggctccatttcagatttgctgtacatggcatggctggagattcttactaagaatcttcctcccgtgttgcttgtgcggggaaaccataagaatgtgctgaccttctactcc

SEQ ID NO: 251155 - DNA, 3297 bp, Artificial Sequence
  Description of Artificial Sequence: Synthetic coding sequence
atgtcgctgaacaactcctcgaacgtctttctggattcggtcccctctaacaccaatcgcttccaggtgtcagtgatcaacgaaaatcatgaatcaagcgcggcagccgatgataacaccgacccaccgcactacgaagaaacctctttcggcgatgaggcgcagaagcggctgcgcatctcttttagaccgggtaatcaggagtgctacgataactttctgcagtcgggcgagacggccaaaactgacgcatccttccatgcatacgactcccacaccaacacttactacctgcaaacgttcggacacaataccatggacgctgtgcctaaaatcgagtactaccgcaacactggatcgatctcgggacccaaagtcaaccggccgtccctgctggaaatccacgagcaattggcaaagaatgtcgcagtgacgccgagcagcgctgacagggtggctaatggagatggaattcctggagacgaacaagcagagaataaggaggacgaccaagcgggggtggtgaagttcggatgggtgaagggcgtcctcgtcagatgcatgctcaacatctggggcgtcatgctcttcatcaggctgtcgtggatcgtgggagaggccggaatcggcttgggggtgatcatcattgggctgagcgtggtggtgaccaccctgaccggaatctcaatgtccgcaatttgcaccaacggagtggtccggggcggaggagcctactacttgatcagccggtcattgggaccagaattcggtggaagcatcggactgatcttcgcgttcgccaacgccgtcgcggttgcgatgtacgtggtggggtttgccgaaaccgtggtggacctgctgaaggagagcgatagcatgatggtggacccgactaatgatatcagaatcatcgggtcaatcactgtggtgatcctgctgggcatctcagtggccggcatggaatgggaagcgaaagcgcaggtgatcctcctggtcatcctgctgattgccatcgccaacttcttcattggtaccgtgattccatccaataacgagaagaagtcaagaggttttttcaattaccaagcgtcgatcttcgccgagaattttggcccaagattcactaaaggagagggctttttctccgtgttcgccatcttctttccggccgctaccggcattcttgcgggagctaacatatccggcgatctggaggatccgcaggacgccatcccgcggggaaccatgttggccatcttcatcaccactgtcgcctacctcggggtggccatctgcgtgggagcctgcgtggtgcgcgatgccaccgggaatatgaatgacaccattatctccggaatgaactgcaatggctcggccgcttgcggcctgggctacgatttctcgcggtgccgccacgagccgtgccagtacggtctgatgaataactttcaggtcatgagcatggtgagcggtttcggccctctgattaccgctggtatcttctcggccaccctttccagcgccctggcgagcctcgtctcggccccgaaggtgtttcaggcactctgcaaggacaacatctacaaagcgctgcagttcttcgccaagggatacggtaagaataacgaacctcttcgcggatacatcctcactttcctcatcgccatggccttcatcttgatcgctgagctcaacactatagcccccattatctcaaacttctttttggcgtcatacgcactgataaacttttcgtgtttccacgccagctacgccaaatcgccgggatggcggcccgcatacggcatctacaatatgtgggtgtccttgttcggtgccgtcctgtgctgcgccgtgatgttcgtcattaactggtgggccgccgtgatcacttacgtcattgaattctttttgtacgtctatgtcacctgcaagaagccagacgtgaactggggatcctccacccaggctctctcgtacgtttcggcactggacaatgccctcgaactgaccactgtggaagatcatgtgaagaatttccgaccacagtgtatcgtgctcactggcgggccaatgacccggcccgccctgctcgacatcactcacgcgtttactaagaattccggtctgtgcatctgttgcgaagtttttgtggggccccgcaaactgtgtgtgaaggagatgaattcaggaatggcgaagaaacaggcatggctgatcaagaataagatcaaggccttttacgcagccgtcgccgcagattgcttccgcgatggggtccgcagtctgctgcaagcgtccggactggggaggatgaagccaaataccctggtgattggctacaagaagaattggagaaaggctccgctgaccgagatcgagaattacgtgggaatcatccatgacgcatttgacttcgaaatcggagtcgtgatcgtgcgcatcagccaaggattcgatattagccaggtgctgcaagtgcaggaagagctcgagcggctcgaacaggagcgcctggccctggaagccaccattaaagataacgagtgtgaggaggaaagcggcggtattcgcggcctcttcaaaaaggcggggaaactgaacatcactaagactacgccgaagaaagatggatcgataaacacttcgcagtccatgcacgtgggagaattcaaccaaaagttggtggaggccagcacgcaattcaaaaagaaacaagaaaaaggaaccatcgacgtctggtggctgttcgacgatggcggactgactctcctgattccttacattctgaccctccggaagaaatggaaggactgcaaacttcgcatatacgtcggaggcaagatcaatagaatcgaggaggaaaagattgtgatggcgtcgctcctgtcgaaattccggatcaagttcgccgatatccacatcatcggagacatcaacatccgccccaataaagaatcgtggaaagtgtttgaagagatgatcgaaccctaccgcctccacgaatcatgcaaggacctgaccaccgccgaaaaacttaagagagaaacgccttggaagattactgatgccgagcttgaggccgtgaaggaaaaatcctaccggcaggtccggctcaatgaactcctccaagaacactcccgagccgcaaatctgatcgtgctgtccctgccagtcgctaggaagggtagcatcagcgacctgctgtacatggcgtggctggagatccttactaagaacctgccgccagtgctgctggtccggggaaatcataagaacgtcctgaccttttactcc

SEQ ID NO: 251156 - DNA, 3297 bp, Artificial Sequence
  Description of Artificial Sequence: Synthetic coding sequence
atgtccctgaacaactcttctaacgttttcctagactcagtgcctagtaataccaataggttccaagtgagtgttattaatgagaaccacgagagttctgccgctgctgacgacaatacagatccaccacactacgaagagacatccttcggcgacgaagctcagaagcggcttcgaatctcattccggcccgggaaccaggaatgttatgataatttcctacaaagcggtgagacagctaagactgacgccagctttcatgcctacgactcacacactaacacttactacctacagacgttcgggcacaatactatggacgcagttccgaaaattgaatactaccgcaatacgggctctatctccgggcccaaagttaaccgacccagccttctggagattcatgagcagttagccaagaatgttgccgttactccatccagtgctgaccgtgtggcaaatggtgacggtattcccggagacgaacaagcagagaacaaggaagacgaccaggcgggagtcgtcaaatttgggtgggttaagggcgtgctagtgcggtgcatgttgaatatttggggtgtgatgctgtttattcgcctcagctggatcgtgggcgaggctggaattggccttggcgtgattattatcgggctgtctgtcgtcgtcacgactctgacgggtatctcaatgtctgccatctgcacaaatggggttgtccgaggaggcggcgcctactatctgattagccgctccctgggcccagaattcggcggctcgatcgggctcatattcgccttcgctaatgccgtggctgtggcaatgtatgttgtgggcttcgcggaaacagtggtggatctcttgaaggagagcgattcaatgatggttgatccgaccaatgacatccgaatcatcggttccattaccgtggtgatcttgctgggtatatcagtggcaggcatggagtgggaggcaaaggcccaagtgatcctcctcgtcattctcctgatcgcgattgcaaacttctttatcggcacggtcattcccagtaacaatgagaaaaagagccggggcttcttcaactaccaggcatcaatttttgctgaaaactttggacctcgcttcacaaaaggtgaagggttttttagcgtcttcgctatcttttttccggccgctacaggcattcttgccggtgcgaacattagtggcgatttggaggaccctcaagacgccatcccgcggggtacgatgttggccatcttcattaccacagtggcgtatctgggagtcgcgatctgtgtcggtgcctgcgtggtccgcgacgccacaggcaatatgaacgacactataatatcaggcatgaactgtaatgggtccgctgcgtgcggcttaggctatgattttagtcgatgcagacatgagccatgccaatatggcctaatgaataactttcaggtgatgtcaatggttagtggatttggccccttgattaccgctggtatcttcagtgcgaccctgtcgtccgcccttgcctcactggtctctgcccccaaagtgttccaggctctctgtaaggataacatatacaaagcccttcagttttttgcaaaggggtatggcaaaaacaacgagccgttgaggggctatatcctgacattcctgatcgctatggcgttcatcttgattgccgagctcaacacgattgcacccataatcagcaattttttcctagcctcttacgcgctgatcaactttagttgttttcatgcatcttatgctaagtctccggggtggagacctgcctatggcatttataacatgtgggtgagtctgttcggcgccgtactgtgctgtgccgttatgtttgtcattaactggtgggcagccgtgattacctatgtcattgagttctttctgtacgtctatgtgacctgtaagaagccagatgtcaactggggaagtagcactcaagcactcagctatgtcagcgccttagacaacgccctggaactgactacagtggaggaccatgtcaagaactttaggcctcaatgcatcgtgctgactggagggcccatgacgaggcccgctctcttagatatcacgcacgcatttaccaaaaatagtgggctgtgcatctgctgcgaggtcttcgttggtccacggaaactctgcgtgaaggagatgaattcgggcatggcgaagaagcaagcatggctgattaaaaataaaatcaaagcattctatgccgccgtggctgctgactgtttcagggatggtgttagatctttgcttcaggcttccggcctaggaagaatgaagccaaataccctggtaattggctataagaagaactggcggaaggctccactgacggaaatagaaaattacgttggtataatccatgatgcattcgattttgagattggcgtcgtaatagttagaatatcacagggcttcgacattagtcaggttcttcaggtgcaggaggaactagagcggctcgaacaagaacgcctggccttggaagctacaattaaggacaatgagtgtgaagaggaatcgggaggcatcagggggctttttaagaaagcaggcaaacttaatataacaaaaacaacacctaaaaaagacgggagtattaacacttctcaaagtatgcatgtgggcgaattcaatcagaaactcgttgaggccagcacacagtttaagaagaagcaagagaagggcacaatagatgtatggtggctgttcgacgacggcgggcttacgctgctgatcccttatattctcactctaagaaagaaatggaaggactgcaaacttcgcatttacgtcggcggaaagattaatcggatcgaagaggagaaaatcgtgatggcttcacttctaagcaagttccgcatcaagttcgctgacatacatatcattggggacattaacatccggccaaataaggaatcttggaaggtgtttgaggagatgatcgagccctacaggcttcacgaatcatgcaaggatttgaccacggcggaaaagctcaaaagggagactccttggaaaataaccgacgccgagctcgaggccgttaaggagaagagctacagacaggttcggctgaatgaactgttgcaggagcattcccgcgctgctaacttgatcgtgctctcccttccggtagctcgtaagggaagcatatctgatctgctctacatggcatggttggagatcctgaccaagaacctcccgccagtgctcttagtgcgcggaaaccataagaatgtgcttaccttctactcg

SEQ ID NO: 251157 - DNA, 3297 bp, Artificial Sequence
  Description of Artificial Sequence: Synthetic coding sequence
atgtcgctaaataattcgtcgaatgtttttttagattcggtaccgtcgaatacgaatcgttttcaagtatcggtaataaatgaaaatcatgaatcgtcggcggcggcggatgataatacggatccgccgcattatgaagaaacgtcgtttggtgatgaagcgcaaaaacgattacgaatatcgtttcgaccgggtaatcaagaatgttatgataattttctacaatcgggtgaaacggcgaaaacggatgcgtcgtttcatgcgtatgattcgcatacgaatacgtattatttacaaacgtttggtcataatacgatggatgcggttccgaaaatagaatattatcgaaatacgggttcgatatcgggtccgaaagtaaatcgtccgtcgctattagaaatacatgaacaactagcgaaaaatgtagcggttacgccgtcgtcggcggatcgagtagcgaatggtgatggtataccgggtgatgaacaagcggaaaataaagaagatgatcaagcgggtgttgtaaaatttggttgggttaaaggtgttttagttcgttgtatgctaaatatatggggtgttatgctatttatacgtctatcgtggatagttggtgaagcgggtataggtttaggtgtaataataataggtttatcggtagtagttacgacgttaacgggtatatcgatgtcggcgatatgtacgaatggtgtagtacgtggtggtggtgcgtattatttaatatcgcgttcgctaggtccggaatttggtggttcgataggtttaatatttgcgtttgcgaatgcggtagcggtagcgatgtatgtagtaggttttgcggaaacggttgttgatttattaaaagaatcggattcgatgatggtagatccgacgaatgatatacgaataataggttcgataacggtagtaatattactaggtatatcggtagcgggtatggaatgggaagcgaaagcgcaagttatactactagtaatactattaatagcgatagcgaatttttttataggtacggtaataccgtcgaataatgaaaaaaaatcgcgtggtttttttaattatcaagcgtcgatatttgcggaaaattttggtccgcgatttacgaaaggtgaaggttttttttcggtatttgcgatattttttccggcggcgacgggtatattagcgggtgcgaatatatcgggtgatctagaagatccgcaagatgcgataccgcgtggtacgatgctagcgatatttataacgacggtagcgtatttaggtgttgcgatatgtgtaggtgcgtgtgtagtacgagatgcgacgggtaatatgaatgatacgataatatcgggtatgaattgtaatggttcggcggcgtgtggtttaggttatgatttttcgcgatgtcgtcatgaaccgtgtcaatatggtttaatgaataattttcaagttatgtcgatggtatcgggttttggtccgctaataacggcgggtatattttcggcgacgttatcgtcggcgttagcgtcgttagtatcggcgccgaaagtatttcaagcgttatgtaaagataatatatataaagcgctacaattttttgcgaaaggttatggtaaaaataatgaaccgttacgtggttatatactaacgtttctaatagcgatggcgtttatattaatagcggaattaaatacgatagcgccgataatatcgaatttttttctagcgtcgtatgcgctaataaatttttcgtgttttcatgcgtcgtatgcgaaatcgccgggttggcgtccggcgtatggtatatataatatgtgggtatcgctatttggtgcggtattatgttgtgcggtaatgtttgttataaattggtgggcggcggtaataacgtatgtaatagaattttttctatatgtatatgtaacgtgtaaaaaaccggatgttaattggggttcgtcgacgcaagcgttatcgtatgtatcggcgttagataatgcgttagaactaacgacggtagaagatcatgttaaaaattttcgtccgcaatgtatagttctaacgggtggtccgatgacgcgaccggcgttattagatataacgcatgcgtttacgaaaaattcgggtctatgtatatgttgtgaagtatttgtaggtccgcgtaaactatgtgtaaaagaaatgaattcgggtatggcgaaaaaacaagcgtggctaataaaaaataaaataaaagcgttttatgcggcggtagcggcggattgttttcgagatggtgtacgttcgctactacaagcgtcgggtttaggtcgaatgaaaccgaatacgctagtaataggttataaaaaaaattggcgtaaagcgccgctaacggaaatagaaaattatgtaggtataatacatgatgcgtttgattttgaaataggtgtagttatagttcgtatatcgcaaggttttgatatatcgcaagtactacaagttcaagaagaactagaacgtttagaacaagaacgactagcgttagaagcgacgataaaagataatgaatgtgaagaagaatcgggtggtatacgaggtttatttaaaaaagcgggtaaactaaatataacgaaaacgacgccgaaaaaagatggttcgataaatacgtcgcaatcgatgcatgttggtgaatttaatcaaaaattagttgaagcgtcgacgcaatttaaaaaaaaacaagaaaaaggtacgatagatgtttggtggctatttgatgatggtggtttaacgttactaataccgtatatattaacgctacgtaaaaaatggaaagattgtaaattacgaatatatgtaggtggtaaaataaatcgtatagaagaagaaaaaatagtaatggcgtcgttattatcgaaatttcgtataaaatttgcggatatacatataataggtgatataaatatacgaccgaataaagaatcgtggaaagtttttgaagaaatgatagaaccgtatcgtttacatgaatcgtgtaaagatctaacgacggcggaaaaattaaaacgtgaaacgccgtggaaaataacggatgcggaattagaagcggtaaaagaaaaatcgtatcgacaagttcgtctaaatgaattattacaagaacattcgcgagcggcgaatctaatagtactatcgctaccggttgcgcgaaaaggttcgatatcggatctattatatatggcgtggttagaaatattaacgaaaaatctaccgccggttttattagttcgtggtaatcataaaaatgtattaacgttttattcg

SEQ ID NO: 251158 - DNA, 1476 bp, Artificial Sequence
  Description of Artificial Sequence: Synthetic coding sequence
atggagccgtcgtcaaagaagctgactggacggctgatgctcgcagtcggtggagctgtgcttggctcgttgcaattcggatacaatacgggggttatcaatgcgcctcagaaagtcattgaagaattctacaaccagacttgggttcaccgttacggagagtccatcctcccaaccactctgaccaccctctggtcgctcagcgtggcgatcttcagtgttggcgggatgatcgggtcgttttcggtcggactctttgtgaaccgcttcggacggaggaactcaatgcttatgatgaatctgctggcgtttgtgtcggcggtcctgatggggttctcaaaactcggcaagtccttcgaaatgctgattctggggcggtttatcatcggggtgtactgcggcctgactaccggatttgtgcctatgtacgttggcgaagtctcaccaaccgcactgagaggagccctcggaaccctccatcagttgggaattgttgttggaatcctgattgcgcaagtgttcggactggactcgatcatgggtaacaaagacctgtggccgctgctcctcagcatcatctttatccctgcgctgctgcaatgcattgtcctgcctttctgcccggaatccccgcggttcctgcttatcaacagaaatgaagaaaaccgcgccaagtccgtgctcaaaaagctgcgagggacggcggatgtgactcacgacttgcaggaaatgaaggaggagagccggcagatgatgagggagaagaaggtgaccatcttggaacttttcaggtcaccggcctatcgacagccgatcctgatcgccgtggtcctgcaattgtcgcagcaactcagcggtatcaacgcagtgttctattactcgaccagcatcttcgaaaaagcgggggtgcagcagccagtgtacgctaccattggaagcggaatcgtgaacactgccttcaccgtggtgtcgctgttcgtggtcgaacgggcaggcagacggaccttgcacctgatcgggttggctggtatggctggatgcgctatcctgatgaccatcgccctggctctgctggagcagctcccttggatgtcgtacctgtcaatagtcgctattttcggattcgtggccttcttcgaagtgggaccgggaccaatcccttggttcattgtggcggaattgtttagccaaggaccgcgcccagcggccatcgcggtggcaggattcagcaattggacttcaaacttcatcgtgggaatgtgcttccaatacgtcgaacagctgtgtggaccgtacgtctttatcattttcacggtgctcctggtgttgttctttatctttacctacttcaaggttcctgagactaaaggccggactttcgatgaaatcgcttcgggtttccggcagggcggcgcgtcacagagcgataagaccccagaggagctctttcatccgctcggagcggattcccaagtg

SEQ ID NO: 251159 - DNA, 1476 bp, Artificial Sequence
  Description of Artificial Sequence: Synthetic coding sequence
atggaaccgtcttctaagaaactgactggtaggctgatgctagccgtggggggcgccgttctcggatcattgcagttcggatacaacaccggggtgattaatgcgccacaaaaggtgatagaggagttctataatcagacgtgggtccaccgctatggagaatccatattgcctaccacactgactacactgtggagtctgtcagttgccattttctccgtaggaggcatgattggctctttcagcgttgggctattcgtcaatcgcttcggtcgacgcaattccatgcttatgatgaaccttttggcctttgtgtcggctgtcctcatgggctttagtaagctggggaagagtttcgagatgctcatcttagggcggtttatcatcggagtttactgtggcctcaccactggtttcgtgcctatgtatgttggcgaggtttccccaactgcactgaggggagcgctcggcacactccaccagctgggaatcgtcgttgggattctgattgcccaggtctttggcctggactccatcatgggaaacaaggacctttggccactccttctcagcattatcttcatcccagctttactacaatgtatcgtactacccttttgtcctgagagccctcgattcctactgataaaccgtaatgaggaaaatcgggccaaatcagtgttgaagaagttgagggggactgcagacgttacccacgatcttcaggagatgaaagaggagagcagacagatgatgcgtgaaaaaaaggtcactatcctggagctgttccgcagcccagcatatcggcagcctatcttgatcgccgttgtcttgcaactctctcagcagttatccgggatcaatgccgtgttttattattctacatctatatttgaaaaagctggggtccagcaacctgtatacgcaaccatcggcagtggtatcgtaaataccgccttcacggtagtttccttattcgtcgtcgagcgtgctgggcgcaggacactgcaccttataggcctagccggcatggctgggtgcgctatcctgatgaccattgctcttgcgttgttggagcaactgccctggatgtcatatctgagtatcgtagccattttcgggttcgtggcgttttttgaagtcggacccggccctatcccatggttcatcgtggccgaattattctctcaaggcccccgtcctgccgctattgcagtggcgggtttctcaaactggaccagcaacttcatcgttggaatgtgtttccagtacgtggagcagctctgcggaccatacgtgtttataatctttactgtgttgctggtgctgttctttatctttacctactttaaagtacccgaaactaagggccgcaccttcgacgagatcgccagtggttttcgccaaggtggcgcaagccagagcgacaagacacccgaagaactcttccatcctctgggagcagattcgcaggtc

SEQ ID NO: 251160 - DNA, 1476 bp, Artificial Sequence
  Description of Artificial Sequence: Synthetic coding sequence
atggagccttcctcaaaaaagttgactggaagactcatgcttgctgtcggcggggccgtgctgggcagtctacagttcggttataataccggagtcatcaatgccccacagaaagttattgaagagttctacaaccagacttgggtacaccgatatggcgaaagcattcttcctacgactctcacgactttgtggagcctctcagtggcaatcttttctgttggcggtatgataggaagcttttctgtgggtctgtttgtcaaccgctttggcagacgcaattcaatgctgatgatgaacctgcttgcttttgtatcggccgtcctgatggggttcagcaagctcggcaagtcttttgagatgctgatcctagggagattcatcataggggtctactgcggtcttaccacaggcttcgtccccatgtacgtgggggaagtgtccccaactgccttgaggggagccctcggcaccctgcaccaactcggaatagtggtcggcattctgattgctcaggtgttcggcctggactcaattatggggaataaggacctttggcccctgctactgtctattattttcattcctgctctgctgcagtgcatcgtgttgcccttttgcccagagagcccgcgattcctactgataaatcgcaacgaggaaaaccgcgccaagagtgtgctcaagaaactacgcggtacggcagacgtgacgcatgatttgcaggagatgaaagaagagtcccggcaaatgatgcgcgaaaaaaaagtgacgattcttgagctgttccgttctcccgcctataggcagcctattctgatagctgtggttctgcagcttagtcagcaactctctgggattaatgcggtcttctactactcgacctctatattcgagaaggcgggagtgcagcagccagtgtatgcgactatcggatccggcatcgttaatactgcatttactgttgtaagtctgttcgttgtagagagagccggccgaaggacactgcatctgatcggccttgctgggatggcaggttgtgctattcttatgacaattgcgttggctctgctggaacagttgccgtggatgtcttatttgagcatcgttgcgatttttggatttgtggcattctttgaggtcgggccgggcccgattccttggtttattgttgccgagctgtttagtcagggaccacgtcctgccgccatcgctgtggctggcttctctaactggacgtctaactttattgttggtatgtgctttcagtatgtggaacagctgtgcggcccgtacgtgttcatcattttcacggtcctgctcgtgttgtttttcatctttacctatttcaaagttccagagaccaagggaaggacatttgacgagatcgccagcggcttcagacaggggggagccagtcagtccgataaaaccccagaagaactatttcaccctttaggcgcagacagtcaggtg

SEQ ID NO: 251161 - DNA, 1476 bp, Artificial Sequence
  Description of Artificial Sequence: Synthetic coding sequence
atggagccaagttcgaaaaagcttacgggaaggctaatgctggccgtcggcggagccgtgctgggaagtctgcaattcggctataacaccggcgtgattaacgccccgcagaaggtgatcgaggagttctacaaccaaacctgggtgcaccgctacggcgagtctatactccccacgaccctgaccacgctgtggtccctctcggtggccatcttcagcgttggaggtatgatcggaagtttttcggtgggtctgttcgtgaataggtttggacgtcgcaactccatgctgatgatgaacctgctggcatttgtctcggccgtactgatgggattcagtaagcttggcaagagcttcgaaatgctgatccttggtagatttataataggcgtgtactgcggattgaccacaggttttgtgccgatgtatgtgggcgaggtttcaccaacagcgctgcgcggcgcccttggcacactccatcaattaggcatcgtagttggtatccttattgcgcaggtgtttggtctagacagtataatgggcaataaggatctctggcccctgctgctaagcatcatttttatcccagcactattgcagtgcattgtactgcctttctgccccgagtcaccaagattcctactgatcaatcgcaatgaggaaaatagggccaagagcgttctcaagaagctccgcggaaccgccgatgtcacacatgacctccaggagatgaaggaagagtcgcgccaaatgatgcgcgagaagaaagtaaccatcttggagctgtttaggtcgccggcctacagacagcctatcctgattgcagttgttctgcagctgtctcagcaactgtcaggcattaacgcagtgttctattattccacatcgatcttcgagaaagccggagtgcagcagcccgtgtacgcaacgattggcagcggcatagtgaacacagcatttaccgtcgtgagcctcttcgtggttgaacgcgccggccggcggacactgcatttgataggactggccggcatggccggatgcgccatcctgatgaccatcgcgttagccctgctagagcaactgccatggatgtcgtatctgtccattgttgccatcttcggctttgttgcgttttttgaggtcggcccaggtcccatcccctggtttatcgtcgcggagctatttagtcagggaccacgaccagctgcgattgctgtcgcgggcttctcaaactggacttccaattttatcgtgggcatgtgtttccagtatgtggagcaattgtgcggaccctacgtattcatcatattcactgttttactggtactgtttttcatattcacttacttcaaggtgccagaaacgaagggccgtacgttcgatgaaattgcctcgggatttcggcagggaggagcatcccagtccgacaagacgcctgaggagttgttccatcctcttggagccgacagccaggta

SEQ ID NO: 251162 - DNA, 1476 bp, Artificial Sequence
  Description of Artificial Sequence: Synthetic coding sequence
atggagccctcgtcgaagaagttgactggacgacttatgctggcagtgggaggagccgtgcttggatcacttcagttcggctacaacaccggggtcatcaatgcacctcaaaaggtgatcgaagagttttacaaccaaacttgggttcaccgatacggagaaagcatccttccgaccaccttgaccactctgtggagcctttcagttgcgatcttttccgtggggggaatgattggatcattttcggttggactttttgtcaacagatttggtaggcgaaactcgatgctgatgatgaatcttctggcattcgtgtcggctgtgctgatgggtttttccaagctcggcaaatcgtttgaaatgcttatcctgggccgcttcataattggtgtgtactgcgggcttactactgggttcgtcccaatgtacgtcggcgaggtcagcccaactgcgctgcgcggagcactgggcacccttcatcagctgggaatcgtcgtgggaattctgatagcacaagtgtttggccttgactccattatgggtaacaaagacctgtggccgctgcttctcagcattatctttatacctgcactgctgcagtgtatcgtgcttcccttttgtcccgaatcgccccggttcctgctcattaaccgcaatgaggagaaccgcgctaagagcgtcctgaaaaaactgaggggtaccgccgacgtgacccacgatcttcaggaaatgaaggaggaatcccggcaaatgatgcgggaaaagaaagtcaccattctcgagctgtttagatcgccagcatacagacagcctatccttattgcggtggtcctccagctttcgcaacaactgtcgggaatcaatgcagtcttttactactcgacttccatcttcgaaaaggcaggcgtgcaacagccagtatacgccaccataggatcgggcatcgttaacaccgcctttacggtggtgtcgctgtttgtggtggaaagagcaggtagacggacccttcacttgatcggactcgctggtatggcaggatgtgcaattctcatgactatcgccttggcgctgcttgaacaactgccttggatgtcctacctgagcattgtcgcaatctttggttttgtcgccttcttcgaagtgggacctggacctattccatggttcatagtggcagaactgttttcccaggggcctcgcccagcagctattgctgtggccggtttttcaaactggacttcgaatttcattgtgggaatgtgttttcaatacgtggaacaactttgcggaccttacgtctttatcatctttaccgtgctccttgtcctgtttttcatctttacttactttaaggtccctgagactaaaggtagaactttcgatgagattgcaagcggatttagacaggggggcgcgtcacaatctgataagactcctgaagaactgttccacccccttggcgcagattcccaagtc

SEQ ID NO: 251163 - DNA, 1476 bp, Artificial Sequence
  Description of Artificial Sequence: Synthetic coding sequence
atggagcccagttcaaaaaaactgactggtagacttatgctggccgtgggcggggcagtgctgggcagcctgcagttcggatacaatacaggggtgatcaacgcaccacagaaagtgattgaagagttttacaatcaaacatgggttcatcgatatggagagtccattctaccaacaacgctaaccactctctggtccctatcagtcgccattttttcagttggaggaatgattgggtccttttcagtgggactgtttgtaaaccgctttgggcgccgcaacagcatgctgatgatgaacctcttagcgttcgtttcagccgtactaatgggctttagtaagttgggaaaatcattcgaaatgctaatattgggaaggttcattattggagtgtattgcggtctgaccactgggttcgtgccaatgtatgtaggagaagtatctccaacagcccttagaggtgcgctcggcacattgcaccagttaggaattgtggtaggcatcctgatagctcaggtctttgggctggactctattatgggcaacaaagacctgtggccattgcttctatccataatttttatcccggccctgttgcaatgtatcgtcttacctttctgcccagaatcccctcgttttctgttgattaacaggaacgaggagaacagggccaagagcgtgctcaagaaactgcgtggaacagcagacgttacccacgacctgcaggagatgaaggaggagagtcggcagatgatgcgcgagaaaaaagtgacaatcttggagctgtttcgctcgcccgcatatcgccagccgatcctcatcgccgttgtccttcaacttagccagcagctcagcggaatcaatgctgttttttattactccacctcaattttcgagaaagctggggtacagcagcccgtgtatgctactatcggaagtggcattgtcaacaccgccttcaccgtcgtctccctgttcgttgttgagcgggcaggcaggcgcactctgcacttgattggcctggccggcatggcaggctgtgccattctgatgacaatcgcattggcactgctagagcagctcccatggatgtcctacttgtctattgttgccatctttggcttcgtagcgtttttcgaggtcggccccggaccaatcccgtggttcatcgttgctgaattattcagccagggtccaaggcccgcggcaattgctgtagccgggttctctaattggacctccaacttcattgttggtatgtgtttccaatatgtcgaacagctttgtggtccttacgtgttcatcatatttacggtgctgctggttctcttctttatattcacatatttcaaagtgcctgagaccaagggccgcacctttgacgagatagcctctgggttccgacaggggggcgcttcccagtccgacaaaacgcctgaggagttgtttcacccgcttggggcagactcacaggtg

SEQ ID NO: 251164 - DNA, 1476 bp, Artificial Sequence
  Description of Artificial Sequence: Synthetic coding sequence
atggaaccaagcagcaagaagctcaccggccgcctgatgctggcagtgggtggtgcggtgcttggttcgctgcagtttggatacaacactggtgttatcaacgcccctcagaaggtgatagaggagttttacaaccaaacttgggtgcatcgctacggagaatcgatacttccaacgaccctcactactctgtggtcgctgtccgtggctatcttctcagtcggtgggatgatcggatccttctcggtgggactgttcgtgaatcggtttggtagacgaaactctatgcttatgatgaacctgcttgcattcgtctccgcagtccttatggggttttccaaactcggaaagtcctttgagatgctgatcctcggtaggttcattatcggagtgtactgtggactgactaccggattcgtccctatgtacgtcggggaagttagcccgactgcgctgcgcggggcactgggaactctgcatcaacttggtattgttgtgggtattcttattgcacaagtgttcggtcttgattcgattatgggtaacaaggatctgtggccccttcttctttcaatcatctttatcccagctctcctccaatgtattgtgcttccgttttgtcccgagtcgcctagatttctgctcatcaacaggaatgaagaaaatcgagcgaagtccgtgcttaagaaacttagaggaaccgcagatgtgactcatgacctccaagagatgaaagaagaatcgagacaaatgatgagagaaaagaaggtgacgatacttgagctgtttcgctcgcccgcataccgacagcctattttgattgctgtggtcctccaactgtcccagcagctctcaggaatcaacgcagtgttttactattccacctcgatctttgagaaagcaggtgtccaacaacctgtgtacgcaactattggttcggggattgtcaatactgccttcactgtcgtctcccttttcgtggtggaacgcgcaggtaggagaacccttcatcttattggactggctggaatggcaggatgtgcaatccttatgaccatcgcacttgcactgctcgaacaactgccttggatgtcataccttagcattgtggcaatctttggttttgtggcgttcttcgaagtcggacctgggcccataccttggtttatcgtcgcagagctgttttcacagggaccccgtccggcagcaatcgcagtcgcaggattctcgaactggactagcaactttatagtgggaatgtgttttcagtacgtggagcagctgtgcggtccatacgtgttcatcattttcactgtgcttctggtgctgttctttatctttacctactttaaggtgcctgaaactaagggccgaacctttgatgaaattgcgtcgggattcagacaaggaggagcatcccagtccgacaaaacccctgaagaacttttccaccctctcggcgcagactcacaggtc

SEQ ID NO: 251165 - DNA, 1476 bp, Artificial Sequence
  Description of Artificial Sequence: Synthetic coding sequence
atggagcctagctccaaaaagctgaccggtaggcttatgctggcagtgggcggggcagtcctgggctcactgcagtttggctacaataccggggtgattaacgcaccccaaaaggttattgaagaattctataatcaaacttgggtgcatcggtacggcgagagcattcttcctactaccctgactactctgtggtcgctgagcgtggccattttctcagtgggcggtatgataggatcgttctcggtcgggttgtttgtgaatcgattcggacgaaggaatagcatgctgatgatgaacctgttggcatttgtgtccgcggtcctgatgggtttttccaagctgggcaagtcctttgaaatgctgatccttggacgcttcattataggcgtctactgcggtcttaccacgggatttgtcccgatgtacgtgggagaagtgtcaccgacggcactccgtggagcccttggaactctccatcagctgggtatagtggtgggaattcttattgcacaagtctttggactggattcgataatggggaataaggacctgtggccacttcttctgtcaattatctttatcccagcgcttctgcagtgtatcgtccttcctttttgccccgagtccccacgattccttctgattaacaggaacgaggaaaacagagcaaagtccgtccttaagaagctgaggggtactgcagatgtgactcacgaccttcaagaaatgaaggaagaatccagacagatgatgcgggaaaagaaagtcactattctcgaactctttaggtcccctgcctacagacaacccatcctcattgccgtggtcctgcagctgtcacagcagctgtccggtattaacgctgtgttttactactccacctcgatttttgagaaggcaggggtgcagcaacctgtctacgccactatcggttcgggcatagtgaacaccgcttttaccgtcgtctcgctgtttgtggtggagagagcagggcgccgtactcttcacctcattggtttggctgggatggcgggttgtgcaatccttatgaccattgctcttgcacttcttgagcagcttccttggatgtcctatctgtcgattgtggcaattttcggatttgtggccttctttgaagtgggacctggaccaatcccgtggtttattgtggcagagctgttctcccaaggacctagacctgctgcaatagcagtggcaggattttctaactggacttcaaactttattgtcggaatgtgtttccaatacgtggagcagctttgtggaccttacgtgtttatcatcttcaccgtgctcttggtcttgtttttcatctttacctactttaaagttcctgaaaccaaagggcgcaccttcgatgaaattgcatcggggttcagacagggtggcgcatcacaaagcgacaagacgcctgaggaactctttcacccactgggagcagattcccaagtg

SEQ ID NO: 251166 - DNA, 1476 bp, Artificial Sequence
  Description of Artificial Sequence: Synthetic coding sequence
atggagccttcgagcaaaaagctgaccgggagactgatgttggcagtgggcggagcagtgctggggtccctacagtttggctacaatacgggtgtgattaacgccccgcagaaagtcatcgaggaattttataaccagacttgggtgcaccgctacggggaatccattctccctacaacgttgaccaccttgtggagcctgagcgtggcaattttcagtgtcggcggcatgatcggtagcttctctgtgggtctcttcgtgaataggtttggtcgcaggaacagcatgctgatgatgaacctgctggccttcgtgtccgcagtgctcatggggttctccaagttggggaaaagtttcgagatgctgatccttggccgcttcatcatcggcgtgtactgcggcctgaccactggattcgtccctatgtacgtcggagaggtgagcccaactgcgctgcgcggcgccctgggcactctgcatcagctgggcattgttgtgggtatcctcatcgcgcaagtcttcggactcgactcgattatgggcaacaaggacctctggccattgctgttatcgattatcttcatcccggcactcctgcagtgtattgttttaccattttgcccggaatccccacgatttctgctgatcaaccgcaacgaggagaatcgcgccaagtccgtgttaaaaaagcttcgcggtaccgctgacgttacccatgacctccaggaaatgaaggaggagtcccgccaaatgatgagggagaaaaaggtgaccattctggagttgttccggagcccggcctatcgccagcctatcctgattgctgtggtactgcaactgtcgcaacaactgagcggcattaacgcagtcttctactacagtacctccatcttcgaaaaagccggcgttcagcaaccggtctatgccactattggcagcgggattgttaacacggccttcactgtggtcagcttgtttgtggtcgagcgcgcggggcgccgcacccttcatctgataggcttggctggtatggcaggttgcgccattttaatgacgattgctttggccctgttggagcagctgccttggatgtcatatctgagcatcgtcgccatatttgggttcgtggctttctttgaggttggccccggaccaatcccgtggttcatcgtcgcggaattgttctcccaaggacctcgcccggcagcgatcgcagttgccggtttctctaattggacgtccaactttatcgttggcatgtgtttccagtacgtggaacaactctgcggcccgtatgtgtttattatcttcactgtgctcctggtgttgttcttcatttttacctactttaaggtaccagagacgaagggccgcaccttcgatgagattgctagcggattcaggcagggcggagcttcccagagcgataagacccctgaggaactgttccatcctctgggcgcggattcccaggtg

SEQ ID NO: 251167 - DNA, 1476 bp, Artificial Sequence
  Description of Artificial Sequence: Synthetic coding sequence
atggaaccttcgtcaaaaaagctgaccggtcgtttgatgctggcggtcggtggtgccgtgctggggtcgcttcagtttgggtacaacactggtgtgattaacgcaccccagaaggtcattgaagagttttacaaccagacgtgggtccacagatatggcgaaagcattctgcccaccactctcacgactctctggtcactttccgtggcaatcttttcggtcggtggtatgatcggtagcttttctgtgggcctgttcgtgaatagatttggtagacgaaattccatgctgatgatgaacctcctggccttcgtgtcggcagtcctgatgggcttctcaaagctgggaaagtcgttcgaaatgctgattctgggtcgttttatcataggagtgtactgtggacttaccacgggctttgtcccaatgtacgttggagaggtgtctcctactgcgcttcgcggggcactgggaaccctgcaccagctcggcatcgtggtgggaatcctgattgcccaagtgttcggtttggacagcattatgggcaacaaggacctgtggcctcttcttctgtcgatcatattcatccctgcacttctgcagtgtatcgtcctgccattttgccctgaaagcccaaggttcctgctcattaaccggaatgaagagaacagggcaaaatcagtgttgaagaaactccggggaactgccgatgtcactcatgaccttcaggaaatgaaagaagaatctcgtcagatgatgcgcgagaagaaggtcaccattctcgaactcttccgctcgccagcatacaggcaacccattctcattgctgtggtgcttcaactgtcccaacagctttccggcatcaatgcagtgttttactactccacttccattttcgagaaggctggagtgcaacaaccagtctacgcaaccatcggaagtgggatagtgaacaccgctttcactgtggtgtcactgttcgtggtggaacgggccggacgacgtacccttcatcttattggactggccggtatggcaggttgcgcaattctgatgaccattgccctggcgctcctcgaacaacttccatggatgtcatacttgtcaattgtggcaattttcggatttgtggccttttttgaagtgggacctggaccgattccatggttcattgtggccgaacttttttctcagggaccccgtcccgccgctatcgctgtcgccggtttttcgaattggacgtcgaacttcatcgtcggcatgtgctttcaatacgtggaacagctttgtggaccctacgtgttcataatcttcactgtcctgctggtgctgtttttcatcttcacctacttcaaggtcccagaaactaagggaagaaccttcgatgagatcgcttcggggtttcgtcagggtggagcatcgcaatccgacaaaacccctgaggaactctttcaccctcttggggcagatagccaagtg

SEQ ID NO: 251168 - DNA, 1476 bp, Artificial Sequence
  Description of Artificial Sequence: Synthetic coding sequence
atggagccctctagtaagaagctcaccggccgtttgatgctggcagttggcggtgcagtactgggttccttgcagttcggttacaataccggcgtgataaacgctccccaaaaagtgatcgaggaattctataatcagacctgggtccaccgctatggagagtccattctgccaactactctgacaactctctggtccctttccgtggctatattttctgtgggtggaatgattggatcattcagcgttggcctcttcgtaaacaggtttggccgccgcaattctatgctgatgatgaatcttctcgctttcgtctccgctgtcctcatgggattcagcaaactcggaaagtcattcgagatgcttatcctgggcagatttatcattggcgtgtattgtggacttaccacaggtttcgttccaatgtacgttggcgaggtctctcccaccgccctgaggggagctctcggcacacttcaccagcttggaattgtcgtgggtatcctgattgctcaagtgttcggacttgacagtattatgggaaacaaggatctttggccactgcttctcagcatcatctttatccctgccttgttgcagtgcattgttttgcccttctgccccgagtcacccagattcctgttgatcaacaggaacgaggagaaccgtgctaagtcagtacttaagaagctgaggggcactgccgacgtgacccatgacctgcaggaaatgaaagaggagagtaggcagatgatgagggaaaagaaggtcacaatactggaactcttcaggagtcctgcttaccgccaacccatacttatcgccgtggtactgcagctcagtcaacagctgtccggcattaatgcagttttctattacagcacatctatctttgaaaaggccggagttcaacagcccgtgtacgctacaatcggatccggcatcgtgaacaccgctttcactgtcgtgtctctcttcgtggtcgagcgtgctggtaggcgtactctgcacttgatcggactggctggtatggccggctgcgccatcttgatgaccatcgctttggcattgttggagcaactcccttggatgtcttatctctcaatagtggctatctttggcttcgttgccttcttcgaggtgggacccggaccaattccctggttcattgtagcagaattgtttagtcaaggtccacgcccagctgctattgccgttgctggtttttcaaactggacatctaattttattgtaggaatgtgcttccagtacgtggagcagctgtgcggaccatatgttttcatcatttttactgtcttgctggtgctctttttcatcttcacatacttcaaggtacccgaaactaaaggcaggacattcgatgagatcgcatcaggttttcgccaaggtggcgctagccaatcagacaaaactccagaagaactgtttcatcctcttggcgccgacagccaagtt

SEQ ID NO: 251169 - DNA, 1476 bp, Artificial Sequence
  Description of Artificial Sequence: Synthetic coding sequence
atggagccttcaagcaagaaacttaccggacggctcatgttggcggtgggaggagccgtcctgggctccctccagtttggatacaacacgggcgtgatcaatgccccccagaaggtgatcgaagagttttacaaccaaacttgggtgcaccgctacggagagtcaattcttcctaccacccttaccaccctctggtccctctcggtcgcaatcttctcagtgggaggaatgattggttcattctccgtgggcctgttcgtcaaccgcttcggcaggaggaactcaatgctgatgatgaatcttctcgccttcgtgtctgcggtgctcatgggattctccaagctgggcaaatccttcgaaatgctgatccttgggagatttatcattggagtgtactgtggcctgaccactggcttcgtgcctatgtatgtgggcgaagtctcaccgaccgccctgcgcggggccctgggaaccctccaccagttgggaatcgtcgtgggaattctcatcgctcaagtgttcggacttgactccattatgggaaacaaagacttgtggccactgttgctctcgatcatcttcattcctgccctgctccagtgtattgtgctgcctttctgccccgaatcgccgcggttcctgctgatcaaccggaacgaggaaaatcgcgccaagtcagtgctgaagaaactccgggggaccgcagatgtcactcatgacctccaggaaatgaaggaagaatcgcggcaaatgatgcgggaaaagaaagttaccattctcgagctgttccgttccccagcctaccgccagccaattcttatcgcggtggtcctccagctgtcgcagcagctgtcgggtatcaacgctgtgttctactattcgactagcatcttcgagaaggccggggtccaacaaccagtctacgctactattggttctggaatcgtgaataccgcatttaccgtggtgtcgctgtttgtggtggaacgcgccggccgacggaccctccatttgatcggattggccggcatggcgggctgcgcaatccttatgaccatcgcactcgcactgttggagcaactcccgtggatgagctacctttcaatcgttgcaatcttcgggttcgtggcgttctttgaggtgggcccgggaccaatcccgtggttcatcgtcgctgaactgttttcacagggcccgcgtcccgctgccatcgcggtggccggctttagcaattggacttcgaacttcattgtgggtatgtgcttccaatacgtcgagcagctgtgcggcccctacgtgttcatcattttcacggttctcctggtcctgttcttcatcttcacgtactttaaggtgcctgaaaccaagggaagaaccttcgacgaaatcgcctccggcttccgccagggaggagcctcacagtcggataaaaccccagaggagcttttccaccctctgggcgccgattcgcaagtg

SEQ ID NO: 251170 - DNA, 1476 bp, Artificial Sequence
  Description of Artificial Sequence: Synthetic coding sequence
atggagcccagcagtaagaagctgacaggcagacttatgctagccgtgggcggcgctgtgttgggcagtctgcagtttggctataacaccggcgtcattaacgcaccacagaaagtgattgaggagttctacaaccagacctgggtgcacagatacggcgagtccattctgcccactactcttacaacactgtggagtctatctgtagctattttctccgttggcgggatgatagggagtttctccgtgggcctgttcgtgaatcgcttcggaagacgtaattcaatgctcatgatgaacctgttggcatttgtctctgccgtgctgatgggctttagcaaactgggcaaatccttcgaaatgctgatccttgggcggtttataataggcgtgtattgcggcctgaccacaggatttgttcccatgtacgttggggaagtgtccccaaccgctctccgcggcgcactgggtacactccaccagctgggaattgtcgtcggcatcctgatcgcgcaggtatttgggctggactctatcatgggcaataaggacctttggcctctccttctgtccattattttcatcccggcccttctacagtgtattgtgttgcccttttgtccagagtcaccgaggtttctattgattaatcgcaatgaggagaaccgggcaaagtcagttctgaaaaaactgcgcggtaccgcagatgtgacccatgacctacaagaaatgaaggaggaaagcagacaaatgatgcgggaaaagaaggtcaccatactggagttgttccgcagccccgcttaccggcagcctattcttatcgctgtggtccttcagctttcacagcagctctctggcattaatgccgttttctattactctacctccatctttgagaaggcgggcgtccagcagcctgtctacgccaccatcggatccggcattgttaacactgccttcacggttgtgtccctgtttgttgtggaaagagccggcagacgtaccctgcatttaattggcctggccggtatggccggttgtgctattctgatgacaatcgccctggccctactggagcagctgccatggatgtcctacctgtcgatcgtggctatcttcggattcgtggccttcttcgaagtgggtcctggacctatcccctggttcattgtggcagaactcttctcccagggaccacgaccagcagccatagccgtagcaggattctctaactggacgtctaatttcatcgtagggatgtgtttccagtacgttgagcagttatgcgggccctacgtgttcataatcttcacagttctgttagtgttgttcttcatctttacatatttcaaagtgcccgagacgaaggggcgcacatttgacgaaattgcttctgggttccgccaggggggcgcctctcagagcgataagactcccgaggagctcttccatcctctgggagccgattctcaggtg

SEQ ID NO: 251171 - DNA, 1476 bp, Artificial Sequence
  Description of Artificial Sequence: Synthetic coding sequence
atggagcctagcagcaagaagctcacagggagattaatgctggctgtcggtggcgccgtgcttggatcactccagttcgggtataacaccggcgttatcaatgcaccgcaaaaagtcatcgaggaattttataatcagacttgggtacatcgttacggggagagcatcctgccaacgaccctcacgacgctttggtctctttcggttgcaattttctcagtgggcggcatgatcggctccttttctgtcggcctattcgttaaccgttttggaagaagaaactcaatgcttatgatgaatctactagcttttgtcagtgctgtcctgatgggattctccaagctggggaagagtttcgagatgctcatcttaggacgttttattattggagtgtattgcggcctcaccactggattcgtccctatgtacgtaggagaagttagtccgactgctctccgcggggccctgggaacactgcaccagcttggcattgtggtggggattttgatcgcacaggtgtttgggttagactccatcatgggtaacaaagatttgtggccactgcttctgagcattatttttataccagcattgctgcagtgtatagttctaccgttctgtcccgaaagcccacgctttttgctcataaataggaacgaggagaacagagcaaagtccgtgctcaaaaagttaagaggaacggctgacgtgacacatgatctccaggagatgaaagaggagtccagacagatgatgcgggagaaaaaggtaaccattcttgaactgtttagaagtccagcatacaggcagcccatattgatagctgttgtactgcagctgtctcagcagctatctggcattaacgccgtgttctattactctacctctatctttgaaaaggctggggtgcagcagcccgtttacgccacaataggaagcggcatcgttaacaccgcttttacagttgtgtccctattcgtcgtcgaacgggctgggcgcagaaccctgcacctgattgggttagctggaatggctggatgcgctatcctgatgacgatagccctggcacttctggaacagctgccatggatgagctatcttagtatagtggccatcttcggcttcgtagctttttttgaagtcgggcctgggccaatcccctggttcatcgtggccgaactgttttctcagggcccccggccagcagccattgccgtggcgggcttttccaactggacgtcaaactttatcgttgggatgtgctttcagtacgttgagcaactgtgcgggccatatgtattcattatctttacagttctattggtgttgttttttatcttcacctacttcaaggtgccagagacgaagggtcggacatttgacgagattgcctctgggttcaggcagggcggggcctctcagtccgataagactcccgaagagctttttcaccctctgggggcagattcacaagtg

SEQ ID NO: 251172 - DNA, 1476 bp, Artificial Sequence
  Description of Artificial Sequence: Synthetic coding sequence
atggaacccagcagcaagaagctgacaggaaggctgatgctggctgtgggaggggctgtactgggctctttgcagttcgggtacaatacgggggtaatcaatgctccgcagaaagtcatcgaggaattctataaccaaacatgggtccacagatacggcgagagcatcctgcctaccacacttaccacactgtggagcctgtctgtagctatcttctcagtaggaggaatgatcggatcattttcagttggcctctttgtgaatcgttttggccggaggaatagcatgctgatgatgaatctcctcgcttttgtcagcgcagttctgatgggattcagcaagctgggaaaatcttttgaaatgttgattctgggccgattcattatcggcgtctattgcgggctaaccaccgggttcgttccaatgtatgtcggtgaggtcagccctactgcgcttaggggagccttggggaccctgcaccaactgggtatcgtggttggcatcctgattgcgcaggtattcggcctcgattccatcatgggaaacaaggacctctggcctttgctcctgtctatcatcttcattccagctctgctacagtgtatcgtgctacctttttgccctgagagcccaagatttcttcttatcaacaggaatgaggagaaccgcgctaagtctgtgttgaagaaactgaggggaacagccgatgtgacacatgacctccaagaaatgaaagaggaaagtcgccagatgatgcgtgaaaagaaggtaactattctggagttgttccgtagccctgcttatagacagccaatcctgatcgccgtcgtgctccagctgtctcaacagctttctggcataaacgccgtcttttattactcaacaagcatcttcgaaaaggcaggtgtgcagcaaccagtgtacgcaaccataggcagcggcattgtcaacacagctttcaccgtggtctctcttttcgtcgtggagcgcgcaggacggaggacactgcatcttatcggtctggctggaatggcaggatgcgcgatccttatgactattgcactcgcattgctggagcaacttccatggatgagttacctttccatagtggctatattcggcttcgtggccttctttgaggttggaccaggacccatcccatggtttatcgtcgctgaactttttagccaaggccccagacctgcagctatcgcagttgctggattctccaactggaccagcaattttatcgtcgggatgtgcttccagtatgtggaacaactctgtggaccctacgtctttatcatttttacagtgcttttagttctgttctttatcttcacttatttcaaagtgcccgaaaccaaggggcgtacctttgacgagatagcatccggatttaggcagggcggggctagtcaaagcgataagactccagaagaattgttccaccctcttggagctgattcccaggtc

SEQ ID NO: 251173 - DNA, 1476 bp, Artificial Sequence
  Description of Artificial Sequence: Synthetic coding sequence
atggaaccgtctagcaaaaagttaacgggacgcttgatgctggctgtcggcggagcggttttgggaagtcttcagttcggctacaacacgggtgtgatcaatgcgccacaaaaggtcattgaagagttttataatcagacctgggtacatagatatggagaatcaattcttccaacgacgctcacaacgctttggtctctgtctgtggcgattttttccgtcggaggaatgatcggatcctttagcgtgggcttatttgtcaatcggtttggacgcagaaattcaatgctgatgatgaatctgttggcgtttgtgtctgctgttttaatgggttttagcaaattgggtaaatccttcgagatgttgattcttggacgttttatcatcggcgtctactgcggacttacgacaggctttgtgccaatgtatgttggcgaggttagccccacggcccttcggggggcattgggcacgttacaccagttgggcattgttgtaggaatcctgatcgcgcaagtgttcgggcttgattcaatcatgggcaataaggatctgtggcctctccttctatccatcatttttatcccggctttactacagtgcattgtcctgccgttctgcccggaatcaccgcgttttctcttgatcaatcgaaatgaagagaacagagcaaaatcagtgttgaagaaacttcggggaacggcggacgtcacgcatgatcttcaagagatgaaggaagagtcccgtcaaatgatgcgagaaaaaaaagttactatcctcgaactttttcgtagcccagcttatcgtcaacccatattgatcgcggttgttctgcaactatcccaacaattgagtggaattaacgcggtgttttactattcaacatcgatttttgaaaaggcgggcgtgcagcagccagtgtatgccaccataggatcaggaatcgtcaatacagcatttacagtggttagcctcttcgtcgtcgagcgcgcaggccggagaacgcttcatttaattggattggctggaatggcaggttgtgctattttgatgactatcgcattagcattattggagcaactgccttggatgagctatttaagcattgtcgcgattttcggctttgtagctttttttgaggttggcccgggaccaattccgtggttcatagtagcggagttgttttcacagggtccgcggcccgcggcaattgcggttgcgggctttagcaattggacgtcaaattttatagtcggcatgtgcttccagtacgtggagcagttatgcggcccatatgtctttatcattttcaccgtgctgctggtcttattcttcattttcacgtattttaaagtaccggaaacgaaaggacgcacatttgacgagattgcttccggcttccgccagggcggcgcgtcacagagtgacaaaacgcctgaggaattgtttcacccgcttggagcggattcacaagtg

SEQ ID NO: 251174 - DNA, 1476 bp, Artificial Sequence
  Description of Artificial Sequence: Synthetic coding sequence
atggaacccagttccaagaagctcacggggagattgatgctggccgtaggcggggccgtactgggcagcttacagttcggctataataccggggtaataaacgccccccagaaagtgatcgaagagttttataatcagacctgggtccacagatatggggagtcgatattaccaactacccttacgacactctggagcttgagtgtggcaatctttagcgtcgggggtatgattggttctttcagtgtaggcttgttcgttaacaggttcggccggcgtaacagcatgctgatgatgaatttgctggcattcgtgtccgcagttttgatgggattcagtaaactagggaagtcctttgagatgctcattttgggcaggttcattatcggagtgtactgtgggcttaccacaggcttcgtccccatgtatgttggagaagttagcccaactgcattacgaggagcgctcgggactctgcaccagctgggaatagtagtgggcatcctgatcgcccaggtttttggactcgattccattatgggtaacaaggacctgtggcctctgctgttgagtatcatcttcattcctgcactgcttcagtgcatcgtgttgcctttctgccctgagtcccctagatttctgctgatcaacagaaacgaagaaaaccgagccaagtccgtcctgaaaaagctgagaggaaccgcggacgtcacacacgatttacaggaaatgaaggaggagagccggcagatgatgcgtgagaagaaggtgacaatcctcgagctgtttcgttccccagcatatcggcagcccattttaattgcggtcgttctgcagctgtctcagcagctgagtgggatcaatgccgtgttttattactcgacatcaatttttgaaaaggctggagtgcagcaaccagtgtacgctacaataggatctggaatagtcaacaccgcgttcacagttgtaagcttgttcgtcgtcgaacgggctggccggaggaccttgcaccttatagggctggcaggcatggctgggtgtgctattttgatgacaatcgcactcgcactgttagagcagctaccgtggatgtcatacctcagcattgttgccatctttgggttcgtcgcttttttcgaggtgggcccaggacctatcccatggtttattgttgcagaactgttttcacagggcccccggccagccgccatagccgttgctggtttctctaattggaccagtaattttatcgtgggtatgtgttttcaatatgtggaacagctgtgtggcccttatgtcttcattatctttaccgtgctcctggttctcttcttcatctttacatactttaaggtccccgaaaccaaaggccgcacattcgatgagatagcatcaggcttccgccagggcggagcttcacagagcgataagactcccgaggaactctttcatcctctgggggccgatagtcaagtc

SEQ ID NO: 251175 - DNA, 1476 bp, Artificial Sequence
  Description of Artificial Sequence: Synthetic coding sequence
atggaaccttcttctaaaaaacttacggggagactaatgctggccgttgggggcgccgtgcttggctctctgcagtttggatataatacgggtgtaatcaacgcacctcagaaagttatcgaggaattttacaaccagacgtgggtgcaccggtacggggagtctatccttcctactacattgacgaccctgtggtctctgtctgtcgccatattctcagtaggcggaatgatcggcagcttcagtgtaggcctgttcgtcaatcgctttggtcggaggaactctatgctgatgatgaatctcttggctttcgtgtctgcagtcctgatgggcttttctaagctcggcaaatcctttgaaatgctcatcttgggtagatttatcataggcgtgtattgcggtttaaccaccggcttcgtgccaatgtacgtgggggaagtaagccctacggcactcagaggtgcccttggaactcttcaccaacttgggatcgtcgtaggaattctgatagcccaggtgttcggcttagactccattatgggaaataaagacctgtggcccttgttgctcagcatcatattcatccccgcgctgctgcagtgcatcgtgctgcccttctgtcctgaatccccccggttcctactcatcaatcggaatgaagagaatagggccaaatccgttctgaaaaagcttcggggcaccgcagatgtgacacacgaccttcaagaaatgaaagaagagtcccgccaaatgatgcgcgagaaaaaagtgaccattttagaactcttccgctctcctgcgtacaggcaacctatcctgatcgccgtggtcctgcagctcagccagcaactaagcggcatcaatgcagtgttttattactctacaagtattttcgaaaaggctggagttcagcagccagtgtatgccaccatcggcagcggtatagtgaacaccgcgttcacagtggtgagcctgtttgtcgtagaaagagctggtcgccgcactttgcacttaatcggtctcgccggcatggccggctgtgctatcctcatgactatcgctctggctctcctcgaacaactgccctggatgtcctatctgtctatcgtggcaattttcggattcgtcgctttttttgaggtgggtcctggcccaatcccgtggttcatagtggcagaattattttctcaggggccgcgtcccgccgccatcgcggtggccggcttctccaactggacgtcgaacttcatagtgggaatgtgcttccagtacgtcgagcagctttgcggcccttacgtcttcattattttcaccgtgctgctcgtgttgttctttatcttcacatacttcaaagtacccgaaacaaaagggagaacattcgacgagattgccagcggctttaggcaggggggagcatctcagtccgataagactccggaggagttgttccaccctctcggtgctgatagtcaggtg

SEQ ID NO: 251176 - DNA, 1476 bp, Artificial Sequence
  Description of Artificial Sequence: Synthetic coding sequence
atggagccgagctccaagaagctgacaggcagactgatgctggcggtgggcggggcagtgctgggctccctgcagttcggatacaacaccggtgtgatcaacgcaccccagaaggttattgaggaattttacaatcagacctgggtccaccggtatggcgagtccattctgcccactaccctgacaaccttgtggagtctgtcggtcgcaatatttagcgtaggaggaatgatcggatcattttctgttgggctgtttgtcaacagattcggtagacgtaacagtatgctgatgatgaatctgctcgcatttgtctccgcagttttgatgggattttccaagctaggaaagtctttcgagatgctcatcttaggaagatttatcatcggtgtttactgtggcctaactaccggttttgttcccatgtacgtaggagaggtcagcccgacagctctgagaggtgcattgggcactctccaccagctgggcatcgtagtggggattctgattgcacaggtgtttggcctagacagcataatgggcaataaagacttgtggcctctgctattaagtatcattttcataccagctttgctgcagtgtatagtcctgccattttgtccagaaagcccacgcttcctgcttattaatcgtaacgaggaaaaccgcgcaaaaagtgtattgaaaaagctcagagggacagctgacgtgacacacgacttgcaggagatgaaggaggagtctcggcagatgatgcgtgagaaaaaggttactatcctggagctgttccgttcaccagcgtacagacaacccatcctcatcgctgtggtcctccagctcagccaacaactgagtggaattaacgccgtcttttactacagcacatccatttttgaaaaggccggggtgcagcaacccgtgtatgccaccattggaagcgggattgttaatacagcgttcacagtggtctctctgttcgtggtagaacgcgcaggaaggcgaaccttgcacctgattggactcgctggaatggctggctgcgccattctgatgacaattgccctggctttgctggagcagctgccatggatgtcttacctgtcaatcgtcgcaatttttgggttcgtggccttttttgaagttgggcctggaccaattccctggttcatcgtggctgaacttttttctcaaggaccccgtcctgctgctattgcagtcgctggattctcgaactggacaagtaactttatcgttggtatgtgtttccagtatgtcgagcagctgtgcggcccctacgtctttattatttttactgtgctgttagtgcttttctttatctttacttatttcaaagttccagaaaccaagggccgaacctttgatgaaatcgcatccggtttccggcaaggcggcgcgtcgcaaagtgataagaccccagaagagctgttccaccctctcggtgcggactcgcaagtt

SEQ ID NO: 251177 - DNA, 1476 bp, Artificial Sequence
  Description of Artificial Sequence: Synthetic coding sequence
atggaaccatccagtaaaaagctgaccggacgcctgatgctcgccgtgggcggggctgtcttgggcagtctgcagttcggctacaacaccggtgtcatcaacgccccgcagaaagtaattgaggaattttacaaccagacttgggttcacagatacggagagagcatccttcccactaccctaactaccctgtggagcttgtccgtcgcaatcttctctgtcggggggatgattgggtctttcagtgtcggactttttgtgaatcggtttggccgcaggaatagcatgctcatgatgaatctgttagccttcgtctccgcggtactgatggggttctccaaactggggaaatcattcgaaatgctcattctgggcaggtttattatcggggtgtactgtggcctgaccacgggtttcgtgccgatgtatgtcggtgaagtgtcccccaccgccctccggggtgccctcggcacactgcaccagttgggaatagtcgtgggaatcctgatagcccaggttttcggacttgactctattatgggcaacaaagatctgtggccattgcttctgagcattatctttattcccgccctccttcagtgtatcgtgctgcctttttgtccagagagtccccgcttccttctgataaatcggaacgaggaaaaccgggccaagagcgtgctaaagaagctccgggggacagctgatgtcacgcacgacttgcaggagatgaaggaagagtcacggcagatgatgagggaaaaaaaggtcacgatccttgaactcttcaggagcccagcctaccggcaaccaattctcatcgccgtcgtcctacagctctcgcaacaactcagcggaatcaacgcagtattctactatagtacgagtatttttgaaaaggctggggtccagcagcccgtgtacgccactatcggctccggaatcgtgaatacggccttcacggtcgtgtccctatttgtcgtggaacgggctggcaggcgcaccctccacctcatcgggttagccggaatggctggttgcgcaatcctgatgactatcgcgttggctctgctcgagcagctgccttggatgtcatatctgtcaatcgtagccatcttcgggtttgtggccttctttgaggtcgggcctggaccaatcccttggttcattgtcgccgagctcttctctcagggaccccgaccggcagccatcgctgtcgccggctttagcaattggactagcaacttcatcgtcgggatgtgctttcagtatgtcgagcaactgtgtggcccctacgtcttcatcattttcactgtgctgttggtgcttttcttcatcttcacatatttcaaggtccctgagacaaaagggagaacttttgatgaaattgcatctggctttcggcaaggcggggcatctcagtccgataaaacccccgaggagctgtttcacccccttggggcggattcacaagtt

SEQ ID NO: 251178 - DNA, 1476 bp, Artificial Sequence
  Description of Artificial Sequence: Synthetic coding sequence
atggaacctagcagcaagaaactgactggccggctgatgcttgcagtgggcggagcggtgctggggtctctgcagttcggatacaacaccggagtgataaacgcgccgcagaaggtcatcgaggaattttataaccaaacttgggtacataggtatggcgagtcaattttgcccaccactctgacaactttgtggagtctctccgtggcaatctttagtgttggcgggatgattggaagtttttctgtgggactgtttgtcaaccgatttggtcgcaggaactccatgttgatgatgaacctcctcgcatttgtgagtgccgtactcatggggttctctaaactgggtaagtctttcgaaatgctcatactgggaaggtttatcatcggggtgtactgtgggttgacaacagggtttgtgcctatgtacgttggggaggtttctcctacagcccttagaggagccctggggacattgcaccaactcggtattgttgtcggcattttgatagcccaggtttttgggctggatagtatcatgggcaataaggatttgtggccgcttttgctgagtatcattttcatcccagcactgctgcaatgtatcgtgctcccattctgccccgaatccccgcggttcctcctgataaaccgcaatgaggagaaccgggctaaaagcgtccttaagaaacttagaggcacggccgatgtgactcacgacctgcaagaaatgaaagaggagagtaggcagatgatgcgcgagaagaaggtcaccatactcgagctgtttagatcacctgcctatagacagcctatcctgatcgccgtagtgttgcagctctctcagcagctttctgggattaatgctgtcttctactattctactagcatttttgaaaaggccggagtgcagcagcccgtctacgccacaattgggtcaggcattgtgaatacagcctttacagtagtcagtttgtttgtcgtcgagcgggccggaagacgaactctccatctgataggcctggccggcatggcaggctgcgccattttgatgacaatcgccttggcactgttggagcaactgccatggatgagttatctgtccattgtagccatctttgggtttgtggcattcttcgaggtgggaccaggaccaatcccttggtttattgtagccgaactcttcagccaaggtcccaggcctgctgctatcgctgtcgcaggattcagcaattggacctccaatttcattgtcggcatgtgttttcagtacgttgaacagctttgcgggccctatgtgttcataatctttacagtgttgctggtcttgtttttcatttttacatacttcaaagtgcctgagaccaaggggaggacatttgatgagatagcatcaggcttccgacaaggtggtgcatcccaatctgataagactcccgaggagctctttcaccccctgggggcagattcacaggtg

SEQ ID NO: 251179 - DNA, 1476 bp, Artificial Sequence
  Description of Artificial Sequence: Synthetic coding sequence
atggaaccttcatccaaaaagttgacgggtcgccttatgcttgccgtcggtggggcagtgcttgggtcgcttcagtttggttacaacactggagtcattaatgcaccacaaaaagtgatcgaggagttctacaatcagacttgggtgcaccggtacggagaatcaattttgcctaccaccctgactaccctgtggtcgctgtccgtggctatcttctcagtgggcggcatgatcggatccttttcggtcggactttttgttaatcggttcggtaggaggaattctatgctcatgatgaacctgcttgcatttgtatctgcagtcctcatgggtttttcgaagctggggaagagcttcgaaatgttgattctcgggcggtttatcattggagtgtattgcggactgaccaccggtttcgtcccaatgtacgtcggtgaagtgtctcctacggcattgaggggcgcacttggaaccctgcatcagcttggtattgtcgtgggcattctcatcgcccaagtgtttggtttggattctataatgggaaacaaggacctctggcctttgctcctcagcataatctttataccggcactgctgcaatgtattgttctgcccttttgtcctgagagtccacgatttctccttatcaaccggaacgaggaaaacagggctaaatcagtgctgaaaaagctgagaggtaccgccgatgtgacgcatgatttgcaggaaatgaaagaagaaagccggcagatgatgcgcgaaaagaaggtcaccattctggaactgtttcgcagtccggcgtatcgccaaccgatactcattgcagtggtccttcaactgagccagcagcttagcggaattaacgctgtcttttactactccacttcaatctttgaaaaggcgggggtgcagcaaccagtatacgcgactatcggctccggaatcgtgaacactgcctttactgttgtatcgctgttcgtggtggagagagcgggacgtagaactctccatctgattggacttgccggaatggccggctgcgcaattctcatgaccattgcgttggcccttctcgaacagttgccatggatgtcgtacctgtccatagtggcaattttcggatttgttgctttctttgaggtcggaccaggccccataccttggttcatcgtcgcagaactgttctcccaaggtcctagacctgcagcaatcgcagtggccgggttcagcaattggactagtaactttattgtgggcatgtgttttcaatacgtggaacagctttgtgggccgtacgtgtttatcattttcaccgttcttctggtgctctttttcatctttacttacttcaaagtgccagaaaccaagggtagaacctttgacgagattgcatcgggatttcgccaaggaggagcatcacaatcggacaagacccccgaggagcttttccacccccttggtgcagattcacaagtg

SEQ ID NO: 251180 - DNA, 1476 bp, Artificial Sequence
  Description of Artificial Sequence: Synthetic coding sequence
atggagccctcctcgaaaaagctcaccggtagacttatgcttgcagttggaggagcagtactgggatcccttcaatttggatacaacaccggtgtgatcaacgcgccccagaaggtgatagaggaattctataatcagacttgggtgcacagatacggagagtcaattttgcctactactctcaccaccctctggtccctgagcgtggccattttctcagtgggtggtatgatcggctcctttagcgttggactgtttgtgaacagatttggacggcgcaatagcatgctgatgatgaacctgcttgcattcgtgtccgcggtgcttatgggtttctcaaaactcggcaagtcgtttgagatgcttattcttggtcgattcataattggggtgtattgcggtttgactactggttttgtcccaatgtacgtcggagaagtcagcccaactgcccttcgtggagcactgggaactctgcatcagctgggtatagtggtgggaatacttatcgcacaagtgtttggcctcgattctattatgggcaataaggacctttggccattgctgctgtcgataatctttatccctgcattgcttcaatgtattgtgttgcctttctgcccggaatcaccaaggtttcttctgatcaataggaacgaggaaaacagagcaaagtccgtgttgaagaaactccgtggcacggcagatgtcacccatgatcttcaggaaatgaaggaagagagtcgacagatgatgcgagaaaagaaggtgactatcctcgagctctttcgatcgcctgcctacaggcagccaattctcattgctgtcgtgcttcagcttagccaacaactttcggggatcaacgccgtcttttactactctaccagcatctttgagaaagcaggtgtgcaacaaccagtgtacgccactataggaagcgggattgtgaatactgcatttaccgtagtttcactgtttgtcgtggaaagagcaggaagaaggacccttcacctcatcgggctggcaggtatggccggctgtgcaatccttatgaccatcgcactcgcactgctggaacaacttccttggatgagctacctgtcgatcgtcgcgatttttggttttgtggccttttttgaagtggggcctgggcccattccatggttcatagtggcagaactgttctcccaggggcctaggccggctgcaattgcggtggccggcttttccaactggacgtcaaactttatcgtaggaatgtgctttcaatacgtcgaacagctctgcggaccgtacgtgttcatcattttcaccgtactccttgtgctgttcttcattttcacttactttaaggtgcctgaaacgaaaggccggaccttcgacgagatcgcgtccgggttccggcaaggcggagccagccagtcagacaagacccctgaagaactgttccatccactcggagcagattcgcaggtg

SEQ ID NO: 251181 - DNA, 1476 bp, Artificial Sequence
  Description of Artificial Sequence: Synthetic coding sequence
atggaaccgagcagcaagaagctgaccggcaggttgatgctggcggttgggggtgccgtgttaggttcgttacagtttgggtacaacaccggcgtgatcaacgctcctcagaaagtaatagaagaattctataaccagacgtgggttcacaggtacggggagtcaatcctgccaacaaccctgactacactgtggagcttgagtgttgccattttttctgtcggcgggatgataggctccttctctgtgggccttttcgtcaatcgcttcggtaggcgaaactctatgttaatgatgaacttgcttgccttcgtgagtgctgtgttgatgggcttctccaagctcgggaaatcctttgagatgcttatcctgggacgctttataattggggtctactgcgggctgacaacaggctttgtgcctatgtacgtaggcgaagtcagccccacagctctgcgtggcgccttggggaccttgcaccagctcggcattgtggttggtattctcatcgctcaggtgtttggattggatagcatcatgggaaacaaggacctatggccactgttgctgtcaattatcttcattcctgcactactccaatgtatagtgttgcctttctgccctgaaagccctaggttcctgctgattaatagaaatgaggagaacagagcgaaaagtgtgttgaagaaactgcgcgggacggctgacgtaactcacgatttacaagagatgaaggaggaaagcaggcagatgatgcgggaaaaaaaagtgacaatacttgagctctttcgctcccctgcctataggcaaccgattctgatcgccgtagtgctgcaactttcccagcagctgagcggcataaatgctgtcttttactatagtacgtcaatctttgagaaggctggcgtgcagcaacccgtgtacgctactataggtagtggcatagtgaacacggctttcaccgtcgtatccttgttcgtcgtggagcgcgctggccggagaacactgcatctgatcgggctcgccggaatggcgggctgtgccatcctgatgaccatcgcactggccttgttggaacagctgccatggatgagctatttgtctatcgtggcaatctttggattcgttgcgtttttcgaagtcgggcccggaccaatcccgtggtttattgtggcggagttattttcgcaagggcctcgacccgcagctattgccgtggccggcttctccaattggaccagtaactttatcgtcgggatgtgctttcagtatgtagaacagctctgcggaccttacgtcttcattatcttcacagtgttgcttgtcctgttctttatttttacatatttcaaggtcccggaaaccaaaggcagaactttcgacgagatcgcaagcggctttaggcagggcggagcctctcagtctgacaaaaccccagaagagctgttccatccactcggcgcagacagccaggtc

SEQ ID NO: 251182 - DNA, 1476 bp, Artificial Sequence
  Description of Artificial Sequence: Synthetic coding sequence
atggagccatcaagtaaaaagttgacaggtcgcttgatgctggcagtggggggtgccgtgctgggcagtctgcagtttggttacaatacaggagtcataaacgcccctcagaaggttatcgaagagttctacaaccagacatgggtccatcggtatggggaaagtatactgcccacgacacttaccacactctggtccttatctgtggcgatcttctcagtcggcggcatgataggcagttttagcgtggggctctttgtgaatcggttcgggcggcggaacagcatgctcatgatgaatctgctggcctttgtgtctgctgtgctgatgggattctcaaagctgggaaaatccttcgaaatgctgattttagggaggttcataatcggagtatactgtggcctgacgacaggattcgtcccgatgtacgtgggcgaggtctctcctactgcgctccgaggggctttgggaacactacatcagctgggaatcgtcgtcgggattctgattgcacaagtgttcgggctcgattctattatgggaaacaaagatctgtggccactgctgctgtccattatcttcatccccgcgctacttcagtgcattgtgcttcccttctgtccagaatcccctcggttcctgctcatcaaccgcaacgaggagaatcgcgctaaaagcgttctcaaaaagctccgggggacagcagatgtgacgcatgacctgcaagaaatgaaggaggaatcgcgtcagatgatgcgagagaaaaaagtaaccatcttggaactgtttcggagccctgcttatcgccaaccaatactcattgccgtggtactgcagctgagccaacagctttctggaatcaacgcggtgttttattactccacctctatctttgagaaggccggggtccagcaacccgtgtatgcgaccattggtagtggcattgttaataccgcctttacagttgtttctcttttcgttgtggagagagccggtagacggaccctgcacctaatcggcctggcagggatggctgggtgcgcaatccttatgaccatcgctttggctctattagagcaactgccatggatgagttatctttctattgttgcaattttcggtttcgtggctttttttgaggtcggcccgggacctatcccctggtttattgtggctgaactattctctcaggggcctagaccagccgcgatcgctgttgccggattttcgaattggacctccaacttcatcgtcgggatgtgctttcagtacgttgagcagctttgcggaccttatgtctttataatatttaccgttctcctggtgcttttctttatttttacttacttcaaggtgccagaaaccaaaggaaggacttttgatgagatcgcttcaggttttaggcagggtggcgcctcccagagcgacaaaactccagaagaattgtttcacccacttggggctgatagtcaggta

SEQ ID NO: 251183 - DNA, 1476 bp, Artificial Sequence
  Description of Artificial Sequence: Synthetic coding sequence
atggagccttccagtaagaaactcactgggcgactgatgctggcagtaggtggcgcggtgttggggtccctccagttcggatacaataccggggtcattaatgccccccagaaagtgattgaggagttctataaccaaacatgggtccatcgatacggcgagtccatcttgcccaccacactgacaacactttggtcccttagcgtggcaatattttctgtgggtggaatgatcggttcctttagcgtgggactttttgtcaataggttcggaaggcggaactccatgctgatgatgaacctgcttgccttcgtcagcgccgtcctgatgggatttagcaagctgggcaagtcctttgagatgttgatactggggcgatttatcattggcgtttattgcggactcacaacgggcttcgtgcccatgtatgtcggcgaggtgtcaccaacggccttgagaggcgctctgggtaccctgcatcagctgggtatagtggtaggcatcttgattgcacaggttttcggtcttgactctatcatgggcaacaaagacctgtggccactgttgctgagcatcatttttatccccgcactgctgcagtgtatagtcttgcccttctgtccagaatctccaaggttcctgctgataaatcggaacgaggagaaccgagcaaaaagtgtgctcaaaaaactgcgaggtactgcagacgtgacccatgacctgcaagagatgaaggaggaatcaaggcagatgatgagggaaaagaaggtgacgatcctggagctgttcagaagccctgcttaccgccagccaatccttattgcggtggtgctccagctgagccagcagctctcaggcattaacgccgtgttttactacagcacctctatttttgaaaaggccggggtgcagcaacctgtctatgccacaatcggcagtggtatagtgaacaccgccttcacagtcgtgtccttgtttgtggtggagagagccggtcggaggaccctgcacttgatcgggcttgctggtatggcaggctgcgccatccttatgacaatcgctcttgcacttctggagcagttgccttggatgagttaccttagcatcgtggcaatcttcggattcgtagcattctttgaagttggcccaggacccattccgtggttcatcgtggctgaactgttctcccaagggccgcgccctgcagccatcgccgttgccggcttctcaaattggacatcaaacttcatcgtgggtatgtgctttcagtacgtcgagcagctctgcgggccgtacgtctttatcatcttcactgtgctcctggtcctgttttttatctttacctattttaaggtacctgaaacaaaagggcgaacattcgatgagatcgcctctggctttcgccaaggcggggcaagccagagtgacaaaacgcccgaggaactgttccaccccctgggagctgatagtcaggtg

SEQ ID NO: 251184 - DNA, 1476 bp, Artificial Sequence
  Description of Artificial Sequence: Synthetic coding sequence
atggaaccgtcgtcgaaaaaactaacgggtcgtctaatgctagcggttggtggtgcggtactaggttcgttacaatttggttataatacgggtgtaataaatgcgccgcaaaaagttatagaagaattttataatcaaacgtgggttcatcgttatggtgaatcgatattaccgacgacgctaacgacgctatggtcgctatcggtagcgatattttcggtaggtggtatgataggttcgttttcggttggtttatttgtaaatcgttttggtcgacgaaattcgatgctaatgatgaatttactagcgtttgtatcggcggttttaatgggtttttcgaaactaggtaaatcgtttgaaatgctaatattaggtcgatttataataggtgtatattgtggtttaacgacgggttttgttccgatgtatgttggtgaagtttcgccgacggcgttacgaggtgcgctaggtacgttacatcaactaggtatagtagtaggtatattaatagcgcaagtttttggtttagattcgataatgggtaataaagatctatggccgttactattatcgataatatttataccggcgttattacaatgtatagtactaccgttttgtccggaatcgccgcgttttctattaataaatcgaaatgaagaaaatcgagcgaaatcggtactaaaaaaattacgtggtacggcggatgttacgcatgatttacaagaaatgaaagaagaatcgcgtcaaatgatgcgtgaaaaaaaagtaacgatactagaactatttcgttcgccggcgtatcgtcaaccgatattaatagcggtagtattacaactatcgcaacaactatcgggtataaatgcggtattttattattcgacgtcgatatttgaaaaagcgggtgttcaacaaccggtttatgcgacgataggttcgggtatagtaaatacggcgtttacggtagtttcgttatttgttgtagaacgtgcgggtcgtcgaacgctacatctaataggtttagcgggtatggcgggttgtgcgatattaatgacgatagcgttagcgttactagaacaattaccgtggatgtcgtatctatcgatagtagcgatatttggttttgttgcgttttttgaagtaggtccgggtccgataccgtggtttatagtagcggaattattttcgcaaggtccgcgaccggcggcgatagcggttgcgggtttttcgaattggacgtcgaattttatagttggtatgtgttttcaatatgttgaacaactatgtggtccgtatgtttttataatatttacggttctattagttttattttttatatttacgtattttaaagtaccggaaacgaaaggtcgaacgtttgatgaaatagcgtcgggttttcgtcaaggtggtgcgtcgcaatcggataaaacgccggaagaactatttcatccgctaggtgcggattcgcaagta

SEQ ID NO: 251185 - DNA, 1476 bp, Artificial Sequence
  Description of Artificial Sequence: Synthetic coding sequence
atggaaccgtcctccaagaagctcaccggaaggctgatgcttgcggtcggaggtgctgtgctgggatccctccagttcggatacaacactggggtgatcaatgccccacagaaagttatcgaagaattctacaatcagacctgggtccaccgctacggagaatcgatactgccaaccactttgactaccctctggagtctgagcgtcgccatcttctctgtgggagggatgatcggatcgttctcggtcggactgttcgttaacagattcggcaggagaaactcgatgctgatgatgaatctgctcgcatttgtgtcggccgtgctcatgggattcagcaagctgggaaagagcttcgagatgctcatcctgggacggttcattatcggggtctactgcggcttgaccacggggtttgtcccgatgtacgtgggcgaagtctcgcctactgcccttcggggagccttgggaactctgcatcaactgggcatcgtggtggggatcctcatcgctcaggtgttcggtctggactcgatcatgggcaataaggacctgtggccactgctgctctcaatcatcttcatccccgctctgctgcagtgcattgtcctgccgttctgtcctgaaagcccgagattcttgcttattaaccgcaacgaggagaaccgagccaaaagcgtgctgaagaaactgagaggtactgccgacgtgactcacgatttgcaagagatgaaagaggagagccgccaaatgatgcgggaaaagaaggtcacgatcctcgaactgtttcgctctccagcctaccggcaaccaatccttatcgccgtggtgctgcagctgtcacaacaactgtccggcattaacgcagtgttctattactcgacctccatcttcgagaaggcgggagtgcagcaacccgtctatgcaaccattggaagcggcatcgtgaatacggccttcaccgttgtctcactcttcgtcgtagaaagggcgggccgccggactctccatttgattggcctcgctggaatggccggttgcgcgatcctgatgactatcgccctggcgctgctcgaacagcttccgtggatgtcatacctcagcatcgtcgcaatcttcggattcgtggctttcttcgaagtgggccctggaccgatcccttggttcatcgtggccgagctgttctcccagggtccacgcccggcggcaatcgcagtggcgggattctccaactggacctccaactttattgtgggaatgtgtttccagtacgtggaacagctctgcggaccctacgtgttcatcatatttaccgtgctcctggtgcttttctttatctttacctactttaaggtgccggagactaaagggcggacctttgacgagatcgcgtcaggctttcgccaggggggtgcatcgcagtccgataagaccccggaggaactttttcacccgttgggagctgattcacaagtg

SEQ ID NO: 251186 - DNA, 1476 bp, Artificial Sequence
  Description of Artificial Sequence: Synthetic coding sequence
atggaaccttcgtctaagaagctgaccgggaggcttatgcttgccgtgggaggtgcagtgctgggtagcctccaatttggatacaatacgggggtgattaacgcaccgcagaaggtgatcgaggaattctataaccaaacgtgggtgcatagatacggcgaatcaattctgcccaccacgctgaccaccctctggtccctttcagtggccattttcagcgtgggcggaatgatcggaagtttctcggtcggtctgttcgtcaacagatttgggcgccggaacagcatgcttatgatgaatcttctcgccttcgtgtccgccgtgcttatgggtttttcaaagctcggaaagagcttcgagatgctgatcctcggtcgatttatcatcggagtctactgcggcctcacgactgggtttgtcccaatgtacgtgggcgaagtctcacctaccgcgctcagaggagcacttggcacccttcatcagctcggcatagtggtcggaattcttattgctcaagtgtttgggcttgacagcattatgggtaataaggacctttggccattgttgcttagcatcattttcattcccgcactcctccagtgcatagtcctccctttttgtccagagtcgccacgcttccttttgattaacaggaatgaagaaaacagggctaagagcgtcctgaagaagctgagaggtaccgcagacgtcacccatgatctgcaggaaatgaaggaggaaagtcggcagatgatgcgcgagaaaaaggtgactatcttggaactttttaggtcgccagcttacagacaaccaatccttatcgctgtggtgcttcagctctcccaacagctgagcgggataaatgcagtgttttactactccacctccatattcgagaaagcaggtgtgcaacagcccgtttacgcaaccatcggttcgggaatcgttaatactgcctttaccgtggtgtcactgttcgtggtggagagggcaggtcgccggacccttcaccttatagggctggcaggaatggcagggtgcgcaattcttatgaccattgctctggctctccttgaacagttgccctggatgtcctacctgtcgattgtcgcaatcttcggatttgtggccttcttcgaggtgggtcctggtccaattccttggtttatcgttgcagaactcttctcacagggccctagaccagccgctattgccgtggccggattttccaactggactagcaactttatagtcgggatgtgttttcaatacgtggaacaactgtgtggaccatacgtgttcattatctttaccgtgctgctggtgctgttctttatctttacttactttaaagtgccagagacgaagggaagaacgttcgatgaaattgcaagcggcttccggcagggaggtgcgtcacaatccgataaaacccccgaggaactcttccaccctcttggagcagatagccaggtg

SEQ ID NO: 251187 - DNA, 1476 bp, Artificial Sequence
  Description of Artificial Sequence: Synthetic coding sequence
atggaaccctcgtcgaagaagctgacgggaaggctgatgcttgcggtgggtggagcagtgctcggcagcctccagttcggatacaataccggagtgattaatgcgccgcagaaggtcatcgaggagttttacaaccaaacttgggtccaccgctacggcgagagcatcctgccaactaccctcaccactctgtggtcactgagcgtcgctatcttctcagtcggaggaatgatcggctccttttccgtggggttgtttgtgaatagatttggcagacgcaattccatgctcatgatgaacctgctggcattcgtgtcagctgtgctgatgggattttcaaagctcggcaagtcgtttgagatgttgatcctgggccggttcattatcggcgtgtactgtgggctgactaccggcttcgtcccaatgtacgtcggcgaagtgtcaccaaccgcgctccgaggagcactgggcactttgcaccaactgggaattgtggtgggaatcctcattgcgcaggtctttggactggattcgatcatgggaaacaaggacctgtggccgttgctgctctccatcatcttcatccctgccctgctgcaatgtatcgtcctcccgttctgtccggagtccccgcggtttctcctgatcaacagaaacgaagaaaacagagcaaaatctgtgctcaaaaaactccgcggaaccgccgacgtcacccacgacttgcaggagatgaaggaggaatcgcggcaaatgatgagagaaaagaaggtgaccatcctggaacttttcaggagccctgcctaccgccagccgatcctgatcgccgtcgtgcttcagctgtcgcagcagctctccgggatcaacgcagtgttttactactcgacttcgatcttcgagaaggccggagtgcaacagccggtctacgcaaccatcggatccggaatcgtgaacactgcgttcaccgtggtgtccctgttcgtggtcgagagagcggggcgcagaaccttgcacctgatcgggctggcgggaatggctggatgtgccatcctgatgacgatcgccctggcactgctcgaacaactgccatggatgtcatacttgtcgatcgtggctatcttcggattcgtcgccttcttcgaggtggggcccggacccataccatggtttatcgtggcagagctgttcagccagggccccagacccgcagccatcgccgtggcgggattctcgaactggacttcaaatttcattgtgggcatgtgctttcagtacgtcgaacagctgtgcgggccttatgtgttcatcatctttactgtgctcctggtgctctttttcatcttcacgtacttcaaggtccctgagactaaaggaaggacctttgatgagatcgcctctggatttcgacagggaggcgcatcccagtccgacaagactccggaagaactgttccacccactgggagctgactcgcaagtg

SEQ ID NO: 251188 - DNA, 1476 bp, Artificial Sequence
  Description of Artificial Sequence: Synthetic coding sequence
atggagccatcctcgaaaaagctgactggacggctgatgcttgcagttggtggtgcggtgctgggatcccttcagttcggctacaacaccggagtgataaatgcacctcagaaggttattgaagaattctacaatcagacttgggtgcacaggtacggtgagtcgatcctgcccaccaccttgaccaccctttggtcgctctccgtcgccattttctcggtgggaggaatgatcgggtcattctccgttggccttttcgtcaacagatttgggcgtagaaattcaatgctgatgatgaatctccttgctttcgtgagcgctgtgctgatgggattcagcaaattgggaaaatcattcgaaatgttgatacttggacgctttatcattggggtgtactgcgggctgaccaccgggtttgtaccaatgtatgttggcgaggtgtcgccaaccgcattgcgcggtgcactgggaaccctgcatcagctgggaatcgtcgtcggtatcctcatagcacaggtctttggactggactcgattatgggcaacaaggatctctggccccttcttctgtcgattatctttatacccgccctgcttcaatgtatagtgttgcctttctgtccagagtccccacgatttctgctgattaacagaaacgaggaaaaccgtgcaaagtcggtgctgaagaagctgcgcggaactgccgacgtgactcatgacctgcaggaaatgaaggaagaatcgcggcaaatgatgcgtgaaaagaaggtgaccatccttgagttgtttcgaagcccagcataccgccagcccatcctcattgcagtcgtgttgcaactttcgcaacaactgtcgggaatcaatgccgtgttctactactcgaccagcatctttgagaaagcgggagtgcaacagcccgtctacgccacgattggatcgggtattgtgaacaccgcatttactgtggtgtcactctttgtggtggaacgagcgggtagacgcaccctccatcttattggactggcaggtatggcaggttgcgcaattctgatgaccatcgcactggctcttctggagcagctgccttggatgtcatacctctccatcgtcgcaatattcggttttgttgctttctttgaagtcggaccagggcctatcccgtggtttatagtggcggaactgttcagccagggtccaagaccggcagccattgcagtggctggtttcagcaattggacttccaactttatcgtgggcatgtgtttccaatacgtggaacagttgtgcggtccatacgtgttcatcatattcaccgtgctcctggtccttttcttcatcttcacgtactttaaggtgcccgaaactaaggggagaacctttgatgaaatcgcatcgggctttcggcaaggaggtgcatcccaatcggacaagaccccagaagagctgtttcaccctctcggcgcggattcccaggtg

SEQ ID NO: 251189 - DNA, 1476 bp, Artificial Sequence
  Description of Artificial Sequence: Synthetic coding sequence
atggaacctagctcaaagaagctgactggtaggcttatgctggcagtgggcggtgccgtgcttggatcgctgcagtttggatacaatacgggcgtcataaacgcaccccagaaggtgatcgaggaattctacaaccagacctgggtccatcgatacggggaatcaatcctgccgactacgttgacgactctgtggtcattgtctgttgctatcttttcggtgggtgggatgattggatccttttcggtcggactgtttgtcaacaggtttggtcggcggaactcaatgcttatgatgaatcttctggcgtttgtgtcggccgtcctgatgggattttccaaacttggaaagtcgtttgaaatgcttatcctgggacgcttcataattggagtgtactgtggcctcactactggatttgttcccatgtacgtgggcgaagtctcgcctaccgcacttcgaggcgccctgggaactctccaccaactggggatcgtggtcggaatcctgatcgctcaggtgtttggtcttgacagcattatggggaacaaggatttgtggcctctgctgctctcaattatctttatccctgccctccttcaatgtattgtccttcccttttgtcccgaatcaccacgttttctgctcattaatcgcaacgaggagaaccgggcgaaatccgtcctcaagaaacttagaggaactgcagacgtgacccacgatcttcaggagatgaaggaggaatcaaggcagatgatgcgagaaaagaaggtgacgatcctggaactttttcgttcgccagcgtaccggcagccaatccttatagccgtggtgctgcaattgtcacagcagctttcagggatcaatgccgtgttttactacagcactagcattttcgaaaaggccggagtgcagcaaccagtgtacgccacgataggatcgggtatcgtcaacactgcatttacggtagtgtcgctcttcgtggtggaaagagcaggccggagaactcttcatctgataggactggcaggcatggcaggttgtgcaatcctcatgaccattgctttggctctgcttgaacaattgccttggatgtcatatctctcaattgtcgcaattttcggattcgtggccttttttgaagtgggcccggggcctataccttggttcattgtcgctgaacttttttcacaaggaccccgtccagccgcaatcgcggtggcagggttctcgaactggaccagcaacttcattgtggggatgtgttttcagtacgtggagcaactttgtggtccctacgtgttcattatcttcactgtgctcctggtgctgttctttatctttacctacttcaaggtgcctgagactaaaggacgtacttttgacgagattgcttcgggttttcggcaaggaggagcaagccaatccgataaaaccccagaggagctgttccatccactgggcgcagattcgcaagtt

SEQ ID NO: 251190 - DNA, 1476 bp, Artificial Sequence
  Description of Artificial Sequence: Synthetic coding sequence
atggagccaagttctaaaaaactcacgggtcgcctgatgctggctgtaggaggagctgtgctggggtccctgcaattcgggtataacacaggtgttataaatgcaccccagaaggtgattgaagagttctacaaccaaacctgggtgcacaggtacggagaaagcattttgcctaccactctgacaaccctgtggtccctgtccgtcgcgattttcagtgttggtggtatgatcggctctttcagcgtcggtctgttcgttaacagattcggtagacgcaatagcatgctgatgatgaacctgcttgcgtttgtctcagccgtcctcatggggttcagcaagcttggtaaaagcttcgagatgctaatccttgggagattcatcataggcgtatattgtgggctcactacaggttttgtgccaatgtatgtgggggaagtgtctcccactgcactgcgtggggccctggggacactccatcaactaggcatcgttgtgggcattctcattgcccaggtcttcggactggactccattatggggaacaaagacttgtggcctctccttctgtctattattttcatccccgcactgctacagtgtatcgtgttacctttctgccccgagagtccacggtttttgttgattaatagaaatgaggagaacagagccaagagtgtgctcaaaaaactgcgcggcactgccgacgtgacacacgatctgcaggaaatgaaagaagaatctaggcaaatgatgcgggaaaaaaaggtgacgatcctagaattgtttcgttccccggcctacagacagccgatccttatcgctgtcgttctgcagctctctcagcagctatcaggaataaacgctgtgttttactattccacctcaatcttcgaaaaggcaggagtacagcagccagtttatgccactattgggagcggaattgttaacacagcattcactgtcgtatctctgtttgtggtggaaagggctgggcggcgcaccttgcacctcatcgggctggcaggaatggcggggtgtgccatcctcatgaccattgcgctcgctttgttggagcaactcccgtggatgagctatttgagcatcgttgctatatttggcttcgtggctttcttcgaggttgggccgggtcccatcccctggttcatcgtggcagagctgttttcacagggccctaggcccgcagccattgcagttgcgggcttcagcaattggacaagcaactttattgtcggaatgtgtttccaatatgtggaacagttgtgcggcccgtacgtgtttatcatattcacggtcttgctcgttctcttctttattttcacatactttaaggtgcctgaaacaaaaggccggacatttgacgaaatcgcatctggattccgccagggaggtgcgtcccagtcggacaagacgcccgaagagttgtttcatcccctcggcgcggatagtcaggtt

SEQ ID NO: 251191 - DNA, 1476 bp, Artificial Sequence
  Description of Artificial Sequence: Synthetic coding sequence
atggagccgtcctccaagaaacttactggacgtctgatgcttgcagtgggcggggccgtgctgggctcactgcagttcggatacaataccggagttatcaacgccccgcaaaaggtcatcgaagagttctacaatcaaacttgggtccaccgctatggagaatccatcctgccaacgactctgacgactctgtggtcactgtctgttgcgatcttcagcgtgggaggcatgatcggttccttttccgtgggtctgtttgtgaaccggttcgggcgccggaattcgatgctgatgatgaacttgctcgcgtttgtgagcgcggtcctcatgggcttttcaaaactggggaaatcatttgaaatgttgatccttggtcggttcatcatcggagtctactgcggattgaccactggttttgtccctatgtatgtcggggaggtgagccccactgccctgcgcggtgcacttggaactctccaccagttgggaatcgtcgtggggatcctgattgcccaggtgttcggactcgactcaattatgggaaacaaagacctgtggccgctcctcctgtctatcatcttcattccagccctcctgcagtgcattgtgttgccattctgccccgaatcacctagattcctgctcatcaacagaaacgaggaaaaccgcgcgaagtcggtgctcaagaagttgagagggaccgctgacgtcactcacgaccttcaggagatgaaggaagaatcgcggcagatgatgcgcgagaagaaagtgaccatactggagcttttcaggagccctgcgtacaggcagccaatccttatcgccgtcgtcctccagctctcgcagcagctgagtggaatcaatgcagtgttttactactctacctcaatcttcgaaaaggcgggggttcagcaacctgtgtacgctacgatcggatcagggatcgtgaacaccgcgtttaccgtggtgtccctcttcgtggtggaaagagcaggacgccggactctccacctcatcggactcgcggggatggcggggtgtgccatcctcatgaccatcgcactggccctcctggagcaactgccctggatgtcgtacctgtccatcgtggccatcttcggttttgtggctttctttgaagtgggcccaggcccgatcccatggttcattgtcgccgagctgttctcccagggaccccggcctgccgccatcgccgtggcggggttttcaaactggacttcgaatttcatagtcggaatgtgcttccaatacgtggaacagctgtgcggaccctacgttttcatcattttcacggtgctgcttgtcctgttctttatcttcacgtacttcaaggtcccggagactaaaggccgcacgttcgacgagattgcttcagggttccgccaaggaggagctagccagtccgataagaccccggaagaactcttccacccgctcggggccgactcccaagtc

SEQ ID NO: 251192 - DNA, 1476 bp, Artificial Sequence
  Description of Artificial Sequence: Synthetic coding sequence
atggagcccagctctaaaaagttgaccggtcggcttatgctcgctgtggggggcgctgttctgggatctttgcagtttggctacaacacaggggtcataaacgcacctcagaaagtgatagaggagttttacaaccaaacctgggttcaccgctatggtgaaagtattctgcctactacactcacgaccctctggtctctgtcagtcgctattttttctgtcggcgggatgattggttctttctctgtcggccttttcgtcaaccggttcggcagaagaaattctatgctgatgatgaatctgcttgcctttgtgagcgctgtgctcatgggtttcagcaagctgggcaagagtttcgagatgctcatccttggacggttcatcatcggagtgtattgcggcctgactacagggtttgtgcctatgtacgtgggcgaagtgtcccctactgccctgcgcggggctctcggaaccctgcatcagctgggaattgtagttggcattctcatcgcgcaggtcttcgggcttgattccatcatgggcaacaaagatctgtggccacttctgttgagtatcatattcatccccgcccttttgcagtgtattgttctgcccttctgtcccgagtccccaagattcttgctgatcaatagaaatgaggagaaccgggctaagagcgtactgaagaagctccggggcaccgctgacgtcacacacgaccttcaggaaatgaaagaggagagccgacagatgatgcgggagaagaaagtgactatccttgaactgttcagatctcccgcatacagacaacccatcctcattgctgtggtgcttcagctgagtcagcagctgagtggaattaacgctgtgttttactatagcacctccatcttcgaaaaagctggcgttcagcagccagtttatgctacgatcggcagtggcatagtcaacactgcatttacagtagtgtctctcttcgtggttgaaagagccggacgacggactttgcacctgatcggactggctggaatggccggctgtgcaatattgatgacaatcgctctggccctgctggaacagctgccttggatgagctatctttccatcgtggcaatttttgggtttgttgcctttttcgaggtgggtcctgggccaattccatggttcatcgtcgccgagctgttcagccagggaccccggccggctgcgattgctgtggctgggttctccaactggacgtcaaatttcatcgtgggaatgtgctttcagtacgtggagcagctctgtggcccctacgtttttataatatttaccgtcctgctcgtcttgtttttcatcttcacgtatttcaaagtgcctgagaccaaagggcgaacttttgatgagatcgctagcgggtttcggcagggcggcgcgtcccagtccgataagactcccgaagaactcttccaccctttgggggctgactcacaggtc

SEQ ID NO: 251193 - DNA, 1476 bp, Artificial Sequence
  Description of Artificial Sequence: Synthetic coding sequence
atggagccatccagtaagaaactaacaggccgcctcatgttggcagtagggggagccgttctcggctcattgcaatttggctataatacaggcgtaatcaatgccccccagaaggtaatcgaggagttttataatcagacttgggtacaccgctatggtgaatccatcctccccaccactctgaccacactgtggtccttgtcggtcgctatattctcggtcggggggatgattggaagcttcagtgtgggcctgtttgtcaaccgattcggaagacgcaatagcatgctgatgatgaatttactcgcattcgtgtcggcggtgttaatgggattcagtaaactgggcaagtcctttgagatgctaatcttgggcaggttcatcataggggtttactgtggactgacgacaggattcgtgcccatgtacgtgggggaagtatcacccacggccttgcgcggggccctgggcaccctccatcaactcgggattgtggtcggcattctcatcgcgcaggtgttcggtctcgactcgattatgggtaacaaagatctttggccgctgttgctgagcataattttcataccagccctccttcaatgcattgttctccccttttgcccagaatcaccaagatttctgttgataaatcgtaacgaggagaacagagccaaatcagttcttaagaaactgagggggactgccgacgtaacgcacgacctgcaggagatgaaagaggagagtcgccagatgatgagggagaagaaagtgacaattttggagctattccgcagccccgcttacagacaacctattcttattgctgtcgtgctgcagttgtctcagcagctttctggaataaatgcagtcttttactacagcacatcaatcttcgagaaggccggtgtgcagcagcccgtctacgctaccattgggtcgggcattgttaacacagcatttaccgtggtgtccttgtttgtggtggagcgcgcagggaggcggactctgcacttgattggacttgccggcatggccggctgtgctattctaatgaccatcgctctcgctcttctggaacaactgccatggatgagctatttgagtatcgtggcgatttttgggtttgttgccttttttgaagtggggcctggccctattccatggtttattgtggccgaactgttcagccaaggtcccaggccggctgccatcgcggtagccggcttctctaattggacatctaacttcatcgtgggtatgtgcttccaatatgttgaacaactctgcgggccttatgtttttattatcttcacagttctgctggtgttattcttcattttcacatatttcaaggttcccgagacgaagggacggacgtttgacgagattgcgtctggtttccgacagggaggagctagccagtcagataagactccggaagagttgtttcaccccctgggcgcagactcccaggta

SEQ ID NO: 251194 - DNA, 1476 bp, Artificial Sequence
  Description of Artificial Sequence: Synthetic coding sequence
atggagccttcgagcaaaaagctcactggcagacttatgcttgctgtgggaggagcagtccttggttcgttgcagtttggttataacaccggtgtgataaatgcaccacagaaggtgatcgaagaattctataaccagacgtgggttcatcgttacggagaatccatcctgccaaccaccctgaccactctgtggtcgctctctgtggccattttctcagtggggggaatgatcggttccttctcggtgggcctgtttgtcaacagattcgggcggcgtaattcaatgctgatgatgaatctgctcgcatttgtctcggccgtgctgatgggattctccaaacttggtaaatccttcgagatgctgatactcggacgattcatcattggagtctactgcggacttactaccgggtttgttcccatgtacgtgggggaggtgagccctaccgcactgcgcggtgcactggggacccttcaccaattgggtatcgtcgtcggcattctgatcgcccaagtgttcggtcttgacagcatcatgggcaacaaggacctttggcctctgctgctcagcatcattttcatccctgcgcttcttcagtgcatcgtccttcctttttgtcccgagtcgcctcggttcctcctcatcaaccggaacgaagagaacagagccaagtccgtgctgaagaagctccgcggaaccgccgatgtgactcatgatcttcaagagatgaaagaagaatcgcgccagatgatgcgggagaagaaggtcactattctcgaactgtttagatcacccgcttaccgacagccaattctcattgctgtggtcttgcaactgtcccaacaactttccgggattaacgcagtgttttactacagcactagcatctttgaaaaggctggcgtccaacaaccagtttacgccactattggctcgggaattgttaataccgcattcactgtggtttcgctttttgtggtggagcgagcgggcagacgcactttgcatctgatcggactggcagggatggcagggtgtgctatcctcatgacgatcgcgctggcattgttggagcagcttccttggatgtcctacttgagcattgtcgccatttttggctttgtggcatttttcgaggtcgggcctggcccaattccgtggttcatagtggctgaacttttttcacaaggccctcggcctgccgcaatcgcggtggcaggttttagcaattggaccagcaatttcatcgtgggaatgtgttttcagtacgtggaacaactctgtggtccatacgtgtttatcattttcactgtgttgctggtgctgttctttatcttcacgtacttcaaggtgccggagactaaaggtagaacctttgacgaaattgcgtccggttttagacaggggggcgcctctcagtcagataaaaccccagaagaactttttcacccgttgggtgccgattcgcaagtg

SEQ ID NO: 251195 - DNA, 1476 bp, Artificial Sequence
  Description of Artificial Sequence: Synthetic coding sequence
atggagccgtcatctaagaagctcaccggtcgcctgatgctcgctgtcggaggagccgtgctggggagcctgcagttcggatacaacaccggtgtcatcaacgcgccgcaaaaggtgatagaggagttttacaatcaaacttgggtgcatagatacggagaatccatcctgccaaccactcttactacgctgtggagtctgtcggtggctattttctcggtcggcggcatgattggatccttttccgttggactctttgttaaccgcttcggacgccgcaactcgatgctgatgatgaatctcctggcgttcgttagcgcagtgctgatgggcttttcgaaactgggtaaatcgttcgaaatgctgatcctgggtcgttttatcatcggtgtctactgtgggctgaccactggtttcgtcccgatgtacgtcggggaagtgtccccaaccgcgctccgcggcgccctgggtacgctccaccagcttggaatcgtcgtcggcatcctcattgctcaggtgttcggtttggattctatcatgggcaacaaggatctttggccactgttgttgtcaatcatcttcatccccgcgctcctgcagtgcattgtgctgccgttctgcccggaatcacctaggttcttgctcatcaaccgcaacgaggagaatcgggccaaatcggtgctgaaaaaactcaggggaactgccgacgtgacccacgacttgcaggagatgaaggaagaaagccggcagatgatgagggagaaaaaggtcactatcctggaactgtttaggagccctgcttaccgccaaccgatcctgatcgcggtggtgctgcaactctcgcagcaactctcgggaatcaatgcggtgttctactattcaacctcaatctttgagaaggcgggagtccagcaaccggtgtacgcgaccatcggatcgggaatcgtgaacactgcgtttactgtggtgtcactttttgtggtggagcgcgcggggagaagaacgctccatctgatcggactggctggaatggcgggatgcgcaatcctgatgactatcgcgctggccctcctcgagcagttgccgtggatgtcgtacctgtccatcgtggccattttcgggtttgttgccttcttcgaggttggtccgggacctatcccgtggtttatcgtcgccgaactcttcagccaaggccctcgccctgccgctatcgccgtggctggcttctccaactggacctccaacttcattgtgggtatgtgcttccagtacgtggagcaattgtgtggcccgtacgtgttcatcatctttacggtgctgctcgtgcttttcttcattttcacttatttcaaggtgcctgaaactaaaggacggacttttgacgaaatcgccagcggattccggcagggtggcgcatcgcagtccgataagacccctgaagaactgttccacccattgggagcagattcgcaggtg

SEQ ID NO: 251196 - DNA, 1476 bp, Artificial Sequence
  Description of Artificial Sequence: Synthetic coding sequence
atggagccatcttcgaaaaagcttactggaaggcttatgcttgccgttgggggtgcagtacttggctccttgcagtttggatacaacacaggagtaattaacgcaccacagaaggtgattgaagaattctataaccaaacatgggtgcaccgttatggcgaatccatacttccaacgaccctcactactttgtggtctctctctgtagctatctttagtgtgggaggaatgataggtagtttttcagtgggacttttcgtgaacagatttggaagaaggaattccatgcttatgatgaaccttcttgcttttgtttcggcagtcctcatgggattctcaaagttaggtaagtcctttgaaatgctaatccttggacgattcatcattggtgtgtattgtgggctcactacaggattcgtgcctatgtacgtcggagaagtatcgccgacggccctcagaggagccctaggaacacttcaccaactaggaattgttgtgggaatcttgattgcccaagtttttggattggattcgataatgggaaataaagacttatggccattattactctctattatttttataccggctttgcttcaatgtattgtgttgcctttctgtccggagtccccaagattcttgttaataaatcgaaatgaagagaatcgtgccaaatcagtgctgaaaaagctacgtggaactgccgatgttacccacgacctccaagagatgaaggaagaatctagacagatgatgcgtgagaagaaggtgaccatccttgagctttttcgctcacctgcctatcggcaacctatattgattgccgtcgtgttacaattatctcagcaactctctggaattaacgcggtcttttattatagcactagtatatttgagaaagcgggggttcaacaacccgtttatgccaccattggatccggaattgtgaataccgcattcacagtagtcagcctctttgtagttgagagagctggacgacgaactttgcatctaattggcttagctggaatggccggatgcgccattttaatgaccatagctctcgctttgttggagcagctgccttggatgtcatatctttctatcgttgcaatttttggattcgttgcattcttcgaggttggaccgggaccgatcccatggtttattgttgccgaattgttttctcagggacctcgtccagcagcaattgcagttgctgggttttcgaactggacttcgaacttcattgtaggaatgtgctttcaatatgttgaacaattgtgcgggccatacgtgttcatcattttcacagttcttcttgtcctcttttttatttttacttatttcaaggttccggaaactaagggaagaactttcgacgagatcgcaagtggtttcagacagggtggagcgtctcaaagcgataaaactccggaggaattgtttcacccactgggggctgactcacaggtg

SEQ ID NO: 251197 - DNA, 1476 bp, Artificial Sequence
  Description of Artificial Sequence: Synthetic coding sequence
atggagccgtcgtcaaagaaacttactggaaggctcatgctggcagtgggtggggcagtgcttgggtcgctgcaatttggctacaacaccggagtgattaacgccccccaaaaggtgattgaggaattctacaatcaaacttgggtgcatcgctacggtgagagcattcttcctactacgctgaccacgctctggtcgctgtcagtggcgattttctcagttggcgggatgattggctccttttccgtgggcctttttgtgaatcgttttggcagaaggaactcgatgctgatgatgaaccttcttgccttcgtgtccgcggtgctgatgggattttcaaagttgggtaaatcgttcgaaatgctgattcttggtagattcatcatcggtgtgtactgcggcctcaccactggttttgtccccatgtacgtgggtgaggtttcgccgacggcgctccgtggtgcgcttggaacccttcaccaactcggaattgtggtggggattttgattgcccaagtctttggacttgattccattatggggaacaaagatctgtggcctcttcttctctccattatctttatacctgcgctcctccagtgtatcgtgctgcccttttgtcctgaatcgccacgattcctcttgattaacagaaacgaagaaaacagagctaaatcggtgctcaagaagctcagaggaaccgcagatgtcacccatgatcttcaagagatgaaggaagagtccaggcaaatgatgcgcgagaagaaggtgactatccttgaactttttcgttcgcctgcatacagacagcctatcctgatagcagtcgtgctgcagctgtcgcaacagctgtctgggatcaatgccgtcttttactattcaacttcaattttcgagaaggccggagtgcagcagcctgtttacgccacgatcggttccgggattgtcaacaccgcattcactgtggtgtcgttgttcgtcgttgagcgcgcgggccggagaactctgcatctgattggacttgcggggatggctggatgtgcaatcttgatgactattgcactcgccttgcttgaacaacttccttggatgagctacctgagcatagtggcaattttcggctttgtggcattctttgaagtcggtccaggaccaataccgtggtttatcgtggcagaattgttttcccaaggtccaaggcctgctgccatcgcagtggcgggttttagcaattggaccagcaactttatcgtgggtatgtgttttcaatatgtcgagcagctgtgcggaccatacgtgttcatcatctttacggtgcttttggtgcttttctttatcttcacctacttcaaggtcccagagactaagggaagaacttttgatgaaatagcatcaggatttcgccaaggcggggcatcacagtccgataaaacccccgaggagctgtttcatccactgggtgcagactcacaagtc

SEQ ID NO: 251198 - DNA, 1476 bp, Artificial Sequence
  Description of Artificial Sequence: Synthetic coding sequence
atggagccatcctctaagaagttaactggccgtttgatgctcgccgtaggcggggctgttctcggttcactccagttcggatacaatacaggcgtgatcaacgccccacagaaggtgatagaggagttttacaatcaaacttgggtgcataggtacggcgagagcatcctccccaccaccctaacaactttgtggagcctcagcgtcgcgatcttctcagtcggtggcatgatagggtcattcagcgtgggactgttcgtgaatcgattcgggcgcaggaactcaatgcttatgatgaacctgttagctttcgtcagcgctgtactgatggggttctctaaattggggaagtcttttgagatgttgatattgggaagatttattataggcgtttattgtggcctgacaacaggcttcgtcccaatgtacgtgggtgaagtgagtcccacagccttgcgtggagcgctgggcaccttgcatcagttaggcatagttgtggggattcttatcgcccaggtgttcgggctcgatagcattatgggcaacaaggacctctggcccctgctactgtctatcattttcattcctgccttgttgcagtgcatcgtgctccccttctgtcctgaatcacctcgttttctcttaattaatcggaatgaagagaatagggctaaatctgtcctgaagaagctccggggtactgctgatgtcacccatgacttacaggaaatgaaagaagagagtcggcagatgatgcgggaaaagaaggtgaccattctggagctgttccggagcccagcttacagacaacccatccttattgctgtggtgcttcaactgagtcagcagctgtccggcattaatgcagtgttctactattctaccagtatctttgagaaggcaggcgtgcagcagcctgtgtacgcgaccattggctcaggcatcgtaaataccgcattcaccgttgtctctctcttcgttgtagagagggcgggaagacggacactgcacctgatagggctggccggcatggcgggttgtgctattcttatgacaatcgccttagctctcctcgaacagctgccatggatgagttacctgagcattgtggccatctttgggtttgtagcctttttcgaagtgggccctgggccaatcccctggtttattgtggccgagctgttctcgcagggacctcgcccggctgccattgccgtggcaggcttctcaaactggacttccaactttattgttggcatgtgcttccagtatgtggaacagctgtgcgggccatacgtgtttattatattcaccgtcttactcgtccttttttttatttttacctactttaaagtccctgagactaaggggcgcacgttcgacgaaatcgctagcggtttccgacaggggggtgctagccagtccgataagactcctgaggagctgtttcatccactcggggcagacagtcaagtg

SEQ ID NO: 251199 - DNA, 1476 bp, Artificial Sequence
  Description of Artificial Sequence: Synthetic coding sequence
atggagccctcaagcaaaaagttgacgggtagacttatgcttgccgtgggtggagctgttctgggcagcttgcaattcggctacaacacgggagtcataaacgccccccagaaggttatcgaggaattctacaaccagacctgggttcaccgttacggtgagtccatcctgcccaccaccctgaccaccctgtggtccctgtcagttgctatcttctcggtcggaggtatgattggttccttctccgttggtctgttcgtcaaccggttcgggcggcgcaactccatgcttatgatgaacctgctagcgtttgtgtcggccgtgctcatgggcttttccaagttaggtaagtcttttgagatgctgatcctcggtcgtttcatcatcggtgtgtattgcgggctgaccacgggtttcgttcccatgtacgttggggaagtgtcccccaccgccctccgtggtgcgctgggtacactccaccaattaggcatcgtcgttggaatacttattgcccaggtgttcggtctggactcgatcatgggtaataaggatctgtggccacttcttttgtccatcatattcattcccgcattgctgcagtgcatcgtcctcccgttttgccccgagtctccgcgctttctcctcatcaacaggaatgaggagaaccgcgccaagagcgtactcaaaaagttgcgcggtaccgccgacgtcacccatgacctgcaggagatgaaagaggagtcccggcagatgatgcgcgagaagaaggttaccatcctagagctcttccgtagccccgcttatcgacagccgatccttattgctgtcgtcctgcagctctcacagcagctttccggtatcaacgccgtcttttattattccacctccattttcgagaaggctggtgtccagcaacccgtgtatgccaccattggctccggtattgtgaataccgcttttaccgtggtctcgctgttcgtggtcgagcgcgcaggacggcgcacgctgcaccttatcggtctggcaggcatggcgggctgcgcgatcctgatgaccatcgccctggcccttctggaacaactcccgtggatgtcttatctctccatcgtcgcgatcttcggttttgtggcttttttcgaggtcggaccaggccccattccatggttcattgtcgccgagctattctctcaaggcccgcgcccagcagctattgccgtggctggattcagtaactggacgagcaactttattgtgggaatgtgcttccaatacgtcgagcagctctgcggcccctacgtcttcattatcttcaccgtgctgttggtcctgttcttcatcttcacctacttcaaggtccccgagacaaaggggcgcactttcgatgagatcgcgtctggcttccgccagggtggcgcgagtcagtccgacaagacccccgaggaactgttccatccgttgggtgctgactctcaggtc

SEQ ID NO: 251200 - DNA, 1476 bp, Artificial Sequence
  Description of Artificial Sequence: Synthetic coding sequence
atggagccatcatctaagaagctgaccggccgacttatgttagccgtcggaggagccgtactcgggtctttgcaattcgggtacaacacaggcgtgattaatgctccacaaaaggtaatcgaagagttctataatcagacttgggtgcaccgctatggcgagagcatcctccccaccacactgaccactctgtggagcttgagcgtcgccatattctccgttggaggaatgattgggagtttctctgttggactctttgttaaccggtttggccgccgaaactccatgcttatgatgaatctgttggcttttgttagtgcagtgttgatgggcttttctaagctgggaaagagttttgaaatgcttatcctcgggaggtttatcatcggcgtttattgtggcctgacaactggctttgtaccaatgtatgtaggcgaagtgtccccgacagctcttaggggcgcactcggtaccctgcatcagctgggaatcgtggtgggcatcctcatcgcccaagtctttggcctggattcaatcatggggaacaaggatctctggccacttctcctttctataatctttatacccgctttgttgcaatgtatcgtgttacctttttgcccagagtcccctaggtttctcctaattaatcggaacgaagaaaacagggccaagtcagtgctgaagaagctgcgcggaacagcagacgtaacccacgacctgcaggaaatgaaggaggaaagtcgtcaaatgatgagggaaaagaaggtcactattctcgagctgttccgatccccagcctacaggcagcccatcctgatcgctgtggtcctacaactgagccaacaactgtcaggtataaatgcagtattctactattccacttccatcttcgagaaagccggtgtgcaacagcccgtgtacgccacgatcggctccggcatcgtcaatacagctttcacggttgtttctctgtttgtggtcgagcgagctggtagacgaactctccacttaatcggcctggctggcatggccgggtgtgccattctaatgactatcgccttggcgctgcttgaacagttaccctggatgtcatatctgtcgatcgttgcaatcttcggctttgtagctttctttgaggtcggccccgggcccataccgtggtttattgtggccgaactttttagccaagggccccggccagctgccatagccgtggcgggcttctctaactggacctcaaactttatcgtagggatgtgcttccagtacgtcgaacaactttgcgggccctacgtctttatcatcttcactgtactccttgtgttgttctttattttcacctacttcaaagttccagagacaaaggggagaacgttcgatgagatcgcttccgggttccggcaggggggcgcctcgcagtccgacaaaacacccgaggaactctttcaccccctcggagccgactctcaggtt

SEQ ID NO: 251201 - DNA, 1476 bp, Artificial Sequence
  Description of Artificial Sequence: Synthetic coding sequence
atggagccctcaagcaagaagctcactggacgcctgatgctggcggtgggcggtgctgtgctgggttcactgcaattcggctacaacaccggcgtcatcaatgcccctcaaaaagtgatcgaagagttctacaatcagacctgggtgcataggtacggtgaaagtatcctgccgacgaccctgaccaccctttggtccctgtctgtggccatctttagcgtggggggtatgatcggttccttcagcgtgggactgttcgtgaatcgcttcggacggagaaactccatgctcatgatgaatctgttggcgttcgtgtcggccgtgctcatgggattctcgaaacttggtaagtcgtttgaaatgctgatcctgggtcggttcatcatcggagtgtactgtggactgaccacgggctttgtgccgatgtacgtgggagaagtgtccccgacggccctcaggggtgccctgggaactctgcaccagctgggaatcgtggtcggtatccttattgcccaggtgttcggcctggatagcattatgggtaacaaagacctgtggccgttgctcctgtcaataatcttcatcccggcattgttgcagtgcatcgtcctgccattctgcccagagtcgccgagattcctcctgatcaacagaaacgaggagaacagagccaaaagcgtgttgaagaagctgcgcggaactgcggacgtcacccacgacctccaggaaatgaaagaggagtcccggcagatgatgcgcgaaaagaaagtcaccatcctcgagctctttagatcgccggcataccgccaaccgatcctcatcgcagtggtcctgcagctctcgcagcaactgtcgggcatcaatgcagtgttttactactcaacttcaattttcgagaaggccggtgtgcagcagcctgtctacgctactatcgggagcgggatcgttaacaccgcgttcactgtggtgtcgctcttcgtggtggagagagccggacgaagaaccctgcatctgatcgggctcgcgggcatggcgggatgcgccatcctgatgacgatcgcattggccctcctggaacaactgccatggatgtcgtacttgtcgatagtcgcaatcttcggattcgtggccttctttgaggtggggccgggaccgataccgtggttcatcgtggccgaactcttctcacagggcccacggccagctgccatcgctgtggcagggttttccaattggacctcgaactttatcgtgggaatgtgttttcaatacgtcgagcaactgtgcggaccctacgtctttatcattttcaccgtgttgctcgtgctgtttttcatcttcacctacttcaaagtgcctgagactaagggaagaacgtttgacgaaatcgcttccgggttcagacaaggcggagccagccagtcagataagactccagaagagctctttcaccctctgggcgcagactcgcaggtc

SEQ ID NO: 251202 - DNA, 1476 bp, Artificial Sequence
  Description of Artificial Sequence: Synthetic coding sequence
atggagccatcttctaagaaactgacaggaagactgatgctcgcagtggggggagccgtgctgggatctctccaattcggttacaacacaggggtgattaacgccccccagaaggtgatcgaggaattctataaccagacctgggtgcatagatacggagaaagtatccttcctaccactcttacaacattatggtctctatctgtcgccattttcagtgtgggagggatgattggctctttctccgtcggcctgtttgtcaataggttcggccgcaggaactccatgctgatgatgaaccttttagcctttgtcagcgcggtgctgatggggttctccaaattgggcaaatccttcgagatgttgatcctggggaggtttataatcggggtgtattgtggcttaactactggatttgtgccgatgtacgtcggggaggttagtccaacagccctaaggggcgccctcgggacgttgcaccaactcggcatcgtagtggggatcctgatagcccaagtcttcggtctggactcaatcatgggtaataaggatctttggcctcttctgctgagtattattttcatccccgcacttctgcagtgcattgtgctccctttctgccctgaatcgccccggtttttgctcattaataggaatgaggagaaccgcgctaaatccgtgctgaagaagttgaggggcacagcagatgttacacacgacctccaggagatgaaggaggagagccggcaaatgatgagagagaagaaagtgaccatccttgaattgtttcggtcccccgcatataggcaaccaatactgattgctgtcgttttgcagttatcccaacagttgtccggcataaacgcggtgttctactactcaactagcatcttcgagaaggccggtgtccagcagccggtctacgccactatcgggagtggtatcgttaatactgccttcacagtcgttagcttgttcgtggtggagcgagccggccggagaactctgcatctgatcggcttggctggtatggctggctgtgctatcttgatgaccattgccctcgccctcctggagcagctaccatggatgagttatctgtctatagtggccatattcgggtttgtggcttttttcgaggtgggccctggaccaatcccctggttcattgtggccgaacttttctcacaagggcccagacccgctgccatcgccgtagctgggttttctaactggacctccaattttattgtgggtatgtgcttccaatacgttgagcagctgtgtgggccctatgtcttcattatttttacagtgctattggtgcttttcttcatcttcacttattttaaagttccggagacgaagggacggacattcgacgagattgcttccggattccgccaagggggagccagccagagcgacaaaaccccggaggaactcttccacccactgggcgccgactctcaggtg

SEQ ID NO: 251203 - DNA, 1476 bp, Artificial Sequence
  Description of Artificial Sequence: Synthetic coding sequence
atggaaccgtcatccaagaaacttacggggaggctcatgctggcagtgggaggcgctgtcctgggttccttgcagtttggatacaacaccggggtgatcaacgcgcctcaaaaggtgattgaagagttttacaaccaaacttgggtgcatcgctacggtgagagcattcttcccactactcttactaccctgtggagcctctccgtcgcaatattctccgtcggtggtatgatcggatccttcagcgtgggactgttcgtgaacaggttcggaagaaggaactcaatgctcatgatgaaccttctcgcgtttgtgtccgcagtgctgatggggttttcaaagctgggaaagagctttgagatgctcatcctgggaagattcataatcggcgtgtactgtgggctgactactgggtttgtgcccatgtacgtgggggaggtcagccctacggcgcttaggggtgccctcggtaccttgcatcagcttggaatcgtcgtgggaattcttatcgcccaagtgtttggccttgattcgattatgggaaacaaggatctttggccactgcttctgtcgattatctttattcctgcgttgcttcaatgcattgtcctgcctttctgtccagaatcgccaagatttctcctgatcaaccgaaacgaggaaaaccgggcaaaatcggtcctgaagaagctgagaggtaccgcggacgtgacgcacgatctccaggaaatgaaggaagagagccgccagatgatgcgcgagaaaaaagtgactattctcgagctgttcagatccccagcttacaggcaaccaattttgatagccgtggtgctgcagctttcccagcagttgagcggaattaacgccgtgttttactactccacgtcgatctttgaaaaggctggcgtccagcagcctgtttacgcgaccatcggtagcggtatcgtgaatacggcctttactgtagtctcactgttcgtcgtggaacgcgcaggcagaaggacccttcatctgatcgggctcgccggcatggcaggttgtgcaatactgatgactatcgccctggcactcttggaacagctcccctggatgagctacctctccatcgtcgccattttcggattcgtcgcttttttcgaagtgggacccggccctataccttggtttatagtcgcagagcttttctcgcagggtccaagacctgccgccatagccgtggcaggattttcgaattggaccagtaactttatcgtgggcatgtgctttcagtacgtcgaacaactttgtggaccttatgttttcattatctttactgttctgctggtgcttttcttcatattcacttacttcaaagtccccgaaaccaaaggccgcacctttgatgagattgcatccggattccgccaaggtggtgcatcacaatccgataaaactcccgaagagcttttccaccctcttggtgcagattcccaagtg

SEQ ID NO: 251204 - DNA, 1476 bp, Artificial Sequence
  Description of Artificial Sequence: Synthetic coding sequence
atggaaccaagttctaaaaaacttaccggaagattaatgcttgcagttgggggtgctgtattaggaagtttacaattcggatataatacaggagtaattaacgctcctcaaaaagttatagaagaattttataatcaaacttgggtacatagatatggtgaatcaattcttccaactactttaactacattatggtctctttcagttgctattttctcagttggtggaatgatcggatctttctctgtcggactttttgttaatcgttttggtagaagaaatagtatgcttatgatgaatcttttagcttttgtttcagcagttttaatggggtttagtaaacttggtaaatcattcgaaatgttaattcttggtagatttattattggagtttattgtggtttaactactggattcgtaccaatgtatgttggtgaagtttccccaacggcacttagaggagcattaggaactttacaccaattaggaattgtcgttggaattcttattgctcaagtttttgggttagatagtattatgggaaataaagatttgtggccacttcttttaagtattatttttattccagcattacttcaatgtattgttttaccattctgtccagaatcaccaagattcttattgatcaatagaaatgaagaaaatagagcaaaatctgttcttaaaaaattaagaggaacagctgatgtcacacatgatttacaagaaatgaaagaagaatcaagacaaatgatgagagaaaaaaaagtaacaattcttgaactatttagaagtcctgcatatagacaaccaattcttattgctgtcgttttgcaattgtctcaacaattgagcggtatcaatgctgttttttattattctacgtcaattttcgaaaaagctggagttcaacaaccagtttatgcaactattggatcaggaatcgttaatacagctttcacagttgtatctttatttgttgttgaaagagcaggaagacgtactttacatttaataggattagctggtatggcaggatgtgccattttaatgacaattgctttagcattacttgaacaacttccatggatgtcttatctttcaattgtagctatttttggatttgttgctttttttgaagttggtccaggaccaataccatggtttattgttgctgaacttttttcacagggtccaagaccagctgctattgctgtagcaggattttctaattggacatcaaattttattgtaggtatgtgttttcaatatgttgagcaactttgtggaccttacgtttttattatcttcactgtattattagttctttttttcattttcacatattttaaagtaccagaaacaaaaggaagaacatttgatgaaattgcttctggattccgtcaaggaggagcatcacaatcagataaaacaccagaagaattatttcatcctttgggagcagattcacaagta

SEQ ID NO: 251205 - DNA, 1476 bp, Artificial Sequence; identical to SEQ ID NO: 251202
  Description of Artificial Sequence: Synthetic coding sequence

SEQ ID NO: 251206 - DNA, 1476 bp, Artificial Sequence
  Description of Artificial Sequence: Synthetic coding sequence
atggagcccagtagtaagaagctaaccggccgactcatgcttgcggtcgggggggccgtactgggctcactgcagttcggatataacaccggggttattaacgccccccagaaggtcattgaggagttttacaaccagacttgggtgcaccgctatggtgaaagtattctccccacaacactgaccaccctgtggagtctctccgtagccatcttttctgtgggagggatgatcggaagcttttcagtgggcctgtttgtgaatcggttcggacggcgcaattctatgctaatgatgaatctgctcgcctttgtctccgctgtactcatggggttcagcaagctgggcaaatcattcgaaatgctgattctcggccgcttcatcatcggagtgtattgtggcctgactacaggtttcgtgcccatgtacgtgggagaggtttcccccacagccctgcgaggagccctggggacactgcaccagcttggaattgtcgtgggcattctcatagcacaagtgtttggacttgactctataatgggcaataaagacctctggccactattactgtccatcatttttattcccgctttacttcagtgtattgttctccccttctgtccagagtctcctaggttcctgttgatcaaccgaaacgaggagaatcgggctaagagcgttctcaaaaaactgagaggcacggccgatgtcacacatgatctgcaggagatgaaggaggagtcgcgccagatgatgagagagaagaaggtcacgatcctggaactattcagaagtccagcctacaggcagcctatactgatagccgtggtgctccagctgtcccaacagctgtccggcattaatgcggtcttctactacagtactagcatcttcgaaaaagcgggagttcagcagcctgtttacgcgactatcggctcgggtatcgtgaacacagcgttcacggtggtgagcctgttcgttgtggagagagcgggccggcggactctgcacctcatcgggctagccgggatggctggttgtgctattctgatgactatagccctcgcacttctggagcagctaccttggatgtcatatctgtcaatcgtggcaatcttcggatttgtagctttttttgaggtgggtcccgggcctattccgtggtttatcgtagccgagcttttctctcaggggccgagaccggctgctatcgcggtggcgggcttttccaattggacaagtaacttcatagtgggtatgtgctttcagtacgtggaacagctttgtggtccttacgtgtttattattttcactgttctgcttgtcctatttttcattttcacatattttaaggtccccgaaaccaagggcaggacctttgacgagattgcctcaggttttagacagggtggtgcctcgcaatccgacaagacccctgaagagctatttcatcccctgggggccgattcccaagta

SEQ ID NO: 251207 - DNA, 1476 bp, Artificial Sequence
  Description of Artificial Sequence: Synthetic coding sequence
atggagccttcaagtaagaaacttactggcagattgatgttagcagttgggggtgctgttttgggttcccttcagtttggatataacacaggcgttattaacgctccccagaaagtgatagaagaattttataatcagacatgggtgcatcgttacggtgagtcaattctccctactaccctcaccacattatggtctttgtctgtagcgattttcagcgtgggagggatgataggttcattcagtgtcggtctgtttgtaaacagattcggtcggagaaattccatgcttatgatgaatctcctcgcatttgtttcagccgttcttatgggattctcaaagttggggaaatctttcgaaatgctcattctgggtaggtttatcataggagtgtattgcggtttgacaactggctttgttccaatgtatgttggggaggtaagtcctacagccttacggggagcattaggcactcttcaccaactggggatagtagttgggatcctgatcgcccaagtgttcggtcttgatagtatcatgggtaacaaagacctttggccacttctcttgtcaataatttttatcccggccctcttgcagtgtattgtgttacctttctgtcctgaatcaccaagattcttactcattaataggaacgaggagaatagagccaagtcggttttaaagaaacttcgcggaactgcggatgttacacacgatcttcaggaaatgaaagaagaatctagacagatgatgcgtgagaaaaaggtcacaatcttagaactttttaggagtccggcatacaggcaacccattttaattgctgtggtattgcagttgtcgcagcagctctcaggcataaatgccgtattttattactctacatcaatatttgagaaagccggcgttcagcaacctgtatatgctactattggatctggaatagtgaatacagctttcaccgttgtgtccttgtttgtcgtggaaagggccggtaggaggacactgcacttaatcgggttggctggaatggccggctgtgcgatacttatgacaattgctctagcgttactcgaacagctaccatggatgagttatttgtcaattgtagctatttttggatttgtggcctttttcgaggtcggaccgggaccaattccatggtttatagttgcagaactctttagtcagggaccaagacccgctgcaatcgccgtggctggattttcaaactggactagcaactttatcgtaggtatgtgcttccagtacgttgaacaattgtgtggtccttacgttttcataatctttactgtccttttggttttgtttttcatattcacctacttcaaagttccagaaaccaaaggacgtacctttgatgaaatagcatcaggttttagacagggaggggcttcacaaagcgataaaactccagaagagctattccacccgctaggagctgacagccaagtt

SEQ ID NO: 251208 - DNA, 1476 bp, Artificial Sequence
  Description of Artificial Sequence: Synthetic coding sequence
atggaaccttcgtcaaagaagctcacgggtcggctcatgctggcggtgggaggtgcagtgctgggctccctgcaattcgggtacaacaccggagtgatcaacgctcctcagaaagttatcgaggagttctacaaccagacttgggtccaccgctacggggagtcgatcctgccgaccactctgaccaccctctggtcactctcagtggcgatcttcagcgtcggaggcatgatcggctcgttttcggttggactctttgtgaaccgcttcggaagaagaaacagcatgctcatgatgaatctgctggcgtttgtctcagctgtcctgatgggattctccaagctcggaaagtccttcgagatgctgatcctgggacgttttatcatcggagtctactgtggactgaccaccggatttgtgccaatgtacgtcggcgaggtgagccctactgcgttgagaggcgctctcggaactctgcaccagttgggaatcgtcgtcggcatcctcatcgcgcaggtctttggcctggacagcatcatgggaaacaaagacctttggccactgctcctgtcgatcatcttcattccggcgctgttgcagtgcatcgtgctgccattctgcccggaatctccgaggttcttgctcatcaacagaaatgaggagaatcgagctaaatcggtgctgaaaaagctgcgcggaaccgccgatgtgacccatgatctgcaagagatgaaggaagaatcaagacaaatgatgagagaaaagaaggtcactatcctggagctgttccggtcgccggcctaccggcagccgattctgattgctgtcgtgctccagctgtcccagcagctgtccggaatcaatgccgtgttctattacagcacctcgattttcgaaaaagccggggtccaacaaccggtttacgccactataggctcgggtattgtcaataccgcttttacggtcgtttcactgttcgtggtggaacgggccggaagaaggacccttcacctcataggattggcaggaatggccggatgcgccatactcatgaccattgctctcgctctgctcgaacaactcccatggatgtcgtacctctcgatcgtggcaatctttggattcgtggcctttttcgaagtggggccgggaccgatcccatggttcatcgtggctgagttgttctcacaggggccgcgcccggcggcgattgcagtggcggggttctcaaactggacttcaaacttcatcgtcggaatgtgtttccaatacgtggaacagctgtgcggaccatacgtgttcatcatcttcactgttctgctggttctgtttttcatcttcacctacttcaaggttcccgaaactaaggggcgaactttcgacgagatcgcctccggtttccggcaaggaggcgcctcgcagtcggacaagaccccggaagaactctttcatccgctcggcgccgatagccaggtc

SEQ ID NO: 251209 - DNA, 1476 bp, Artificial Sequence
  Description of Artificial Sequence: Synthetic coding sequence
atggaaccatcgtcaaagaagctgacgggacgtctgatgctggcagtgggaggagcagtgctcggctccctccaatttggatacaacactggagtgatcaatgcgccacaaaaagtgatcgaagaattctataaccaaacctgggtacataggtacggagaaagcattcttcccactactctgaccaccctgtggagcctgtccgtcgcaatcttctccgtcggtggcatgatcggatccttttctgtgggactttttgtgaacagatttggcaggcgtaacagcatgctgatgatgaatctgctggcttttgtgtcagcagtcctgatgggattttcgaaacttggaaagagcttcgagatgctgatactcggccggttcattatcggtgtgtactgcggccttactaccggatttgtgcctatgtacgtgggagaagtgtccccaaccgcactccgcggagccttgggcacgctgcaccaacttggaatagttgtgggaatcctgatagcccaggtgtttggattggacagtatcatgggcaataaggatctgtggccgctgctgctgtcgatcattttcatcccagcactgctccaatgcattgtccttcccttctgtcctgaatcccctagatttttgctcattaaccgaaatgaggaaaatagagccaagtcagtcctcaagaaacttagagggactgcggatgtcactcatgacctgcaagaaatgaaagaagaatcacgccagatgatgagagaaaagaaggtcactattctcgagttgtttcggtcaccagcataccgccagcccatccttattgcagtggtgctgcaactgtcacaacaactctcaggtattaacgccgtgttttactactccacgtcgattttcgagaaggctggagtgcagcagccagtgtatgcgactatagggtcgggtatcgtgaacactgcatttaccgtcgtgtcgctgttcgtcgtcgaaagggcaggtagacgcaccctgcaccttattggtctggcaggtatggccggctgtgcaatccttatgactatagcgttggctcttctggaacaacttccctggatgagctacctgtcgattgtggcaattttcggattcgtggcattctttgaggtgggacctggaccaatcccctggttcattgtggctgaactcttttcacaaggtcctagacctgcagcgattgcagtggccggattttcaaattggacctcgaactttatcgtggggatgtgttttcagtacgtcgaacaactttgcggaccttacgtctttatcatattcactgtgttgctggtgctcttcttcattttcacttactttaaggtgccggagacgaagggccgaactttcgacgagattgcatccggttttaggcaaggtggagcgtcccagagcgataagactcctgaggagctcttccatccgttgggagcagacagccaagtg

SEQ ID NO: 251210 - DNA, 1476 bp, Artificial Sequence
  Description of Artificial Sequence: Synthetic coding sequence
atggagccctcgtcaaagaaattgactggtcgtttgatgctggcagtcggaggtgctgtgctcggatcactgcagtttggttataacaccggggtcatcaacgcgcctcaaaaggtcattgaagagttttacaatcaaacctgggtgcaccggtacggggaatcgatcctgcctaccacccttaccactctctggtcactgtcagtggcgattttctcggttggcggtatgattgggtcatttagcgtgggactctttgtgaaccgctttggtagaagaaactccatgctcatgatgaatcttcttgcttttgtcagcgccgtgcttatgggtttttccaagctgggtaaatcgtttgaaatgcttattcttggaaggtttatcattggcgtgtactgcggactcactaccggatttgtcccaatgtacgtgggagaagtgtccccaactgcgcttcgaggtgctctgggtacccttcatcagctggggatcgtggtgggcatccttattgctcaggtctttggactggactcaattatgggaaacaaagacctttggcctcttcttctttcgattatctttatccctgcattgctgcagtgtattgttcttcctttctgcccagaatctccccggttcctgctgattaacagaaacgaggaaaaccgggctaaatcagtgctcaagaagttgcgcggtaccgccgatgtgactcatgatcttcaagaaatgaaagaggaatcgcggcaaatgatgcgggaaaagaaggttaccattctggagctttttcgaagccctgcgtaccgtcaacctattctgattgcagtcgtgctgcaattgtcccaacagctgtcggggatcaacgcggtgttttactactccacgtcgatcttcgagaaggcgggtgtgcaacaacctgtctacgcaaccattggttccggtatcgtgaataccgcattcacggtggtgtcgctgtttgtggtggagagggcagggcggaggactcttcatctcattggtttggcaggtatggccggatgtgcaatccttatgaccatcgcactggcactcctggagcagctgccttggatgtcatacctgagcatagtggccatcttcggatttgtcgctttcttcgaggtggggcccgggccaattccgtggtttattgtggcagaacttttctcccaaggtccacgacctgcagcaatcgcagtggccgggtttagcaactggacgtcaaacttcatcgtgggaatgtgttttcaatacgtggaacagctttgtggaccatacgtctttatcatattcactgtccttctcgtgctgttctttatcttcacctacttcaaggtgccagaaaccaagggccgcacctttgacgaaattgcaagcggttttagacagggaggtgcatcacaatccgacaagactccagaagagctttttcaccccctcggggccgattcccaagtg

SEQ ID NO: 251211 - DNA, 1476 bp, Artificial Sequence
  Description of Artificial Sequence: Synthetic coding sequence
atggaaccctccagtaaaaagttgacaggacgactgatgctcgctgttggaggcgccgtgctgggatcactgcaattcgggtacaataccggcgtgatcaacgcgcctcagaaagtgatagaggagttctacaatcagacatgggtgcacaggtacggagagtccatactgcccaccacgctaacaaccctgtggtcactctccgtggccatcttttcagtgggtggtatgattggatctttcagcgtgggtcttttcgtcaaccggtttggtcggagaaatagtatgctgatgatgaatctgctggccttcgtgtcagcagtcctcatggggttttctaagctcggtaagtcttttgagatgctgatcttggggcgtttcataataggggtttactgcggactgactacgggtttcgtacccatgtatgtgggcgaagtgtcacccaccgcactgcgcggtgcactgggaaccctacaccagctgggaatcgtggttggaattctgatcgcccaagtcttcggactggatagtattatgggcaacaaggacctgtggcccctccttctgtccattatattcatccctgctcttcttcagtgcattgtcctgcccttttgtcctgaaagccctcgctttctgctcataaatcgaaacgaagaaaatcgggcaaagtcggtcctcaaaaaacttcggggcactgccgatgttactcatgacttacaggaaatgaaggaggagagtcggcagatgatgcgggaaaaaaaggtgaccatcttagaactgttcaggagccccgcctatcgtcagccaatcctgatcgctgtcgtgttacaactcagccagcagctgtcggggatcaacgcagtgttttattatagtacgagcattttcgagaaagccggggttcagcagccagtgtacgcaaccatcggctctgggatagtaaataccgcttttaccgtcgtgagccttttcgtggttgagcgggccggaagacgtaccttgcaccttatcgggttggccgggatggctggctgtgctatcctgatgacaattgctttagctctgttggaacagctgccatggatgagctacctctctattgtggccatcttcggcttcgtggccttcttcgaagttggcccgggccctattccctggttcattgtcgccgagcttttcagtcaaggacctcgtccggccgccatcgctgtggccggcttcagcaactggacttctaactttatcgtggggatgtgcttccaatacgtcgagcagctgtgcggtccttacgttttcatcatatttacagtgctcctggtcctcttcttcatattcacttattttaaagtccctgagactaaaggcaggacattcgacgaaattgctagcgggttcagacagggcggagcatcacagtccgacaaaacccctgaagaacttttccatcctctgggagcggactcccaggtc

SEQ ID NO: 251212 - DNA, 1476 bp, Artificial Sequence
  Description of Artificial Sequence: Synthetic coding sequence
atggaaccttcttctaaaaagcttactgggcggctcatgctggccgtggggggggccgtcttaggatctttacagttcgggtacaacacaggggtgatcaacgcacctcagaaagtgatagaagaattctataatcagacatgggtgcacagatatggggaatcaatcctgcctacaactctcacaactctatggtctctctctgtagccatcttcagtgtagggggaatgatcggatccttttctgtagggctgtttgtaaataggtttggacgccgaaattccatgctgatgatgaacttactagcatttgtgtctgctgtgctcatggggttctctaaactggggaagagttttgaaatgctaatcctaggaaggtttataatcggagtatattgtgggctcacaacaggattcgtaccaatgtatgtaggagaagtgtctcccacagcactccggggagcattagggactcttcatcagcttggaattgtggtggggattctaattgctcaggtcttcgggcttgactccataatgggaaataaggatctctggccactccttctgtcgatcatcttcattcctgcgctactgcagtgcattgttctccctttttgtcccgaatctccacggtttctcctcatcaaccggaatgaggaaaatagagcaaaatctgtgctgaaaaagctaaggggaacagccgacgttactcatgatctccaggaaatgaaggaggaaagtagacagatgatgagagaaaagaaagtaacaatcttagaattgttcagaagtcctgcgtatcggcaacctatacttatagccgtcgtgctacagctttcccagcagctctcaggaatcaatgccgtgttttattactctacttcaatatttgaaaaggccggagtccagcaacctgtatatgctactataggatctgggatcgtgaatactgcgtttacagtcgtgtcgctgtttgtggtggagagagccggacgccggactttacatctcataggattagcgggaatggcgggatgtgctatcctcatgacgatcgctcttgcactactagaacagctgccttggatgtcctacttatcaattgtagccatctttgggtttgttgccttcttcgaagtaggaccagggcccataccatggttcatcgtcgcagaactattctcccagggacccaggccagcagccatcgccgttgctgggttttccaactggacaagtaacttcattgtaggaatgtgttttcaatatgtcgaacagctctgtgggccctatgtgttcatcatatttactgtcctcctagttttatttttcatttttacatattttaaagtgcccgaaacaaaagggcgaactttcgatgaaatcgcttctggattccgacaaggaggagcctcccagtccgataaaacacccgaagaactctttcaccctctgggagccgattcccaggtt

SEQ ID NO: 251213 - DNA, 1476 bp, Artificial Sequence
  Description of Artificial Sequence: Synthetic coding sequence
atggaaccaagctcgaagaaacttaccggacgactgatgctggctgtgggaggagctgtcctggggtccctccaattcggatacaatactggggtcataaacgctccacagaaagtgatcgaggaattctataatcaaacgtgggtccacagatacggagaatcaatcttgccaactactttgaccaccctctggtccctttcagtcgctattttctcagtgggcggaatgatcggatccttttccgttggactgtttgtgaaccgcttcggacggcgcaacagcatgctgatgatgaatctgctggccttcgtgtccgcagtccttatgggattttccaaactgggcaagtctttcgaaatgctgatcctgggccgcttcattatcggtgtgtattgcggactgactaccggtttcgtgccgatgtacgttggggaagtgagcccaaccgctctccgcggcgcattgggtactctgcaccagctggggatagtagtggggatcctcatcgcgcaggtctttgggcttgactcgatcatgggaaataaggacttgtggccgctgctgttgtcgataatcttcatcccggcgctcctgcaatgcatcgtgctcccattctgccctgaatcgccgcgcttcctgctcatcaacagaaacgaggagaaccgcgcgaagtccgtgcttaagaagttgagaggcactgcggatgtgacccacgacctccaggaaatgaaggaggagtcacggcagatgatgcgggaaaagaaagtcaccatcctggagcttttccggtcgccagcctaccggcagcctatcctcatcgcagtggtgctgcaattgagccagcagctgtctgggattaacgcagtgttttactactcgactagcatcttcgagaaagcgggcgtccagcaaccggtctacgcaactatcggctcaggaatcgtgaacaccgcttttaccgtcgtgtccttgttcgtggtggaaagagccggcagacgcaccctgcatctgatcggcctcgctggaatggccgggtgtgcgatcctgatgaccattgccctcgccctcctcgagcaactgccgtggatgtcttacttgagcatcgtggccatcttcggcttcgtggcctttttcgaagttggacctggtccgataccctggttcatcgttgcagagctgttcagccaaggacctcgaccggccgccatcgccgtcgccgggttcagcaactggacttcgaacttcattgtcggaatgtgtttccagtacgtcgaacagttgtgcggtccatatgtgtttatcattttcactgtcctcctggtcctcttcttcatctttacctacttcaaggtgccggaaacgaaaggaagaacttttgatgagatcgcctccggattccgacagggaggtgcgtcgcaatcagacaagacccctgaggaacttttccatccgctgggggccgattcccaggtg

SEQ ID NO: 251214 - DNA, 1476 bp, Artificial Sequence
  Description of Artificial Sequence: Synthetic coding sequence
atggaaccttcctctaagaagctgacaggccgcctgatgttagcagtgggaggcgccgttctgggcagtttgcaattcgggtataacacaggcgtgatcaacgctcctcaaaaagtgattgaggagttttataaccagacatgggtgcatcggtacggagagtccattttgcctactaccctgaccaccctgtggagcctcagcgttgctattttctctgtaggcggtatgataggttcgttttcagtcggactatttgtgaatagatttggacgccgcaacagtatgttgatgatgaatttgcttgctttcgtatcagctgtgctgatgggttttagcaaactgggcaagagcttcgagatgcttatcttagggcgctttatcataggagtgtattgcgggctcaccacagggttcgtgccaatgtatgttggagaggtgtcccccaccgccctgagaggtgcgttaggcaccctccatcagcttggaattgtggtcggcatattgattgcccaggtgttcgggctagactccatcatgggcaataaagacctctggccactcctgttatcaattattttcatcccagccctgctgcagtgcatcgtcctgcccttctgcccggaaagtccacggttcctgctgattaatagaaatgaagagaaccgcgccaagtcggtgctcaagaagctgaggggtacagctgatgtaacccacgacttgcaggagatgaaagaagagtcccgtcaaatgatgcgcgagaaaaaggtaaccattctggaactcttccggagccccgcgtaccgccagcccatactcattgcagtggtgctccagctctcccagcaactgtcggggatcaatgccgtattctactacagcacatcgatctttgaaaaggctggggtacagcagcctgtgtacgccacaattggatccggcattgtgaacactgcctttacggtcgtcagcctgttcgtggtcgaaagggccggccgacggacgctgcatctgatcggactggcagggatggccggctgtgccatcctgatgactattgccctggccctgctggaacagctcccctggatgagctacctttctatcgttgccattttcggtttcgtggctttcttcgaggttggccctggacctatcccatggtttattgtggcagagctgtttagtcagggtccccgacccgccgctattgccgtggccggattctccaattggaccagtaactttatcgtcggaatgtgctttcaatacgtcgagcagctctgcggtccgtacgttttcattatcttcacagtcttactcgtactgttctttatctttacatacttcaaggtgcctgaaacaaagggacgcacattcgacgaaatcgctagcggatttaggcagggtggagccagccagagcgacaaaactccagaggagctcttccaccctctgggggcggactcccaagtc

SEQ ID NO: 251215 - DNA, 1476 bp, Artificial Sequence
  Description of Artificial Sequence: Synthetic coding sequence
atggagccgagctcaaaaaagttgaccgggcgcctcatgctcgccgtcggaggagcagtgctgggctcattgcagttcggctacaatacgggcgtcattaacgcgcctcagaaggtaatcgaagaattctataatcagacctgggtgcacaggtacggcgagtcgatcttgccaactaccttgaccaccctgtggagccttagcgtggccatcttttcggtgggaggcatgatagggtcctttagcgtgggattgttcgtgaatagattcggacggcgaaacagcatgctcatgatgaacctcctggccttcgtgagcgcagtcctgatggggttctccaagctggggaagtccttcgaaatgctgatacttggacgcttcattatcggtgtctactgtggactcactacgggatttgtgccgatgtacgtaggtgaagtttctccgaccgcactgcggggagctctgggcactctccatcagttgggtattgtggtcggtatcctcatcgcgcaggtttttggacttgactccattatgggaaataaggacctctggccgttgctgctgtcaatcatcttcatccccgccctcctgcaatgcatcgtgctgccattctgcccggagtcgccgcgattcttgctcatcaaccggaacgaggagaatagagctaaatcggtgctcaaaaaactgagaggcactgctgatgtgacccatgaccttcaggaaatgaaggaggagtcccgacagatgatgagagaaaagaaggtgaccattctggaattgtttaggagccccgcctaccgccagcctatccttatcgccgtggtcctgcaactgtcacaacagctgtcgggcattaacgcagtgttctactactccacctccatcttcgagaaagcgggagttcaacagccagtgtatgcgactatcggatcggggatcgtgaacaccgccttcactgtcgtctcacttttcgtcgtcgaacgcgcgggccgccgtactctgcacctgatcggactggccggaatggcgggttgcgccatcctgatgactatcgcactcgctctgttggaacagctcccgtggatgtcctacctttcaatcgtagcgatcttcgggtttgtggccttcttcgaggtgggaccagggcctatcccatggttcatcgtggccgagctgttttctcaagggccccgccctgcagccatcgctgtagctggattctctaactggactagtaatttcattgtcggaatgtgcttccaatacgtcgaacagttgtgtgggccgtacgtgttcattatctttaccgtgctcctggtcctctttttcatctttacctactttaaggtgccggaaacgaagggccggaccttcgatgagatcgcctcgggttttcggcaaggaggcgcctcgcagtctgataagacgcccgaagaactgttccacccgctgggagccgactcccaagtg

SEQ ID NO: 251216 - DNA, 1476 bp, Artificial Sequence
  Description of Artificial Sequence: Synthetic coding sequence
atggagccttcgtcaaagaagctcaccggacgcttgatgctggcggtgggaggcgcagtgctgggctcgctccagttcggatacaacactggcgtgatcaatgccccgcagaaggtgatcgaagaattctacaatcaaacctgggtgcatcggtacggagagtccattctgccgactaccctcaccactctttggagcctgtcagtggcgatcttttctgtgggagggatgatcggatcattctcggtgggactcttcgtgaaccgcttcgggcggagaaattcaatgcttatgatgaatctgctggcatttgtctccgcagtcctgatgggcttctccaaacttggaaagagcttcgagatgctcatccttggacgcttcatcatcggcgtgtactgcggactcaccaccggattcgtccccatgtacgtgggggaagtgtcaccgaccgcactgagaggagctctgggaaccctgcaccagcttggaatcgtggtcggaatcttgatcgcgcaggtgtttggattggattcgatcatgggaaataaggacctctggccgctcctgctctctatcattttcatcccggcattgttgcagtgcatcgtgctgccgttctgtccggagtcccctcgctttttgctgatcaaccgcaatgaagagaatcgggctaaatcggtcttgaaaaagctcaggggaactgcggatgtgacccatgacctccaggaaatgaaggaggagtcaagacagatgatgcgcgagaaaaaagttaccatcctcgaactcttccgatcgcccgcttacagacagccgattctcatagcagtggtgctccagctgtcacagcagttgtccggaatcaatgccgtgttctactactccacctcgatcttcgaaaaggcaggagtgcaacagccagtttacgccaccatcgggagcggaatcgtcaacaccgccttcactgtggtatctctgttcgtcgtcgagcgggctggacgcaggactctccatcttatcgggctggccggcatggccggatgcgccatcctgatgaccatcgcgttggccctcctggaacaacttccttggatgtcgtatctgtcgatcgtggccatcttcggattcgtggccttcttcgaagtgggacctggaccaatcccatggttcattgtggccgaacttttctcacaaggcccgcggccagctgcaattgcggtcgcaggcttctcgaactggacctcgaactttatcgtgggcatgtgtttccagtacgtggagcagctttgcggaccatacgtgttcatcattttcactgtcctcctcgtgctcttctttatcttcacttactttaaagttcccgaaactaagggaaggacctttgacgaaatcgcctccggatttcgccaagggggagcaagccaatccgacaagactccagaagaactgtttcaccccctgggggcggactcccaggtg

SEQ ID NO: 251217 - DNA, 1476 bp, Artificial Sequence
  Description of Artificial Sequence: Synthetic coding sequence
atggagccttcctccaagaaactgactggccgcctcatgttggctgttggaggggcagtgctgggatctcttcagttcggctacaacaccggggtgatcaacgcgccccagaaggtgatcgaggagttctacaatcaaacttgggtgcatcggtatggtgagtcaatcttgcctactactctgacgaccttgtggtccctgtccgtggcgattttctcggtcggagggatgatcggatctttcagcgttggattgttcgtgaacagattcggacgccggaattcgatgctgatgatgaatctcttggcttttgtgtctgccgtgctgatgggattctccaagctcggaaaatcatttgaaatgctgatcctgggtcgctttatcattggagtctactgtggccttaccactggattcgtgccaatgtacgttggagaagtctcaccgaccgccctgcgcggagcactcggcactctgcaccagctcgggatcgtggtaggaatcctgatcgcccaagtgtttggactggacagcatcatgggtaacaaggacctgtggccgctgttgctgagcattatctttatccctgccctcctccagtgtatcgtgctcccgttctgcccggaaagcccacggttcttgctgattaatcgaaacgaggaaaaccgagcgaaaagcgtgcttaagaaacttcgcggaaccgcagatgtgactcacgatctgcaagaaatgaaagaagaatcacggcagatgatgcgggagaagaaagtgaccatcctggagttgttcaggtcccctgcctaccggcagccgatcctcattgcggtcgtcctgcaactgtcccagcagttgtccggaatcaacgcggtcttttactacagcacctcaattttcgagaaagcgggagtgcagcaaccagtgtacgcgaccatcggttccggcattgtgaataccgctttcaccgtcgtctccctgtttgtggtggaaagagcaggccggcgcaccctgcacctgatcggtctggccgggatggccggatgtgctatcctgatgactatcgcgctggccctcctggagcaactgccatggatgtcctacctctcgatcgtggcaattttcggcttcgtagcgttcttcgaagtcggcccgggaccgatcccctggtttatcgtggccgagctcttctcacagggacctagaccagcggcaatagcggtggccgggttttctaattggacttcaaactttatcgtcggaatgtgcttccagtacgtggaacagctctgtggcccatacgtctttatcatattcaccgtgctgcttgtccttttcttcatcttcacttacttcaaggttccggagactaaggggcgtacgttcgatgaaatcgcgtccggatttcgccagggtggagcatcgcaatccgacaagactccggaagaattgtttcatcccctcggtgccgattcacaagtg

SEQ ID NO: 251218 - DNA, 1476 bp, Artificial Sequence
  Description of Artificial Sequence: Synthetic coding sequence
atggaaccttcgtccaagaagctcacaggaagactcatgttggctgtcgggggcgccgtcctgggctctctgcaatttggctataacactggagttatcaacgcccctcaaaaggttatcgaggagttctacaaccaaacatgggtgcatcggtatggagagagcattttgcctactacactgactaccctgtggtctctgtctgtggcgatctttagcgtggggggcatgatcggcagctttagtgttggactctttgtgaaccggttcggaagaagaaattcaatgctcatgatgaacctgcttgcctttgtgtccgcagtattgatgggctttagcaagctaggcaagagcttcgagatgctgatcttgggccgcttcataatcggggtgtattgtgggctgaccactggcttcgttcctatgtacgtcggggaagtgtctccgaccgctctgcggggagctcttgggacgctccaccagttgggaatagtggtaggcatcctaatagcccaggtctttggtctggacagcattatgggtaacaaggatctgtggccactgctgctgagcattatctttataccagcactcctgcagtgcatagttctccctttctgccccgaaagtccaagatttctccttatcaataggaatgaagaaaacagggctaagtcagtgcttaagaagctgagaggcaccgctgatgttacccatgaccttcaagagatgaaagaagagagccgccagatgatgagagaaaaaaaggtgaccattctggagctcttcagatcgccagcgtaccggcagcctattctcatcgcggtggtcctgcaacttagccaacagctgtcgggcatcaacgcggtgttctactatagcacttctatctttgagaaagctggcgtccagcagccggtctacgcaaccattgggagtgggattgtgaacaccgcgttcaccgtcgtttctctgttcgttgttgagagggctggaagacgtaccttgcatttgataggcctggcgggcatggcgggctgcgctattttgatgactatcgctctggctttgctggagcagctgccctggatgtcctacctgagcattgtggcaatcttcggtttcgtggcattttttgaggtcggacctggaccgattccctggttcatcgtagcggagctcttttctcagggcccccggccagcagcgatagccgtcgcgggcttttcaaattggacaagcaactttatagtgggcatgtgtttccaatatgttgagcaactctgtggaccctatgtattcataatctttacagtattattggtccttttttttatattcacctatttcaaggtgcctgagaccaaaggaaggacctttgatgagatcgcctcgggctttagacaaggcggtgcctcccagagcgataagactcccgaggagttatttcatccactgggcgcagatagtcaagtg

SEQ ID NO: 251219 - DNA, 1476 bp, Artificial Sequence
  Description of Artificial Sequence: Synthetic coding sequence
atggagcctagtagcaaaaagctgaccggcaggctgatgctcgcagtcgggggtgccgtcctggggtctctgcagttcggctataatacaggagttattaatgcccctcagaaagtcatagaggagttctacaaccagacctgggtgcatcgatatggcgagagtatccttccgaccactttgacgacactttggagcctgagcgtagcaatctttagcgtaggcgggatgattggatctttcagtgtggggctgttcgtcaatagatttggcagacggaactcaatgctgatgatgaatctactggctttcgtgagcgctgttctgatggggttctctaagctcgggaagtctttcgagatgttaatcctgggtcgcttcatcattggcgtgtactgtggcctgacaactggattcgttcctatgtacgtcggggaagtttcccccactgccctgcgaggagcactgggtactctgcatcagttaggcatcgtagtggggattctaattgcacaggtgttcggactcgacagtatcatgggtaataaggatctgtggcctttgctcctctcaattatttttattccagccctcctccagtgtatagtgttgccattctgtcccgagtccccaaggttcctgctaatcaataggaatgaggagaaccgagccaagtccgtgctcaagaagctacgtgggactgcagacgttacacacgacttgcaggagatgaaggaagaatctcgacagatgatgagggagaagaaagtgaccattctggaactgttcaggagtcctgcctatcgacagccaattttaatagcagttgtgttgcaactgtcgcagcagctgtccggcatcaacgcagtgttctactacagtacctcgatattcgaaaaagctggcgtgcagcagcctgtgtacgctactattgggagtggcatcgtgaacaccgcttttacagtggttagtctgtttgtcgttgaacgcgccggcaggcgaactctgcacctcattggactcgccgggatggcaggttgtgccatcttgatgactatcgcactcgcgctacttgagcaacttccttggatgagctatctgagtatcgttgccatttttggttttgtggcattcttcgaggtgggtccggggccaatcccatggttcatcgttgcagagctcttttcccagggcccgagacccgccgccatcgcagtcgccggcttctccaattggaccagtaactttatcgtcggaatgtgttttcaatacgtggagcagctgtgcgggccatatgtgttcataatcttcactgtccttcttgtcctgtttttcatattcacgtacttcaaggtaccagagaccaagggccggactttcgacgagattgcatcaggctttagacagggcggagcaagccaaagcgacaagacgcctgaggaactgtttcatccactaggggccgactcacaggtg

SEQ ID NO: 251220 - DNA, 1476 bp, Artificial Sequence
  Description of Artificial Sequence: Synthetic coding sequence
atggaaccctcgtctaagaagctgacaggccgactgatgctcgccgtgggcggcgctgttctagggtcactccagtttggttataacactggtgttataaacgcccctcaaaaggtgatagaagagttttataaccagacatgggttcaccgctatggcgaatctatcctccctaccacgctgactacactgtggtcattgagcgtcgctatattctccgtcggtggcatgataggttccttctctgtaggattgttcgtgaaccgattcggtcgaaggaactccatgctaatgatgaatttactggcttttgtgtcagctgttttgatgggcttctctaagttgggtaagtcgtttgagatgcttatccttggcaggttcattataggcgtctattgtggtctcactacaggattcgtgccaatgtatgtgggcgaggtgagccctacagctctgcgaggcgctctcggaacacttcatcagctaggtatcgtcgtgggaatacttatagcccaggttttcggcctggactccattatgggtaacaaagatttgtggcctttactgctatctataatattcattcctgctctgctccagtgcatagtccttcccttttgcccagagtcgcccagattcttattgatcaacagaaacgaagaaaacagagccaaatcggtcctgaaaaaactcagaggaactgctgacgtaacccatgacctgcaggagatgaaggaagagagcagacagatgatgcgagaaaaaaaggtgacaattcttgaactcttcagatctcccgcttatcgtcagccaatccttatcgctgtggttctgcagctgtcgcagcaactgtctggaatcaatgccgtcttttactactccacatccatcttcgaaaaggctggagtgcaacagcctgtgtatgctacaatcgggagcggcattgtgaacacagcctttacagtggtgtcactctttgtcgtggagcgggccggccgacgaactctgcatttgattggactagccgggatggctggatgtgctatcctcatgactatcgccctcgcgctcctcgaacaactgccttggatgtcatacctatctatcgttgcaatttttggcttcgtcgctttcttcgaggtggggccaggacctattccatggttcattgttgccgaactgttttcacagggacccaggccagccgctatcgctgttgccggctttagcaactggacgtcaaactttattgtagggatgtgttttcaatacgtcgagcaactgtgtgggccttatgtgttcatcatattcacagttctgctggtcctgttctttattttcacctacttcaaagtccccgagaccaagggcaggacatttgacgaaattgcaagcggcttccgacaaggcggcgcgagccagtcagacaaaaccccggaagagttgttccaccccctcggcgcagatagtcaggtg

SEQ ID NO: 251221 - DNA, 1476 bp, Artificial Sequence
  Description of Artificial Sequence: Synthetic coding sequence
atggaaccttccagcaaaaaacttaccggacggctcatgcttgcagtggggggtgctgtgctgggaagccttcagttcggctacaacaccggtgtgataaatgcgcctcaaaaagtgatcgaagaattctataatcaaacttgggtgcataggtacggtgaatcaatacttcctactaccctcactacgctttggagcctctccgtggccatcttttctgtgggaggaatgataggatcattctcggtcggactctttgtgaaccgttttggtcgccgaaactccatgctgatgatgaatcttctcgcttttgtgtcagccgttctgatgggtttctccaagctcgggaagtccttcgagatgctcatcctcggacgcttcattatcggcgtctactgtggacttaccaccggattcgtgccgatgtacgtgggcgaagtgagccctaccgcactgagaggtgcactgggcacccttcatcagctgggaattgtcgtcggaatcctgatcgcccaggtgttcgggctggactcaatcatgggtaataaggatctgtggcctctgctgctttccatcatattcatacccgcacttctccaatgtattgtgcttcctttttgtcccgaatcgccgcgatttcttctcattaaccgcaacgaggagaacagagcaaagagtgtcctgaaaaaacttaggggtaccgcggacgtaactcatgatctgcaggagatgaaggaagagtcccgacaaatgatgcgagaaaagaaagtgaccatcctggaactgttccggtcgccggcataccggcagccaattcttatcgcagtcgtcctgcaactgtcccaacaactctcgggcatcaacgccgtgttttactactccacttcgattttcgaaaaagccggagtgcaacaacctgtgtacgcgaccatcggatcgggtatcgtgaataccgccttcactgtggtgtcgctcttcgtggtcgagagagcaggccggcgtacccttcatctgattggcctggcaggaatggctggttgcgcaattctgatgaccatcgcactcgcccttcttgaacaacttccttggatgtcgtacctgagcattgtggccatatttggtttcgtggcttttttcgaggtcggacccggtccaataccatggtttattgtggctgaacttttttcgcagggacctcgcccagcggcgatcgctgttgcaggattttcgaactggactagcaactttattgttggtatgtgctttcaatatgtcgagcagctgtgtgggccatatgtctttatcatattcacggtgctgctggtgctgttctttatcttcacctactttaaggtgccagaaaccaagggtcggacttttgatgagatcgcgagcggattccgacagggaggagcatcacaaagcgacaagacgcctgaggaactgttccacccacttggagcagattcccaggtg

SEQ ID NO: 251222 - DNA, 1476 bp, Artificial Sequence
  Description of Artificial Sequence: Synthetic coding sequence
atggagccgtcctccaagaagctcaccggtcggttgatgctggcagtcggcggtgctgtgcttggctcactacagtttgggtacaacactggggtcataaacgcccctcagaaggttatcgaggagttttacaatcagacctgggttcatcggtatggagaaagcatcctgccaaccactctgacgaccttgtggtccctgagcgtagccattttcagcgtgggagggatgataggctccttttccgttgggttgttcgtgaacaggttcggcagacggaactcgatgctcatgatgaacctgctggcattcgtgagtgccgtcttaatgggatttagcaaactggggaaatcattcgagatgctaatactggggaggtttattatcggtgtatattgtggattgacaactggcttcgtgccaatgtacgtaggagaagtctcgccgaccgcattgaggggagcccttgggactttacatcagctgggtattgtcgtgggcattctgattgctcaagtctttgggctggactcgatcatgggcaataaagatctgtggccgttgctactgagcatcatattcatccccgctctcttacagtgcattgtgttgcctttttgtcccgagagtccccgttttctcctgattaatagaaacgaagaaaaccgcgctaagtccgtgctaaagaagctcagaggtactgccgacgtgacccacgatctgcaagagatgaaggaggaatcaaggcaaatgatgagggagaagaaggttaccattctcgaactgttcagatcacctgcgtacaggcagccaattctcatcgctgtagtcctgcagctgtcccagcaactcagcggcataaatgcagtattttactattctacaagcatcttcgagaaagcgggcgttcagcagccagtgtacgccacaattggcagcgggatcgtcaacacagcatttaccgtggtgagtctctttgtggtggaacgcgcgggaagaagaactctgcacctgattggcctcgccggaatggccgggtgcgctattcttatgactattgccctggctctgttagagcagttgccttggatgagctacttgtcaatcgtcgccattttcggctttgtggccttctttgaggtcggccccggccccattccctggtttatcgtcgccgagctattttcccagggacccagaccggctgccatagcagttgccggctttagcaactggactagcaatttcatagtgggtatgtgcttccaatacgttgaacagctatgtggcccttacgttttcatcatcttcacagtcctcttagttttattctttattttcacgtattttaaagtccctgaaacaaaggggcggacctttgacgagatagcttccggctttcgtcaagggggtgcatcccagagcgataagactccagaagaattatttcatcccctcggtgccgatagtcaggtt

SEQ ID NO: 251223 - DNA, 1476 bp, Artificial Sequence
  Description of Artificial Sequence: Synthetic coding sequence
atggagccctctagtaagaaattgactgggcgattaatgctagccgttggaggggccgtgcttggctcactccagttcgggtataacactggtgtgatcaacgcaccccagaaagtgattgaggagttttataaccagacttgggtacacaggtacggggaaagcatccttcccactaccttaacgacactttggagcctttctgtggcaatcttctccgtggggggcatgatagggtcttttagtgtcggcctcttcgtcaacagatttgggagaagaaacagcatgctgatgatgaatcttctcgcctttgtgtccgctgtgcttatggggttcagtaagcttggtaagagtttcgagatgctaattcttggccgatttatcataggtgtgtactgcggccttacaacgggattcgttcccatgtatgtcggagaggtgagtcccacggctttaaggggtgctctcggaaccttacatcagttggggattgttgttggcatcctcatcgcccaggtttttggactggacagcatcatgggtaacaaggatctttggcccctcctgctcagcattatcttcatcccagcccttctccagtgtatagtgcttcctttctgtcccgagagtccacggttcctactcatcaaccgcaacgaagagaaccgcgccaaaagcgtcctcaagaagcttagagggactgccgacgtgacccatgatctccaagaaatgaaagaggaatcgcggcaaatgatgcgcgagaagaaagtaaccatcttagaactgttccgcagcccggcctatcggcagcccatcctgattgccgtcgtgctccagctgtcccagcagctgagtggcatcaatgccgtgttttattatagtacttccatcttcgaaaaggctggggtccaacagccagtgtacgctaccatcggcagtggcatcgttaatacagcttttacagtggtgtctctatttgtggtcgagcgagcgggccgtagaaccctccacttaattggacttgccggcatggcgggatgcgccattttgatgactattgctctggccctgttggagcagttgccatggatgagttacctgtcaatcgtagccattttcgggtttgtagctttcttcgaggtgggacctggacccatcccttggtttatcgtggcagaactgtttagccagggtccacgcccagctgcaattgccgtggctggcttctctaattggacatcgaatttcatcgtaggaatgtgttttcaatatgtagagcaactgtgtggcccttatgtcttcataatcttcacagtcttactagtgctattcttcatttttacttactttaaggtcccagagactaaggggcgcaccttcgatgagatcgctagcggctttcgacaggggggggctagccagagcgataaaacccccgaggagttatttcacccgttgggggccgacagccaggtg

SEQ ID NO: 251224 - DNA, 1476 bp, Artificial Sequence
  Description of Artificial Sequence: Synthetic coding sequence
atggaaccttcctctaagaagctgaccggaaggcttatgctggcagtcggaggggctgtcctcgggtcgcttcagttcggatacaacactggcgtgattaacgcgccacaaaaggtcatagaagagttctacaatcagacctgggtacatcggtacggagagagcatcctgcctacgactctcaccaccctgtggtcactctcggtcgcaatcttctcggtcggcggaatgatcggatcctttagtgtgggacttttcgttaaccggtttggccgccggaactccatgctcatgatgaacttgctggctttcgtttccgcggttttgatgggcttctctaaactgggaaagtcattcgagatgctgatccttggtcgattcatcatcggtgtgtattgcggactgactaccggattcgtgccgatgtacgtgggggaagtgagccctaccgccttgcggggagcccttggaactctgcaccagctgggtatcgtggtgggcatcctcatcgctcaagtgttcggcctggactcgataatgggaaacaaagatctgtggccgctgctcctgtccatcatcttcatcccggcattgctgcagtgtatcgtgctccctttctgcccagaatcgccgcggttcttgttgattaacagaaatgaagagaatcgggcgaagagcgttttgaaaaagctgcgcggtaccgccgacgttacccatgatcttcaagaaatgaaagaagagtcacggcaaatgatgagagagaagaaggtgacgatacttgaactcttccgaagcccggcctatcgtcagccaattctcatcgccgtagtactgcagctgtcccagcagctgagcgggatcaacgcggtgttctactacagcacttccatattcgaaaaggccggagtgcaacagcccgtctatgctacgatcggctcaggaattgtgaatacggcattcactgtcgtgtccctcttcgtggtggagagggccggccgccgcactctccacctgattggattggctggaatggcggggtgcgccatcctcatgactatcgcgctcgcattgctggaacaactgccttggatgtcgtacctgtccatcgtcgccatctttggatttgtggccttcttcgaagtgggaccaggaccaattccgtggtttatcgtggccgagttgttctcccaggggccaagacctgcggccattgcagtcgcgggtttcagcaactggacctccaatttcatcgtcggaatgtgttttcaatacgtggagcagctgtgcggtccgtacgtgtttatcatctttaccgtcctgcttgtgctgttctttatctttacctacttcaaagtgccggaaactaagggtagaaccttcgacgagatcgcatcggggttcagacagggcggtgcctcacagagcgataagactccggaagagctgttccacccgctgggagccgactcgcaagtg

SEQ ID NO: 251225 - DNA, 1476 bp, Artificial Sequence
  Description of Artificial Sequence: Synthetic coding sequence
atggagccctcaagcaagaaacttaccgggcgcctgatgttggcagtgggcggcgcggtgctgggctccctgcagttcggttacaatactggagtgatcaacgccccgcaaaaagtcatcgaggaattctacaaccagacctgggtgcatcggtacggggaatcgatcctgccaacgacccttaccaccctctggagcctgtcagtcgcaatcttttcggttggaggaatgatcggctccttttccgtgggcctctttgtcaacagattcggacgccgcaactcgatgctgatgatgaatctcctggcgttcgtgtcagcagtgctcatggggttttccaaacttggaaagtctttcgagatgctgatcctgggtcgcttcatcatcggggtctattgcggtctgactaccggcttcgtgccaatgtacgttggtgaagtatccccgaccgcgttgaggggagcgctgggcactctccatcagctggggatcgtcgtgggaatcctgatcgctcaggtcttcgggcttgactccatcatgggaaataaagacttgtggccgctgctgctgtcgatcatcttcatccctgcgttgttgcaatgcatcgtgctgccgttctgtcccgaatcccctcgctttcttctgattaatagaaacgaagaaaaccgggccaagtcggtcctcaagaaactcagaggaaccgccgatgtcacgcacgacctgcaggaaatgaaggaagagagccgccaaatgatgcgggagaagaaggtgactattctcgagctgtttagatcacctgcctaccgccagccgatcctgatcgcagtggtgctgcagctgtctcaacagctgtccggaatcaatgctgtgttctactattccacttcgatatttgagaaggcgggtgtgcagcagcccgtctacgcgaccattgggtcgggcatcgtgaataccgccttcaccgtggtgtcgctcttcgtagtggaacgggccgggcggcgcactctgcacctgattggcctcgccggtatggcaggctgcgctatcttgatgaccatcgctcttgccctgttggaacaactgccatggatgagctacctgtcaatcgtggccattttcggattcgtggccttcttcgaagtggggccgggaccaatcccgtggtttatagtggcggaactgttcagccagggaccacgcccagccgccattgccgtggcaggattctctaactggacgtcgaactttatagtgggcatgtgcttccaatacgtggaacagctgtgcggaccgtacgtcttcatcatcttcactgtgctgctggtgctcttcttcatcttcacttactttaaagtgcctgaaaccaaaggccgcactttcgatgaaatcgcgagcggcttccgccaaggaggggcgtcgcagtccgataaaactccggaggaacttttccatccgctgggagccgactcgcaggtg

SEQ ID NO: 251226 - DNA, 1476 bp, Artificial Sequence
  Description of Artificial Sequence: Synthetic coding sequence
atggagccatctagcaaaaaactgaccggtcgtctcatgctggccgtcggaggagccgtcctagggtccctgcaatttggatacaatacaggcgtcattaatgcacctcagaaagtgattgaagaattttacaaccagacatgggtgcatagatatggtgaaagcatacttcccactaccttgaccaccctgtggtcactgtctgttgcaattttttccgttggcggcatgatcggatctttttccgtggggctattcgttaataggtttgggaggaggaattccatgctgatgatgaatctgcttgcattcgtgagtgcagtgctgatgggtttctctaagctgggtaagagcttcgaaatgttaatactggggcggtttattatcggggtctactgcggcctaacaacaggcttcgtcccaatgtatgttggcgaggtgagcccaaccgcactgcgcggcgcactgggcacactacaccagctcggcatcgttgtcgggattcttatagcacaagtgttcgggctagattcaatcatgggtaacaaagacctctggcccctgctcttatctattatatttataccagctttgctgcagtgtattgttctgccattctgtcccgagagccctcgcttcttactaatcaaccgaaatgaggaaaacagagctaagagcgtgctgaagaagttaaggggcaccgctgatgtgactcacgatctgcaggagatgaaagaagagagccggcagatgatgagagagaagaaggtgacaatactggaactctttaggtccccagcttataggcagcccattctgattgccgttgtcctgcaacttagccagcagctatctggcataaacgccgtcttttactacagcaccagcattttcgagaaggctggcgtgcaacagcctgtgtacgcaacaatcggatctggcatcgtgaacaccgctttcacagtagtgtctctctttgtggttgagcgggccggaagacgcaccctccatctgatagggctagctggcatggccgggtgtgcaatcctcatgaccatcgccctagctctgttagagcagctgccatggatgtcatacctgtccatagtagctatctttggctttgtggcattttttgaagttgggcccgggcctatcccttggtttatagtggcagagctgttcagccaaggacctcgccccgcagctatagcagtggctggcttctccaactggacttcaaacttcattgtgggcatgtgtttccagtatgttgagcagctgtgtggaccttacgtgtttattatctttactgtcctgctagtgctctttttcatttttacttactttaaggttccagagacaaaggggcgcaccttcgatgagattgcttctggctttcgtcaggggggagcttcccagtccgacaagaccccagaggaattatttcaccctctgggcgcagatagccaggtg

SEQ ID NO: 251227 - DNA, 1476 bp, Artificial Sequence
  Description of Artificial Sequence: Synthetic coding sequence
atggaaccttcgagtaaaaaattgactgggagactcatgcttgccgtgggaggggccgtgttggggagcttgcagtttggatacaacactggggttataaacgctcctcagaaggtgatcgaagaattctataatcagacatgggttcatcgttacggcgagtcaatcctccccacgacactaactacactgtggagcctctccgtggcaatcttctctgtgggtggtatgatcgggagcttctccgtcggcctgttcgtgaataggttcgggcggaggaattctatgttgatgatgaacctgctggccttcgtttccgcagttctgatgggattttcgaagctcgggaaaagtttcgagatgcttattctgggacgtttcattattggggtctactgtggactaactacaggatttgtgcccatgtatgtcggggaggtcagcccaacagctctgcgaggcgccctgggcactcttcaccaactaggaatcgttgtggggattctcatcgcccaggtgtttggcctggactctattatgggtaacaaagatctgtggccactgcttctgtcaatcatatttattcctgctctcctccaatgcattgtgctgcccttctgtcccgagtcacctcggttcctcctcatcaacagaaacgaggagaatcgcgcaaaaagtgttctcaaaaagctccgggggactgcagatgtcactcacgacctgcaggaaatgaaggaggagtccagacagatgatgcgggaaaaaaaggtgacaattctggaattatttagaagcccagcctatcgccagcccatcctcatcgccgtggttttacagctcagccagcaactcagtgggattaatgcggttttttactatagcacatctatctttgagaaagcgggggtccagcagcccgtctacgcgaccattggctctggcattgtcaatacagcttttaccgtggtgtccctctttgtagtcgagagggccggtcgtagaacattgcacctgatcggccttgcaggcatggcgggatgtgcaatccttatgaccattgcccttgccctgctcgaacagctgccctggatgagttatctgtctatcgtggccatctttggcttcgtcgctttttttgaggtggggccaggacctatcccctggttcatagtggcggaattgttttctcaaggacctcgtccagctgctatagccgtcgcaggattctcgaattggacctcaaactttatcgtgggcatgtgcttccagtatgtagagcaactctgtggcccgtacgtgtttatcatcttcacagttctgctcgttctcttctttatcttcacatacttcaaggtccccgaaactaaaggaagaacctttgatgagatcgcctccggcttccgacagggcggcgcctcacagtctgataagacacctgaggaacttttccaccctctcggggcagactcacaggtg

SEQ ID NO: 251228 - DNA, 1476 bp, Artificial Sequence
  Description of Artificial Sequence: Synthetic coding sequence
atggaaccaagctcgaagaagttgactggccgcctgatgctcgcggtcggcggagcagtgctcggttcgctgcagttcggctacaatactggcgtgataaacgcgccgcagaaggtgatcgaggagttctataaccagacctgggtgcaccgctacggcgaatccattctccccacgaccctgactaccctctggtcactgagcgtggcgatcttctctgtcggtggcatgattgggtcgttttcagtgggtctgttcgtgaaccgcttcgggagacggaatagcatgctgatgatgaatctgcttgcctttgtgtcggcggtgctgatgggcttttcgaagctcggaaaatccttcgaaatgctgatcctcggacggttcatcatcggagtctactgcggactgacgaccggtttcgtgccgatgtatgtgggcgaagtctccccaaccgccctccggggcgccctgggtactctgcaccaactcgggatcgtggtcggcattctgatagcccaggttttcgggctggactcgattatgggaaataaggacctttggccactgttgttgagcatcattttcatccctgccctgctgcagtgcatcgtgctgcctttttgcccggagtctccaaggttcctgctcatcaacagaaacgaggagaaccgggccaaatccgtgctgaaaaagttgcggggaactgccgatgttacgcatgatcttcaagagatgaaggaagaatcgcgccaaatgatgcgggagaagaaagtcaccatcctcgaactcttccggagcccagcctaccggcagccgatcctcatcgcagtggtcctccagctttcccagcaactctctgggatcaatgcagttttctactactcgactagcatcttcgagaaggcgggagtgcaacagccggtctacgccactatcggatcggggattgtgaacactgcattcaccgtggtgagcctgtttgtggtcgaacgggcgggaaggcggaccctgcatctcatcggactcgccggaatggccggatgtgcaatcttgatgactatcgcattggcgctgttggaacagttgccgtggatgtcctacttgtccatcgtggccatcttcggattcgtggcgtttttcgaggtgggaccaggtccaatcccttggtttatcgtcgctgaactcttctcacaaggaccgcgcccggcagctatcgctgttgccggattctcgaactggacttccaacttcatcgtgggcatgtgttttcagtacgtcgaacagctctgcgggccctatgtgtttatcatcttcaccgtgcttctggttctgttcttcatcttcacgtacttcaaggtgcctgagactaaaggacgaacctttgacgaaatcgcatctggatttcggcagggcggagcatcccaaagcgacaagaccccggaagaactgttccaccctctgggtgcggatagccaagtc

SEQ ID NO: 251229 - DNA, 1476 bp, Artificial Sequence
  Description of Artificial Sequence: Synthetic coding sequence
atggagccctcatccaagaaactcaccggtcggctgatgcttgccgtcggaggcgccgttttgggatcgcttcagttcggatacaacactggcgtgatcaacgctcctcagaaggtcattgaagaattctacaaccagacctgggtgcatagatacggagagtccatcctgcccaccaccctgactaccctctggtcgctgtcggtggccatcttctcagttgggggcatgatcgggtccttttcggtgggcctctttgtaaacagattcggacgccggaattccatgctcatgatgaatctcctggctttcgtcagcgccgtgttgatgggcttttccaagctcggaaagtctttcgaaatgctcatactcggaaggttcatcatcggggtctactgtggactcactaccgggtttgtcccaatgtacgtgggagaagtgtcgccaaccgcgctcagaggagctctgggaactttgcaccagctcgggatcgtggtcggaatacttatcgcgcaagtgttcggactggactcaataatgggaaacaaggatctctggccgctgcttctttcgatcatctttatcccggctctgctgcagtgtatcgtgttgccattctgccctgagtccccgaggttcctccttatcaaccgcaatgaggaaaaccgcgctaagtccgtcttgaagaagctgcggggtaccgcagatgtgacccacgacctccaggaaatgaaagaagagtcaagacaaatgatgagggaaaagaaagtcaccatactcgagctcttccgctcgccggcctacagacaaccaattctgatcgccgtcgtcctgcagttgtctcaacagctcagcggaatcaacgcggtcttttactacagcacgtcgatctttgagaaggccggcgtccaacagcctgtatatgccactatcgggagtggcatcgtcaatactgccttcaccgtcgtctccctgttcgtggtggagagggccgggagacgcactctgcacctgatcggcctcgcgggaatggcgggatgcgccatcctcatgactatcgccctggcgcttctggaacaactcccctggatgagctacctgtcaatcgtggcaattttcggcttcgtggccttcttcgaagttggaccgggcccaatcccgtggttcattgtggctgaactgttctcccaaggaccgcgccctgccgcgattgcagtggcgggattctcaaactggacctccaatttcatcgtgggaatgtgtttccagtacgtcgagcagctttgcggtccatacgtgtttatcatctttacggtgttgctggtgctgttcttcatcttcacgtacttcaaagtgccggagactaaagggcgtaccttcgacgaaatcgcttcgggattccggcaaggcggggcgagccagtcggacaagacccccgaggaactgtttcatccgctgggcgcggattcgcaggtg

SEQ ID NO: 251230 - DNA, 1476 bp, Artificial Sequence
  Description of Artificial Sequence: Synthetic coding sequence
atggaaccctcctcgaagaaactgaccggacgcctgatgctggctgtgggaggcgccgttctcgggtccctgcaattcggctacaatactggagtgattaacgcgccgcagaaagtgatcgaggagttctacaatcaaacgtgggtgcaccggtacggcgaatcaatcctccccactaccttgacgactctctggagcctgtcggtggccatctttagcgtgggtggaatgatcggttccttctcagtcggcctcttcgtgaatcgcttcggacggcggaactccatgttgatgatgaatcttttggcgttcgtgagcgcggtgttgatgggattttcaaagctgggaaagtccttcgagatgctcatcttgggaaggtttatcattggtgtgtactgtggactcactaccgggttcgtcccgatgtacgtgggggaagtgtcgcctaccgcactccggggcgcgctcggtactcttcaccagctcggaatcgttgtgggcatcctcatcgcccaagtgttcggactggatagcattatggggaataaagatctgtggccgctgcttctgtcgatcattttcatcccggctttgctgcagtgtatcgtcctcccattctgcccggaatcaccgcgcttcctcctgatcaataggaacgaggagaatcgcgctaagtctgtcctcaagaagctgcggggaactgccgacgtcacccacgacctgcaggaaatgaaggaagagagccgacagatgatgcgcgagaagaaggtcaccatcttggaacttttcaggtcacccgcctaccggcaacctatccttatcgccgtggtgctgcagctctcacagcagctgtcgggaattaacgccgtgttttactacagcacttcaatctttgagaaggccggagtccagcaacctgtctatgccactattggttcagggatagtgaacaccgcctttaccgttgtgtcgctgtttgtggttgaaagagccggacgcaggaccctccatcttataggcttggcagggatggctggttgtgcgatcctcatgaccatcgcgcttgcgctcctcgagcagctcccatggatgtcgtacctctcgatcgtggcgatctttggcttcgtggcgttcttcgaagtgggtccaggcccaatcccgtggttcatcgtggcggaactgttctcacaaggtccgcgcccggcggcgatcgcggtcgcaggtttttcgaattggacctcgaacttcattgtgggcatgtgttttcaatacgtggagcaattgtgcggaccgtacgtgttcatcatctttactgtgctcctggtcttgtttttcatcttcacgtacttcaaagtcccagaaaccaagggaagaacgttcgacgagatcgcctctggattcaggcagggaggtgcctcccagtccgataagaccccagaggaactgttccatccgctgggtgcagactcccaggtc

SEQ ID NO: 251231 - DNA, 1476 bp, Artificial Sequence
  Description of Artificial Sequence: Synthetic coding sequence
atggagccttcatcaaaaaagctcaccggtcgcctgatgctggcagttggaggcgccgtgctcggcagtcttcagttcggttataataccggagttattaatgccccccagaaggttattgaggagttctacaaccaaacatgggttcaccgctatggagagagcattctgccgactacattgacaactctgtggagtttgtccgtcgccattttctctgtcggcggtatgatcggaagtttctcagtgggacttttcgtgaacagattcggcagaaggaattctatgctcatgatgaacctgctggcgtttgtatccgctgttttgatgggcttcagtaagttgggcaagagtttcgagatgctgattttgggaaggtttatcattggtgtgtattgcggcctgaccactggcttcgtccctatgtacgtgggagaggtgtccccgacagctttgcgcggagccctcggaactctccaccaattgggcatagtcgttggaatcctgatcgctcaagtattcggtctcgattctatcatgggtaacaaggatctctggcctctgcttctgtccatcatcttcattcccgcgctgcttcagtgcatcgtgttgcctttttgcccagagtccccaaggttcctgctgattaacaggaatgaagagaatcgcgctaagtccgtcctcaagaagttgcgcggaacggcagatgtgactcatgacctgcaagagatgaaggaagagtctcgccaaatgatgagagagaaaaaggtcactattctggaactgttcaggtccccggcttaccgccagcccattttgatcgctgttgttctgcagcttagtcagcaactttctggtattaatgcagtgttttactacagtacaagcatcttcgagaaagctggagtgcagcagccggtatatgccacaattggaagcggcatcgttaatacagccttcaccgtcgtgagcctgtttgtggtagaaagggctggtaggagaacccttcacttgatcggcctggccggtatggctggttgtgcgattctgatgacgatcgccctggcacttctggaacaactgccatggatgtcttacctgtccattgtcgctatattcggatttgtcgcgttcttcgaggtgggacccggtcctattccgtggtttatcgtcgctgaactcttctcccagggacctcgcccagcggctatcgccgtcgctggcttctctaactggacttccaatttcatagtgggcatgtgtttccagtacgttgagcaactgtgcggcccttatgtgtttattatcttcaccgtgttgcttgtgttgttcttcatattcacctatttcaaggtccctgaaacaaagggaaggaccttcgacgagattgcttcaggctttaggcagggcggtgcttctcaatctgataaaacaccagaggagctgttccaccctctgggcgcggacagtcaggtg

SEQ ID NO: 251232 - DNA, 1476 bp, Artificial Sequence
  Description of Artificial Sequence: Synthetic coding sequence
atggagcccagttcgaaaaaactgacgggccgcctgatgctggcggtaggaggcgccgtcctcggatccctccaatttgggtacaacactggggttatcaatgctccccaaaaggttatcgaggagttctataatcagacctgggtgcatcgctatggcgagtctatcttgcctactacccttaccaccctgtggtctctatcggtggccattttttccgttgggggcatgatcggatctttttccgtgggacttttcgtaaatagattcggccggaggaacagcatgctgatgatgaacctactggcctttgtaagcgccgtcctgatgggcttctccaaactgggcaagagcttcgaaatgcttatactcggaagattcataatcggggtgtattgtggcctgaccacaggtttcgtgcctatgtacgtgggagaggtctctcccaccgcactccgaggagccttgggaacccttcatcagctcggcatcgtagttgggatattgatcgcacaagtctttggtctggatagtataatgggcaataaagacctgtggccacttcttttaagtattatctttattcccgccctactgcagtgtattgtcctgcctttttgtcctgagagcccaagattccttctgatcaacaggaacgaagaaaaccgagcgaagtctgtcctaaaaaagctccgtggaaccgctgatgtcacacacgatctgcaggaaatgaaagaagaaagccggcagatgatgagagaaaagaaggtcacaatactggaactttttcgctcccccgcatacaggcagcccattttaatcgccgtagtgttgcagctgtcacagcaactgtcagggatcaacgccgtgttctattactctacgtcaatattcgagaaggctggcgtgcagcagccagtttatgcgactataggatctggaatcgtgaataccgctttcaccgtcgtgtccctgttcgttgtggagagagcaggccgtcgtaccctccatttgattggcttggctgggatggcaggctgtgctattctgatgacgatcgctctcgctctgctggagcagctcccctggatgtcatacctgagtatcgtcgccatctttggctttgtggcatttttcgaagttggaccaggcccgatcccatggtttatagtggccgaactgttcagccaaggccctcggcctgcagccatagccgtcgccggtttctcaaactggacatccaacttcatcgtaggaatgtgctttcagtacgttgagcagctttgtgggccctatgttttcattatttttaccgtgcttttagtgctcttctttatttttacctatttcaaagtgcctgagactaaagggagaaccttcgacgagatcgccagtgggttccgtcaaggtggggcgagtcagagtgacaagacgccagaagaactcttccatcctctgggcgctgactcacaggtt

SEQ ID NO: 251233 - DNA, 1476 bp, Artificial Sequence
  Description of Artificial Sequence: Synthetic coding sequence
atggaaccctcctcgaaaaagctgacggggcggctcatgcttgccgtaggaggggcggtcctcgggtctctacaatttggatataataccggggtgataaacgcgccgcagaaggtcatagaggagttttataaccagacctgggtacacagatacggggaatcaatcctgcccaccaccctgaccaccttgtggtccctgtcggttgctatcttttccgtcggcggtatgataggcagtttcagtgtgggcctgtttgtaaaccgctttggtcgcaggaatagcatgctgatgatgaacctgctagcattcgtaagtgcagtgctgatggggttctccaaactcgggaaaagttttgagatgctaatcctgggcagatttatcatcggggtatattgcgggctgacaactggctttgttcccatgtatgttggtgaagtgagccccactgcactgagaggagctctcggtaccctgcaccagttgggaattgtagtgggaatcctgatcgcacaggtcttcggactggattctatcatggggaacaaggacctctggccgctcctcttaagcatcattttcattcctgccctcctgcagtgcatcgtcctgccattctgtccagagagcccacggttcttgctaatcaaccggaatgaggaaaatcgcgcaaagtccgttctgaagaagttgcggggcacggcagacgtcactcacgacctgcaagaaatgaaggaagagtctaggcaaatgatgcgagaaaaaaaagtgacaatacttgagctatttcggagtcccgcttatcgtcaacccatactgattgccgtcgtgcttcagttaagccagcagctttctggtatcaatgcagtcttctattactcgacttcaatcttcgagaaggccggagtccagcagcccgtgtatgctacgatcggtagcggaattgtcaatacagctttcacggtagtgtcactgtttgtggtcgaacgagccggccgtcgtacccttcacttgatcggtctggccggcatggcaggctgcgctatcctgatgacaatcgctctggccctgcttgaacagttgccttggatgagctatctcagcatagtcgccatattcgggtttgtcgcgttctttgaagtaggcccgggacccatcccatggtttatcgtggctgagctcttctcccaagggcctagacccgctgcaatcgcggtggcgggattcagtaactggactagcaacttcatagtaggaatgtgcttccagtatgtagagcaactgtgtggaccatatgtgtttataatcttcaccgtgctgctggtgcttttcttcatcttcacctattttaaggtgcctgagacaaagggtcggacatttgatgaaatagcttccgggttcaggcaaggcggcgcttcccaaagcgacaaaactcccgaagagctgttccacccactaggcgctgattctcaggtt

SEQ ID NO: 251234 - DNA, 1476 bp, Artificial Sequence
  Description of Artificial Sequence: Synthetic coding sequence
atggaaccgtccagcaagaagctcactggacgtctcatgctggcggtcgggggcgcagtgttgggatccttgcagttcgggtacaacactggagtgataaatgcacctcagaaagtgatcgaggaattctacaaccagacgtgggtgcacagatacggagagtcaatcctgcctacgaccctcaccaccctgtggtccctgtctgtcgcgatcttctcagtcggcggaatgataggatcgttcagcgtcggattgttcgttaaccgcttcgggcgaagaaactcgatgttgatgatgaaccttttggctttcgtcagcgccgtgctcatggggtttagcaagctcggcaagtcatttgagatgctcatcctgggtcgcttcatcataggagtgtactgtgggctgaccaccggatttgtgccgatgtacgtgggcgaggtgtcgcctactgctctgcggggtgcccttggaacccttcaccaactgggaattgtcgtgggtatcctgattgcccaggttttcggactcgattcaatcatgggaaacaaggacctctggccactcctgctttccatcatcttcattcctgcccttctgcaatgcatcgtgttgcccttttgcccggagtccccaaggttcttgttgattaatcggaacgaggaaaatagggcgaagagcgtactgaagaaactccggggaaccgcagatgtcactcatgacctccaagagatgaaagaagagagccgccagatgatgcgggagaaaaaggtgactattcttgaactctttcgctcgccggcgtacagacagccgatcctcatcgcagtggtgctgcagctctctcagcagctcagcggaatcaacgcggtcttttactactcaacctcgatcttcgagaaggccggggtgcagcagccggtctacgccactatcggatccgggatcgtcaataccgcttttactgtggtgagcttgttcgtggtggaacgcgccggacgacggacgctgcacctgataggcctcgcaggtatggcagggtgcgccattctgatgactattgcccttgctttgctggagcaattgccatggatgtcgtacctgtccatcgtggccattttcggatttgtggccttcttcgaagtggggccgggccccatcccatggtttatcgtcgcagaattgttctcacaaggcccacgcccggccgccatcgcggtcgcaggattctcgaactggacttccaatttcatcgtcggtatgtgcttccagtatgtggaacaactgtgcggcccatatgttttcattatcttcactgtgctgctggtgctgttcttcatcttcacctacttcaaggtgccggaaaccaaaggacgcacgttcgatgaaatcgcatccggattcagacagggtggggcgtcgcagtctgacaagacgccagaagaattgtttcatcctctgggtgctgatagccaagtc

SEQ ID NO: 251235 - DNA, 1476 bp, Artificial Sequence
  Description of Artificial Sequence: Synthetic coding sequence
atggaaccatcatccaaaaagctcaccggcaggctcatgcttgcggtgggaggcgccgtgctcggttcacttcagttcggctataacacaggggtcatcaacgcccctcagaaagtcattgaagaattctataaccagacctgggtgcacagatacggagaatccatcctgccaacaactctgaccaccctgtggtccctttctgtggccatatttagtgtcggcgggatgattggttcattttctgtcggcctgtttgttaataggttcggccgcaggaactctatgttaatgatgaacctcctggctttcgtcagcgcggtgctgatgggattctctaaactgggaaaaagtttcgagatgcttattctgggtcgctttataataggcgtgtattgtggacttactaccggcttcgtacccatgtatgtcggtgaagtcagccccacagccctgagaggtgccctcgggaccctgcaccaactcggaatcgtagtgggtatcctgatcgcgcaggtatttgggctggacagcatcatggggaataaagatctttggcctctcctgttgtcaattatttttattccagcactgttgcagtgtatcgttctgcccttttgtcctgaatccccacggttcctgctgatcaaccgcaatgaagagaatagggcaaagtcagttctcaaaaagttgcgcgggacagccgacgttacacacgacctccaggagatgaaagaagaatcccgccagatgatgcgcgaaaaaaaagtcacaatccttgaactgtttcggagtccagcctatcgccagccaatactaatcgctgtggtgttacaactgagccagcagctgagcggaatcaacgctgtgttttactattcaactagtattttcgaaaaggctggggtccagcagccagtctatgcaactatcggaagtggaatagtcaacaccgcatttactgtcgtgagcctgttcgtggtggagcgggctggtcgccggacgctccacctgattgggctcgctggtatggcgggatgcgctatcctgatgactattgctctagctctcttggagcaactaccttggatgtcttacctaagcatcgtggccattttcggctttgtggcctttttcgaggttgggcctgggcctatcccttggttcatcgtagcagagctcttttctcaaggcccacgtccagcagcaatcgccgtggccggattctctaactggactagtaattttatagttgggatgtgctttcaatacgtcgagcagctctgcgggccgtacgtgttcattatttttactgtgcttctggtactgttcttcattttcacatacttcaaggttcctgagaccaaagggcggacattcgatgagatcgcaagcggctttcgccaggggggcgcttcccagagcgataaaacacccgaagaattgttccatcctctaggcgcggattcccaggtc

SEQ ID NO: 251236 - DNA, 1476 bp, Artificial Sequence
  Description of Artificial Sequence: Synthetic coding sequence
atggagccaagctcgaagaagctcaccgggagacttatgctggcagtcggaggggccgtacttgggtcacttcagtttggttataacaccggagtgataaacgcacctcaaaaggtcatagaggaattctacaatcagacttgggttcacaggtacggagagtccattctccctaccacccttactaccctgtggagtctctcggtggccatcttcagcgtgggagggatgataggctccttttcagtgggtttgtttgtgaatcggtttggtagacgcaattctatgctgatgatgaaccttctggccttcgtctcggcagtgctcatgggattttcgaaactgggcaagagctttgaaatgctcatcctcggcagattcattatcggagtgtactgcggactgactaccggattcgtgccaatgtacgttggggaagtgagccccactgccctgaggggagcacttgggactcttcatcaactcggaattgtggtgggtattcttatcgcgcaggtctttggacttgattcaataatggggaacaaagacctctggccgctgttgctgagcattatctttattcccgcactcctgcaatgtattgtattgccattttgtcctgaaagccctcgtttcctcttgatcaatagaaacgaagaaaaccgggccaagtccgtcctgaaaaagctgcggggaactgcggatgtcacccacgacctgcaggagatgaaggaagagtcgcgtcaaatgatgcgggaaaagaaggtgaccattctggagctgttccgatccccggcatataggcagccaattcttattgcagtggtccttcaactgtcacagcaactttcaggtataaacgctgtgttttactactccacgtccatctttgagaaggcaggtgtccagcagcctgtgtacgcaactattggttccggcatagtaaataccgcatttactgtcgtgtcgctgttcgtcgtagaaagagcaggcagacgcacgctgcatctgattggactcgccggtatggcggggtgcgcaattcttatgaccatagcactggcactgcttgaacagttgccatggatgtcgtacttgagcatcgtggcgattttcggatttgtggctttctttgaagtgggacctggccccatcccctggttcattgtggccgaattgttttcgcaaggtcctcgtccagccgcaatagcggttgcaggcttctcaaactggacctccaactttatagtgggtatgtgttttcaatacgtcgagcaactttgtggaccgtacgttttcattatctttactgtgcttcttgtgctgtttttcatcttcacgtactttaaggtgcctgagactaaagggcgcacctttgatgaaatcgcctcgggttttcgccaagggggcgcttcccagtctgacaaaactcccgaagaactctttcatccccttggtgcagattcgcaagtg

SEQ ID NO: 251237 - DNA, 1476 bp, Artificial Sequence
  Description of Artificial Sequence: Synthetic coding sequence
atggagccttcctcgaaaaagctcactggccggttgatgttggcagtgggtggagcagtgcttggatcgctccagttcggttataataccggggttatcaatgccccacaaaaagtcattgaggaattttataatcaaacatgggtccacaggtatggagagtcgattctacctaccacacttactaccttgtggtcgctatctgttgccattttctccgtcgggggcatgatcggttctttctccgtcggtctgtttgtgaatcgtttcggacgccgcaactccatgctgatgatgaacctcttggccttcgtctcagcagtgctgatgggattctctaagctcggcaagtcttttgaaatgctaatactgggccgatttattatcggcgtgtactgtggcctcactaccggattcgtccccatgtatgttggagaagtgagtcccactgccctccgaggcgctcttggaacactccatcaacttggtattgtggtcggtattttgattgcgcaagttttcggtctggattccatcatgggcaataaagacctctggcctttgttgctgtcgatcatttttatcccagcccttctacaatgcatagtgctcccgttttgtccagagtcccctagattcctcctgataaatcggaatgaggagaaccgagccaagtcggttttgaaaaagttgagaggaactgcggatgtcactcacgacctccaggaaatgaaagaagagtcccgacagatgatgagggagaagaaggtcacaatcttggagctattccgcagccccgcgtatcgccagcctattctgattgcagttgtcttacagctctcacagcaacttagtggaataaacgctgtcttctactattccacatctatttttgagaaagcgggcgtccagcagcctgtgtatgctaccattggaagtggtatcgtcaatacggccttcacggttgtttctctctttgttgttgaacgagcggggcgccgaactctccatttgatcggactggcgggaatggccggctgtgccatcttgatgacaatcgctctcgccctcttggagcaattgccatggatgtcctatttgtctatagttgccatatttggattcgtggccttttttgaggttggccccggtccgatcccatggttcatcgtggcagagttattctctcagggtcccaggccggcagcgatcgctgtcgcggggttctcgaactggacaagcaattttatagtaggtatgtgcttccagtatgttgagcaactatgcggaccttatgtcttcattatcttcactgtgctcttggttctcttcttcatttttacctacttcaaggtacccgaaaccaaggggcgtacctttgatgagattgcaagcggcttcagacagggtggcgcgtctcagtcagacaaaacgccagaagaactatttcatccgcttggtgcggatagtcaggta

SEQ ID NO: 251238 - DNA, 1476 bp, Artificial Sequence
  Description of Artificial Sequence: Synthetic coding sequence
atggagccaagttccaagaagcttacaggacgccttatgctggccgtggggggcgccgtccttgggagcctccagttcggatacaacacaggcgtgatcaatgcacctcaaaaggttatcgaagagttctacaaccagacttgggtgcataggtatggcgagtctattctacccactactctgaccactctgtggagtttgtctgtagcaatcttcagcgtcggcggcatgattggttctttttctgtgggcctctttgtaaacagattcggcagaaggaactctatgctcatgatgaatctgctcgcctttgtgagcgcggtgttgatgggtttctctaaactcggcaagtccttcgagatgttaatactgggccgtttcattataggagtgtattgcggactcaccacagggttcgtgcccatgtatgtaggtgaggtgtcacctacggccctgagaggagccctgggaactctgcaccaactgggcatcgtggtgggaatcctgatcgcccaggtattcggactggattctattatgggaaataaagacttatggccactcctcctgtcaatcattttcatccccgctctcctccagtgcattgtcctgcccttctgccccgaaagcccacgctttctgttaatcaatcggaatgaggagaacagggctaagagcgtgctcaagaagttaagaggtaccgctgacgtaacgcacgacttgcaagagatgaaggaggaatcccgacaaatgatgagggaaaagaaggtgactatcctggagctgttcaggtccccagcctataggcagcctatacttattgctgtcgttcttcagctgtctcaacagttgtctggaattaacgccgtcttctattatagtaccagtatatttgagaaagctggagtgcagcaacctgtgtacgcgaccatcggctccggcatagtaaacaccgcttttaccgtggtctccctgttcgtggtggagcgagccgggcgccgcactcttcacctcattggacttgctggaatggcaggatgcgcaattcttatgacgatcgctctggcgttgctggagcagctgccatggatgtcctacctcagcattgtcgcgatctttggatttgttgcattctttgaagtcggcccgggacctatcccctggttcatcgttgccgaactttttagccagggcccacgccctgcagcgattgcggtcgccggcttcagcaactggacaagtaattttatcgtaggcatgtgttttcagtatgttgaacagctgtgcggcccctatgtgtttataatcttcactgtcctgcttgttctgttttttatctttacttattttaaagtgccagagaccaagggacgcaccttcgatgagattgcgtccggcttccggcaaggcggggcctcacagtccgacaagacacccgaagagctgtttcaccccctgggggcagattcccaggtg

SEQ ID NO: 251239 - DNA, 1476 bp, Artificial Sequence
  Description of Artificial Sequence: Synthetic coding sequence
atggaaccctcatctaagaagcttacgggccggctgatgttggctgtgggtggtgccgtcctgggttccctacagttcggctataacaccggagtcatcaacgctccgcagaaagtcatcgaagaattctacaaccagacatgggtacatcggtatggcgagtccattttgccaaccaccctcaccacactttggagcctcagtgttgccatcttctctgtaggcggcatgattgggtcgttctcggtaggcctgttcgtgaatcgtttcggcaggcggaacagcatgctgatgatgaacctccttgcctttgtatccgctgtcctcatgggattttctaagctgggaaagtctttcgaaatgcttattctgggccggttcattataggcgtctattgtggactgactactgggtttgttcctatgtacgtcggagaagtttcccccactgccctgcgaggtgcactggggaccctccaccagcttgggatcgtcgtaggcattctgatcgcccaggtctttgggcttgatagtatcatggggaacaaagatctgtggcccctgctgctctcaattatattcatcccggcccttcttcagtgcattgtgttgccgttttgtcctgagagcccacggtttcttctgatcaacaggaatgaggaaaacagggcaaagtcggtgctgaagaaactgcggggaaccgccgacgtgacccacgatttgcaggagatgaaagaggagtcacgacagatgatgagagaaaagaaggtcacgatactcgagctttttaggtcccctgcctaccgtcaaccaatcctgatcgctgttgtgctgcaactcagccaacagctatcgggaataaatgctgtgttctactattccaccagtatctttgaaaaggccggcgtacagcagcctgtgtacgctaccataggcagtggaatcgtcaacaccgctttcacagtcgtctccctattcgttgtcgagcgcgctggccggagaacattgcacctgattggactggctggaatggccggctgtgcgatcctgatgaccatagctctcgcattgctagagcagcttccatggatgtcatatctcagtatcgttgccatctttgggttcgtggcctttttcgaggtgggcccgggccctatcccatggttcatagtggcggagttgttcagccagggaccgcgtccggcagcgatcgccgtggcaggctttagcaactggacttctaacttcatcgttggcatgtgtttccagtacgtggagcagttatgcggcccctacgtttttatcatctttaccgtactgcttgtgttgttcttcatctttacatatttcaaagtccccgagaccaaggggagaacattcgacgagatcgcatctgggttccgccaaggcggagcatcccagtcagacaagacccctgaagagctgttccaccctcttggtgcagattcgcaggtg

SEQ ID NO: 251240 - DNA, 1476 bp, Artificial Sequence
  Description of Artificial Sequence: Synthetic coding sequence
atggaaccatcatccaaaaagctcaccgggcggttgatgctggctgtgggaggcgcggtcttgggttcactccaattcggatacaacaccggagtgattaatgcaccccagaaagtgattgaggagttttacaatcagacttgggtgcatcgctacggagaatcaattctgccgaccacgcttactactttgtggtcgctgtccgtagccatctttagtgtcggaggaatgatcggttccttttccgtgggactttttgtcaacagatttggtcgcagaaactctatgctgatgatgaatctccttgcattcgtgagcgcagtgctgatgggattttcaaagctcggtaagtcctttgaaatgcttatccttggcaggtttatcataggggtgtactgtggtttgaccactggatttgtccccatgtacgtgggggaagtgagccctaccgcacttaggggtgccctcggcaccctgcaccagcttgggatcgtggtgggtatcctgatagcccaggtctttggacttgattcaatcatgggaaacaaagacctctggcccttgttgctgtcaataatctttattcctgcactcctgcagtgcatcgtgcttcccttttgtccagaaagcccacggtttttgttgattaaccgcaacgaagaaaatagagcaaagtctgttcttaagaagctgcgtgggaccgccgatgtgactcacgaccttcaggagatgaaagaagaatcgcgccaaatgatgagagagaagaaggtcacgattctcgagctttttagatccccagcttacagacaacccattctgatagcagtggtcctgcagctttcgcaacagctgtctggcatcaacgcagttttctactactccacctcgatatttgaaaaggccggtgtccaacaacctgtctacgccactattggctccggcattgtgaatacggctttcactgtggtgagcctgttcgtggtagagcgagcaggtcggcgaactctccatttgataggtcttgcagggatggcgggatgcgctattctgatgaccatcgcacttgctctcttggagcaactgccttggatgtcatatctcagcattgtcgcaatcttcggatttgtggcattctttgaagtggggcctggtcccattccctggtttattgtggcggaattgttctcgcaaggacctagacctgcggcaattgcagtggccggattttccaactggacttccaactttatcgtaggaatgtgtttccaatacgttgagcaactgtgtggtccatatgtgttcatcatattcaccgtgctgcttgtcctctttttcatcttcacttactttaaggtcccggaaactaagggcagaacctttgacgaaattgcttccggattcaggcaaggaggagcctcccagtccgataaaactcctgaggaactctttcatccacttggcgcagattcgcaggtc

SEQ ID NO: 251241 - DNA, 1476 bp, Artificial Sequence
  Description of Artificial Sequence: Synthetic coding sequence
atggagccaagctcgaagaagcttactggcagactgatgctcgcagtgggcggagccgtgctggggagtctgcagttcggctataacactggcgtgatcaacgccccccaaaaggtcatagaggagttttacaaccagacttgggttcaccgctatggggaaagcatccttcccacaaccctgaccactctgtggtcactgtcggtagcaatcttcagtgtcgggggcatgattgggtcattttctgttgggctctttgttaatagatttgggcgcagaaattccatgctgatgatgaacctgttggccttcgtgtccgcggttctgatggggttctctaagctgggcaagagttttgaaatgctgatcctgggacgatttattatcggggtctactgcggacttacaactggctttgtgccaatgtatgtgggagaggtcagtccaacagcccttcggggcgccctgggcactctgcatcagttggggattgtcgtgggaatcctgattgcccaggtgttcggtctggactcaataatgggcaacaaagatctctggccccttctgctttcaatcatctttatccctgcgctcctgcagtgcatcgttctcccattttgtcccgagtccccacgcttcctgctcatcaaccgaaatgaggaaaacagggcaaagtctgtgttaaagaagctaaggggtaccgcagacgtaactcacgacctgcaggaaatgaaggaagaatctaggcagatgatgagagagaagaaggttactatcctggaactcttccgtagccccgcataccgtcagcctattctgatcgccgtcgtgctgcagctctcacagcagctgagcggaattaatgcagtgttttactatagtacttctatctttgaaaaagcaggtgtgcagcagcccgtgtatgccactataggatctgggatcgtgaatactgcgttcacggttgtgagcctgttcgtggtggagagggcggggagaagaaccttacatctaatcggcctcgctggcatggccgggtgtgcaatcctgatgaccatcgcactggccctcttagaacagctgccctggatgagttacttgtctattgtggctatctttggcttcgtggcttttttcgaggtggggccgggacccattccttggttcatcgtggcagagcttttctctcagggacccagacccgcagcgattgcagtcgccgggttctctaactggacgagtaactttatcgtggggatgtgtttccagtacgtagaacaactttgcggaccatatgtgttcatcattttcaccgtcctgcttgtcctgttcttcatcttcacttatttcaaagtgcccgaaacaaagggtcgtactttcgatgagattgcctctggattccgccagggaggcgccagtcagagtgataagactcccgaagaactcttccacccgcttggagcggattctcaggtc

SEQ ID NO: 251242 - DNA, 1476 bp, Artificial Sequence
  Description of Artificial Sequence: Synthetic coding sequence
atggagccatcttcaaagaagttgaccggacgtctgatgctcgccgtcggcggagccgtcctggggtcactgcagttcgggtacaataccggagtcatcaacgctccccagaaggtcatcgaagagttctataatcagacctgggtgcatagatatggagaatcgatcctgccaactactctgacgaccttgtggagcctgtctgtggctatcttctcagtgggagggatgatcggttcgttctcagtcggtcttttcgtgaaccgcttcggacgcagaaactcgatgctgatgatgaacctcctcgcctttgtttcagccgtcctgatgggattctcgaagctggggaagtcgtttgagatgctgatcctcgggcggttcatcattggcgtgtactgtggtttgaccaccggctttgtgccgatgtacgtcggcgaggtgagcccaactgcccttagaggtgccctcggaactcttcaccaactcggaatcgtcgtggggatcctgatcgcccaggtgttcggactcgattctatcatgggaaacaaagacttgtggcccctgctgcttagcattatcttcatcccggcgctgctccagtgcattgtcctgccgttctgccctgaatcgccgcggttcttgctgatcaatcgcaatgaggaaaatcgcgccaagtcggtgctgaaaaaactgaggggcaccgctgatgtgacccatgatctgcaagagatgaaggaagagtcccgccagatgatgcgggagaaaaaggtgacgatcctcgagctgttccgctccccagcctaccgccagccgatcctcatcgcagtggtgctgcagctctcccagcaactcagcggtataaacgctgtgttctactattccactagcatcttcgagaaggccggcgtgcaacaacctgtttacgcaactatcggatccggaattgtgaacactgccttcaccgtcgtcagcctgtttgtggtggaacgggcgggacgccggaccctgcatctgatcggcctggcaggaatggccggttgcgcaatcttgatgacgatcgccctggccctgctggaacagttgccttggatgagctacctgtcgattgtggcgatttttggctttgtggctttctttgaggtgggtccgggaccgattccgtggtttatcgtggccgaacttttttcgcaaggacctaggcctgcagcgatcgcggtggccggcttcagcaactggacttccaacttcatcgtggggatgtgcttccagtacgtggagcaactgtgtggtccttacgtgtttatcatctttactgtcctgctcgtgctgttctttatcttcacctactttaaagtccctgagactaaggggcgcaccttcgatgaaatcgctagcggatttcggcagggaggagcctcacagtcggacaagacccccgaggagctcttccatccattgggtgccgactcccaagtc

SEQ ID NO: 251243 - DNA, 1476 bp, Artificial Sequence
  Description of Artificial Sequence: Synthetic coding sequence
atggagccttcgtctaaaaagcttacagggaggcttatgctggccgtgggcggcgccgttctcggcagcttgcagttcggctacaatacaggtgtgattaatgctccacaaaaggtcatcgaagagttttataatcaaacttgggtgcaccggtacggcgagtccattctgcctaccacactaacaactctgtggagcctctctgtagccatattttctgtgggggggatgatcggctcgttctccgtgggcttgtttgtgaatagattcggtagaaggaactcgatgcttatgatgaatttactggcctttgtcagcgcggtgctgatggggttttcaaagttgggcaagtcattcgaaatgttgatccttggcaggttcattataggcgtgtattgcggactgaccactggatttgtcccgatgtatgtgggcgaagtatccccgactgcccttcgaggtgccctgggaaccttgcatcagctcggaatcgtggtaggcatactcattgcacaggtgtttggcctagatagcataatgggcaacaaagatctgtggcctctccttctcagcatcatcttcatacccgcacttctgcagtgtattgtccttccattctgccccgagagcccccgttttctactaattaacagaaacgaggagaacagggcaaagagcgtactgaagaaactgagaggaactgccgacgtgactcatgatttgcaggagatgaaggaagaaagccgccagatgatgcgagagaaaaaagtcacgatcctggagcttttcagatcccctgcctaccgccagcctatccttatagccgttgtcttacagctcagtcagcagttgtcaggcatcaacgcggtcttctactacagcacaagcatatttgagaaagcaggagtgcagcaacctgtgtacgcaaccatcggctcaggtatcgtgaacaccgcatttacagtggtctctctgtttgtggttgaacgtgcaggtagacggacacttcatttaatcggcctggctggaatggcaggatgtgcaatattaatgacaatcgctctcgctttgcttgagcagttgccttggatgtcatatctctcaatcgtggccattttcggattcgtggctttttttgaggtcggaccaggacctataccgtggttcatagttgctgagctgtttagtcagggccccagaccagccgctattgcagtggcaggcttttctaattggacttctaattttattgtgggcatgtgtttccaatacgttgagcagctgtgtggaccctatgtcttcattatattcaccgtgcttctagtcctgtttttcatttttacttacttcaaggtacctgagactaagggccgcacatttgatgagatcgcctcagggttccgccagggcggggcatcccagtcggataaaacaccggaggagctcttccacccgttgggagcagactctcaggtg

SEQ ID NO: 251244 - DNA, 1476 bp, Artificial Sequence
  Description of Artificial Sequence: Synthetic coding sequence
atggaaccaagtagtaaaaaactaacaggacgactgatgctcgctgtcggaggagccgtgctagggagtctgcaattcgggtataacacaggggtgatcaacgccccacagaaggtaattgaagaattctataatcagacttgggtccaccggtatggggagtccatcctgcctacaacactcacaacactctggtcgctctctgttgcaatattttccgttggagggatgatagggtcatttagtgtaggactttttgtgaataggttcgggcgccggaattcaatgttaatgatgaatcttttagcatttgtaagtgctgtgttaatgggattctcaaaactcgggaagagttttgagatgctgatcttgggacggttcatcatcggggtctactgtgggctgactacaggattcgtacccatgtatgtcggagaagtgtcgcccacggccttaagaggagcactcggaacattacaccagctggggattgtggttgggatactaatagcacaggtgttcgggctcgatagtatcatgggaaataaggatctatggcccctcctgctttctatcatattcatccccgccctcctccagtgtatagtcttaccattctgtcccgaatctccacggtttctcctcatcaacaggaacgaggaaaatagagcaaagtccgtcctgaaaaaattacggggaactgcagatgtgactcacgatcttcaggaaatgaaagaagaatcacggcaaatgatgcgggaaaaaaaagtgactatacttgaactttttagatcacctgcttataggcagcccatacttatcgccgtagttctacagctgagtcagcaattatctggaatcaacgctgtgttttactattccacttcaatatttgagaaagcgggggttcagcagcctgtgtacgcaacaattggatcaggaatcgtaaacactgcctttacagttgtatctttatttgtggtggagcgcgccgggagacgaactctccatctcatcgggctcgcaggaatggccggatgtgctatattgatgacgatcgcacttgccctactcgaacagctcccctggatgagttacctttcaatcgtcgctattttcggattcgtggcctttttcgaagttggaccaggaccaatcccatggtttatcgtcgccgaactcttttcacagggacctagacccgccgcaatcgcggtggctgggttctccaactggacatcaaacttcattgttgggatgtgtttccagtacgtagagcagctctgtggaccttatgtatttataatctttacagttctgttagtgttgttcttcatcttcacatattttaaagtgcctgaaacaaaagggaggacattcgatgaaatagcctctggatttaggcaggggggagcctctcagtcagacaaaacacccgaagagttatttcatcctctaggggctgattctcaggta

SEQ ID NO: 251245 - DNA, 3591 bp, Artificial Sequence
  Description of Artificial Sequence: Synthetic coding sequence
atgctgtggtgggaggaggttgaggattgctacgagagagaggacgtgcagaagaagacattcactaagtgggtgaatgcccagtttagcaagttcggtaagcagcacatagaaaacctgttttcagacctgcaagacggtaggaggctgctggacttgttagaaggcctgactggacagaagctgccaaaagaaaagggaagcacccgagttcatgcgctcaacaacgtgaataaagcgctgcgagtgctgcagaacaataatgttgatctagtgaatataggctccactgatatagtggacggcaaccacaagctgaccctcggacttatctggaatattatcctgcattggcaagtgaaaaacgtgatgaagaatataatggccggtctccagcagacaaactcagagaagatcctgttgtcctgggtgagacagtccacccgaaattacccacaagtgaatgtcattaactttactacaagctggtcagatggactcgcactcaacgcactgattcactctcatcgacctgacctgtttgattggaatagcgtggtgtgtcagcagagtgcaactcaacggctggagcatgcattcaatatagcaagataccaattgggaatcgagaaactgttggatcctgaagacgttgacacaacctacccagataaaaagtctatcctgatgtacatcaccagtctcttccaagttctgccccaacaggtcagcatcgaagctattcaggaggtggaaatgctgccacggcccccaaaggtgaccaaagaagaacattttcagttacaccaccagatgcactactctcagcagattactgtgtctctagctcagggatacgagagaaccagctcaccgaagccccgattcaagagctacgcctacacccaggctgcttatgtgaccacaagtgacccgactagaagcccattcccctcacagcacctggaagctccagaggataagtcctttggttcttccctcatggaatccgaagtcaatctcgaccgataccagaccgccctggaggaagtgttgtcttggctactgtcagcggaggacacgctacaggcacagggcgagatttcaaacgacgttgaagtggtgaaggaccagttccacacacacgaaggatacatgatggatttgactgctcaccaggggagggtaggaaatatcttgcaactaggaagcaaactgattggaaccgggaaacttagtgaagatgaggagactgaagtgcaagaacaaatgaatttgctgaattcgcgatgggaatgtttaagagtagcaagcatggaaaagcagagtaatctgcacagagtcttgatggacctgcagaaccagaaactgaaggaactgaacgattggctgactaaaactgaggagcgaacacgtaagatggaggaagaaccacttggtcccgatttagaagatctcaagaggcaggtgcagcagcacaaagtcctgcaggaagatctagagcaagaacaggtacgtgtgaactcattgacccacatggttgtcgtcgtcgacgagagtagtggcgaccatgccaccgctgccctcgaagaacaattgaaggtgttgggggaccgttgggctaatatttgccgatggactgaagacagatgggtgctgttgcaggatatattgctgaagtggcaaagacttaccgaagaacagtgcctctttagcgcttggctctcggagaaagaagacgccgtcaacaaaatccataccaccggatttaaggatcagaacgagatgctctcatctctccagaagctcgctgtactgaaggctgatctggaaaaaaagaagcagtctatgggtaagctgtacagtctgaagcaggatttgctttctaccctaaagaataaatcagttactcagaagactgaggcgtggctcgacaatttcgcacgttgttgggacaatctggtgcagaaattagagaagtcgacagcccagatatcccaagccgtgaccacaacccagccgtccctgacacagaccacagtcatggaaactgttacaactgtgactacccgagaacagatcctcgtcaagcatgctcaggaagaacttcccccacctcctccccaaaaaaagcggcaaattaccgtggatacgctcgagcgactccaggagctgcaggaagctaccgacgagttggaccttaaactcagacaagcagaagtcatcaaaggcagctggcaaccagttggcgacttgttgattgattccctacaagatcatctggaaaaagttaaggcgctgaggggggagattgcaccacttaaagagaacgtgtctcatgtgaatgatctggccagacagcttacaaccttggggatccaactcagtccctacaatttgtctacactcgaagacctcaatactcgatggaagttacttcaagtcgcggtggaggatcgagttagacagttacacgaggcacatcgggacttcggccccgcctctcagcatttcctttcaacctccgtgcaggggccctgggagagggcaatctcccctaacaaggtgccctactacatcaaccacgaaacacagaccacctgctgggatcacccaaaaatgacagagctgtaccagagtttggctgatctgaacaacgtccgtttcagcgcgtataggactgccatgaaactgcgcagattacagaaggcactgtgtctcgatcttttgtctctgagcgccgcatgcgacgccctggaccagcataacctgaaacagaatgatcagcctatggatatcctccagatcattaactgtcttacaacgatctacgaccgcttggagcaagaacacaataacctagtgaatgtaccactctgcgtggatatgtgtctgaactggttactcaatgtctacgacacaggacgaaccggaaggattcgggttctctcgtttaagactgggataataagtctttgtaaggcccacctggaggacaagtacagatatcttttcaaacaggtcgcgtcgtctaccgggttttgtgatcagcgcaggctgggactgctgcttcatgattcaatacagatcccgagacagctcggggaagtggccagttttggaggcagtaacattgagcccagcgtgagatcttgcttccaatttgctaacaacaagcctgagattgaggccgctctgtttctcgactggatgaggctggaaccgcagagcatggtatggttaccagtgttgcatagggtggcagctgcagagaccgccaagcatcaagctaagtgcaatatctgcaaggagtgcccaatcattggattccgataccggtctctgaagcactttaattatgacatctgtcagtcatgtttcttcagcggtcgcgtggctaaaggccacaagatgcactatcccatggtggaatactgtacccctaccacgagtggcgaggacgtgcgagactttgctaaagtcctgaagaataaattcagaaccaagaggtatttcgcaaaacacccgagaatggggtacttgccagtgcagactgttctagaaggtgacaacatggaaactgataccatg

SEQ ID NO: 251246 - DNA, 3591 bp, Artificial Sequence
  Description of Artificial Sequence: Synthetic coding sequence
atgttatggtgggaagaagtggaagactgttatgaaagagaagatgttcaaaagaaaacttttaccaaatgggtaaatgcacaattttcaaaatttggtaaacaacatattgaaaatttattttctgatcttcaagatggtagacgattattagatttattagaaggtttgacaggacaaaaacttccaaaagaaaaaggttctacaagagttcatgctttaaataatgttaataaggcattaagagtcctacaaaataataatgtcgatttagttaatattggatccactgatattgttgatggtaatcataaattaacattaggacttatctggaatattatattacattggcaagtaaaaaatgttatgaaaaatattatggcaggattacaacaaacaaattcagaaaaaattttacttagttgggtgagacaatcaacacgtaattatcctcaagtgaacgttattaattttacaacatcttggagtgatggattggctcttaatgcattaattcattctcatagaccagatttatttgattggaactcagttgtttgtcaacaatcagctacacaaagattagaacatgcattcaatattgcaagatatcaattaggtatcgaaaaattattagacccagaggatgttgatacaacttatccagataagaaatcaattcttatgtatattacaagtttatttcaagtacttccacaacaagtaagtatagaagcaatacaagaagtcgaaatgttgccaaggccacctaaagttacaaaagaagaacattttcaattacatcatcaaatgcattattcacaacaaattactgtttctttagcacaaggatatgaaagaacatcttcacctaaaccacgattcaagagttatgcttatactcaagctgcttatgttacaacttcagatccaacaagaagtccattcccttcacaacatttagaagcacctgaagacaagtcttttggatcatctttaatggaatctgaagttaacttagatagatatcaaacggctttagaagaggtgctttcatggcttcttagtgccgaagatactcttcaagcacaaggtgaaatcagtaatgatgttgaagttgttaaagatcaatttcatactcacgaaggatatatgatggatttaactgctcatcaaggacgtgttggtaatatattacaacttggatcaaaacttataggaacaggaaaacttagcgaagatgaagaaactgaagttcaagaacaaatgaatcttcttaattcaagatgggaatgtttaagagtcgcttcaatggaaaaacaatctaatcttcacagagtattaatggatctacaaaatcaaaaacttaaagaattaaacgactggttaactaaaactgaagaacgtactagaaaaatggaagaagaaccattaggtcctgatttagaagatttaaaaagacaagttcaacaacataaagttcttcaagaagatcttgaacaagaacaagttagagtaaattctttaacacatatggttgttgttgtagatgaatcatcaggggatcacgctactgctgcacttgaagaacaattaaaagttttaggagacagatgggcaaacatttgtcgatggacagaagacagatgggttttgttgcaagatatacttttaaaatggcaacgactcactgaagaacaatgtcttttttcagcttggttatcagaaaaagaagatgctgttaataaaattcatacaactggttttaaagatcaaaatgaaatgttaagtagtttacaaaaattagcagttttaaaggctgatttggaaaaaaaaaaacaatctatgggaaaattatatagtcttaagcaagatttgttaagtactcttaagaataaatcagttacacagaaaactgaagcttggcttgacaattttgcaagatgttgggataatttagtacaaaaattagaaaaatctactgcacaaatttcgcaagcagtaacaacaacacaaccatcacttactcaaaccactgttatggaaactgtaacaactgttacaacaagagaacaaattttagttaaacatgctcaagaagaattaccacctccacctccacaaaaaaaaagacaaataactgttgatacattagagagattacaagaacttcaagaagccacagatgaacttgatcttaaattgagacaagctgaagttataaaaggaagttggcaaccagttggagatcttttaattgattcattacaagatcatcttgaaaaggtaaaagcattaagaggagaaattgcccctttaaaagaaaatgtatcacatgtaaatgatcttgcaagacaacttactactttaggaatacaattaagtccttataatttatcaaccttagaagatttaaacactagatggaaacttttacaagttgctgttgaagacagagttagacaactccatgaggcacatcgagattttggaccagcatctcaacattttcttagtacatcagttcaaggaccatgggaaagagctatttctccaaataaagttccatattatattaatcatgagacacaaacaacttgttgggaccatccaaagatgactgaactttatcaatcattagcagaccttaataatgttagattttctgcttatagaacagccatgaagttacgtagattacaaaaagctttatgtttggatcttttatcattatctgcagcatgtgatgcattagatcaacataatttaaaacaaaatgatcagccaatggatatacttcaaattattaattgccttacaacaatttatgacagacttgaacaagaacacaataatttagtaaatgtccctctttgtgttgatatgtgtttaaattggcttttgaatgtatatgatacaggaagaacaggtagaattcgtgttttgtctttcaaaactggaattataagtttatgcaaggctcacttagaagataaatatagatatttattcaaacaagtagcttcttcaactggattttgtgatcaaagaagacttggattacttttacatgactctattcaaattccaagacaattgggagaagtggcaagtttcggtggatctaatatcgaaccttctgtaagatcttgctttcaattcgctaataataagccagaaatcgaagcagcattatttcttgattggatgcgattagaaccacaatcaatggtttggcttccagttttacatagagttgctgcagctgaaacagctaaacaccaagctaagtgtaatatttgtaaagaatgtccaattattggattcagatatagaagtttaaaacattttaattatgacatatgtcaatcttgtttcttttcaggtagagttgcaaaaggacataaaatgcattatccaatggtagaatattgtactccaacaactagtggagaagatgtaagagattttgctaaagttcttaaaaataagttcagaactaagagatactttgctaaacatccaagaatggggtaccttccagttcaaacagtattagaaggagataatatggagacagatacaatg

SEQ ID NO: 251247 - DNA, 3591 bp, Artificial Sequence
  Description of Artificial Sequence: Synthetic coding sequence
atgctgtggtgggaagaagttgaggactgttacgaaagagaggacgtgcaaaagaaaactttcaccaagtgggtgaacgcgcaattctcaaagttcggcaagcagcatatcgaaaatctcttttccgaccttcaagatggacgcaggctgctggatctcctcgaaggactcaccggccagaaactccccaaagaaaaggggtccacgagagtgcacgcactcaacaacgtgaataaggcactccgcgtcctgcagaacaataacgtggatctggtgaatatcggatcgaccgacatcgtggacggcaaccataaactcaccctgggactgatatggaatatcatccttcactggcaggttaagaacgtgatgaagaacatcatggctggactgcaacagaccaactcagagaaaatcctgctttcgtgggtcaggcagagcacccgcaattacccgcaggtgaacgtgatcaatttcacgacctcgtggagcgacggtctggccctcaacgcgctgatccacagccatcggcccgatctgtttgactggaactcagtggtgtgtcagcagtcagctacccagcggctcgagcacgcgtttaacatcgcgcggtatcagctgggaatcgaaaagctccttgaccctgaggatgtggatactacttaccccgacaagaagtcaatcctgatgtacattaccagcctgtttcaggtgctccctcagcaggtcagcatcgaggccatccaggaagtggaaatgcttcctcggccgccgaaagtgaccaaagaagagcactttcagttgcatcaccaaatgcactactcgcaacagatcaccgtgtcgctggcgcaaggatacgaacgaacctcctcaccgaagccgcggttcaagtcgtatgcctacacccaggccgcctacgtgacgacctccgatccaacccgctccccgttcccatcccaacacctggaagccccggaggacaaatcattcggctcgtccctgatggagtcggaggtgaatctcgatcggtaccaaaccgccctggaagaggtgttgtcgtggctgctgagcgcggaggatactttgcaggctcaaggtgaaatctccaacgacgtggaagtcgtgaaggaccagttccacacccacgagggctacatgatggacctgactgctcatcagggccgcgttggaaatattttgcagctgggctccaagctgatcggcacgggaaaattgtccgaggatgaggagactgaagtgcaggagcagatgaacctgctgaattcacgatgggaatgcctgagagtcgcctcgatggagaaacaatcgaacttgcatcgcgtgctgatggatctgcagaaccaaaagctgaaggaacttaatgactggctcaccaaaaccgaggagagaacccgtaaaatggaggaggaaccgctcggaccggacctcgaagatctgaagcgccaggtacagcaacacaaggtgctgcaagaggacctggaacaagagcaggtccgcgtcaacagcctgactcacatggtcgtcgtcgtggacgagtcaagcggggatcatgccaccgccgctttggaggaacagcttaaggtcctgggcgatcggtgggctaacatctgccggtggactgaggaccgttgggtgctgttgcaggacatccttctcaagtggcaacgcctcaccgaggagcaatgccttttctcagcatggctctccgaaaaggaggatgcggtgaacaagattcacactactggattcaaagaccagaacgaaatgctgagctccctgcagaagctcgcagtgcttaaggccgacctggagaagaaaaagcagagcatgggaaagttgtacagcctgaagcaagacctgctgtcgaccctgaagaacaagtcggtgacgcaaaagactgaggcttggctcgacaacttcgcaagatgctgggacaatctcgtgcaaaaacttgaaaaaagcaccgcccagatttcgcaggcagtcactactactcagccttcgctgactcagaccactgtgatggaaacggtgactaccgtcaccactcgggaacagatcctggtgaagcatgctcaagaggaactcccgccccctccaccccaaaagaagcgccaaatcactgtggacacccttgagcgcctgcaggaactgcaggaagccactgatgaactggatctgaaattgcgccaggccgaagtgattaagggaagctggcaaccggtgggagatctgctgatcgattccctccaggaccacctcgaaaaggtgaaggcccttcgcggcgaaattgctccgttgaaggaaaatgtgagccatgtcaatgacttggcaaggcagctgaccaccctcggtatccagctgtctccgtacaatctctcgacgctggaggacctgaacactcggtggaagctgctccaggtggcggtcgaagatagagtccgccagctgcacgaggctcacagggatttcgggcctgccagtcaacattttttgtccacttcagtgcaaggaccgtgggaaagagccattagtccgaacaaggtgccatactacattaatcatgaaactcaaaccacttgctgggaccacccgaagatgacggaactgtaccaatctctggcggacctcaataacgtcagattctcagcctaccgcactgccatgaagctccgcagactgcaaaaggcgctgtgtctcgatttgttgtccctgtccgccgcatgcgacgcactcgaccagcataatttgaaacagaatgaccaaccaatggacatcctccagatcatcaactgccttaccactatctacgaccggctggaacaggagcacaacaacctggtgaatgttccactctgcgtggacatgtgcctgaattggctgctcaacgtctacgacactgggaggacgggacggatcagggttctgtctttcaagaccggaatcatctccctgtgcaaagcccatctcgaggataaatacagatacctttttaagcaggtggcctcgtcgaccggattctgcgaccagaggagattgggactccttctgcatgattcgatccaaattccacggcagctcggcgaggtcgcgagcttcggtgggagcaacatcgaaccgtccgtccgctcctgcttccaatttgcgaacaacaaaccagaaattgaagccgccctgttcctcgactggatgcgactggaaccacagtcgatggtctggctgcctgtgctgcaccgggtggcggcggctgaaaccgccaagcaccaggcaaagtgtaacatctgtaaagaatgcccaatcatcggattccgctaccggagcctcaagcacttcaactacgacatctgccagtcgtgtttcttttccgggcgggtggcgaaggggcacaagatgcactaccctatggtcgagtattgcactcccaccacttcaggtgaagatgtccgcgatttcgcaaaggtgctcaagaataagttcagaactaaacggtacttcgcaaaacatccacgcatgggatacctgccggtgcaaaccgtcctggaaggtgataacatggaaaccgacactatg

SEQ ID NO: 251248 - DNA, 3591 bp, Artificial Sequence
  Description of Artificial Sequence: Synthetic coding sequence
atgctctggtgggaagaagtggaagattgttatgaaagagaggacgttcagaaaaagacctttactaaatgggtgaacgcacagttctcaaagtttggaaagcaacatattgaaaatcttttcagcgacttgcaggacggacggcgattgcttgatcttctggaaggactgaccggtcaaaaacttccaaaggaaaagggttcgactagagttcatgccctgaacaatgttaacaaggcactccgtgtcttgcaaaacaataacgtggatctggtgaacattggatccaccgatatcgtggatggaaatcacaagctgactctgggacttatctggaacattatccttcattggcaagtgaaaaatgtcatgaagaatatcatggcaggccttcaacaaacgaactcggagaagattctgctgagctgggtgcgtcagtccactaggaactaccctcaggtgaacgtcattaactttactacctcctggtccgacggccttgcacttaacgctctcattcattcacacagacccgatctgtttgattggaacagcgtcgtgtgtcaacagtcggcaacccagagactggagcatgcattcaacattgcacggtaccagctgggcattgagaaacttctcgaccctgaggacgtggatactacctaccctgacaagaaatccatccttatgtacatcacctcgttgttccaggtgctccctcagcaggtgtccatcgaggccatccaagaagtggaaatgctgcctaggcctcccaaggtcaccaaagaggagcatttccagcttcatcatcagatgcattactctcagcagataaccgtgtcactggcacaaggttacgaacgcaccagctcaccaaagcctcggttcaagtcctacgcttacactcaagcagcatacgtgactactagcgatccgacccgctccccttttccaagccagcatctggaagcaccagaagataagtcctttggatcctccctcatggagagcgaagtgaatcttgatagataccaaacggcactggaagaagtgctttcctggctgctttctgctgaggacactctgcaggcgcaaggtgagatttcaaatgatgtcgaagtggtgaaggaccaatttcatacgcacgagggatacatgatggatctgactgcgcatcaaggaagagtggggaacatcctccagctgggatccaagttgattgggaccggtaaattgtccgaagatgaagaaactgaagtccaagaacagatgaaccttcttaactcacgatgggaatgcctcagagtggcatccatggagaagcagtccaacctgcaccgcgtgctgatggatctgcagaaccagaagctgaaagaactgaacgactggctgaccaaaaccgaggagcgcacgcggaaaatggaagaggaacctttgggccctgatctggaagatctgaagcgccaagtgcaacagcataaggtgctgcaagaagatctggaacaggaacaagtgcgagtgaattcgctgacccatatggttgttgtcgtggatgaatcgtcgggagatcacgcaactgcagcgctcgaggaacagcttaaggtgctgggggatagatgggcaaatatctgtcggtggaccgaagatcgctgggtgctgcttcaagatatcctccttaagtggcaaagacttaccgaagagcaatgcctcttctccgcatggctttccgagaaggaggatgcagtcaataagatccatacgaccggtttcaaagaccaaaatgaaatgctttcgagccttcaaaaactggcagtcctgaaagccgatctggaaaagaaaaagcagtccatggggaaactttacagccttaagcaggatctgttgtcgactctcaagaacaagtctgtgacccaaaagacggaagcatggctggacaactttgcaaggtgttgggataaccttgtccaaaaacttgaaaagtcaaccgcacagatttcccaagcagttaccaccactcaaccaagccttacgcagaccacggtcatggaaaccgtcactactgtcactactagagagcagattttggtgaaacacgcacaagaagagcttccaccaccccctcctcagaaaaaacgtcaaatcactgtcgatactctggaacgccttcaagagcttcaagaggctactgacgaacttgatctcaagctcaggcaggcagaggtgatcaagggttcatggcaacctgtgggtgaccttcttattgattctcttcaagatcatctggaaaaggtgaaagccctgcggggggagatcgcaccgctgaaggaaaatgtgtcacatgtgaacgaccttgcccgccaactcaccactctcgggattcagcttagcccgtacaatctgtcgactctggaggaccttaacactaggtggaagctcctccaggtcgcagtggaggatcgcgtgaggcagcttcatgaggcacaccgcgattttggtccggccagccaacactttctcagcacctcagtgcaaggcccctgggaaagggcgatttcacctaataaggtgccctattacattaatcatgagacgcagactacctgttgggatcatcctaagatgaccgaactctaccaatccctggcggatctgaacaatgtgcgcttttcagcctaccgtacggccatgaaactgcggaggcttcagaaggcactgtgtctggacttgctgtcgctttccgccgcgtgcgatgcgcttgatcagcacaaccttaagcagaacgaccaacctatggacattctgcaaatcattaactgccttaccactatttacgatcgcttggagcaggagcacaacaacctggtgaacgttccactttgtgtcgacatgtgtctgaactggctcctgaacgtctacgatactggccgaactggaaggattcgggtgctctcgtttaagactggaatcatcagcctgtgtaaagcacatcttgaagataagtatcgctatctctttaaacaagtggcaagcagcactggcttctgtgatcaaagacgacttggactcctcctccacgactcaatccaaattcctcgccagcttggagaagtggcatcgtttggaggttccaacattgaaccttcggtgaggtcgtgctttcagtttgccaacaacaagccagaaatcgaagccgcccttttcctggattggatgcgactggagcctcagtcgatggtgtggcttcccgtgcttcatagagtggcagcagcagaaaccgctaagcaccaagccaagtgtaacatttgcaaggaatgtcctattatcgggtttcgttacaggtcgcttaagcatttcaactacgatatttgtcagtcgtgtttcttcagcggtagagtggcaaagggacacaagatgcattaccctatggtggaatactgcaccccaactacctccggagaagatgtgcgagattttgcaaaggtgcttaagaataagtttcgcaccaagcgctactttgcgaagcatcctcggatgggataccttcccgtccaaaccgtcctggagggagataacatggagactgataccatg

SEQ ID NO: 251249 - DNA, 3591 bp, Artificial Sequence
  Description of Artificial Sequence: Synthetic coding sequence
atgctgtggtgggaagaagtggaggattgttatgagcgggaggacgtgcagaagaaaaccttcaccaaatgggtgaatgctcagttctcgaaattcggcaaacaacacattgaaaacttgttttccgatctgcaggatggtcgcaggcttctggatctgcttgagggactcaccggacagaagctgcctaaggaaaaaggaagcacccgcgtgcatgccctcaataacgtcaataaggcattgcgggtccttcagaataacaacgtggatctggtcaacattgggtccaccgatatagtggacggaaaccataagttgaccctcggactcatttggaatatcatcctgcattggcaagtcaagaacgtgatgaagaacattatggcaggactgcagcaaactaactccgagaaaatcttgctttcctgggtgagacagtccaccaggaactacccacaggtcaatgtcatcaatttcactacctcctggtccgatggtctggcactgaatgccctcattcactcccatcgacctgacctttttgattggaattcggtggtttgtcaacaatcggcaactcaaagacttgaacatgcgttcaacattgcacgataccagctggggatcgaaaagctgcttgatccagaggacgtggatactacttaccccgacaagaagagcatacttatgtacatcacgtccctgtttcaggtgctccctcaacaagttagcattgaagccattcaggaggtggagatgttgcctcgcccgccaaaggtcaccaaggaggagcattttcagcttcatcatcaaatgcactactcccagcagatcaccgtctcgctggctcaaggatacgagagaacgtcgtccccgaagccaagatttaagtcatacgcctacacgcaagcagcctacgtgaccacctcggaccccactcgctccccatttccaagccagcacctggaagcacccgaggacaagagtttcgggtcgtccctgatggaatcggaagtcaacctggatagataccagactgcactggaagaagtccttagttggttgctctccgcggaggacactcttcaggcgcaaggagaaattagcaacgacgtggaagttgtgaaggatcaatttcacacccacgagggttacatgatggaccttaccgcacatcaaggtcgcgtgggaaacattctccagctgggatcaaagctcattgggactggaaagttgtcagaggacgaagaaaccgaagtccaagaacaaatgaacctgctgaactcgagatgggaatgtcttagagtcgcgtcgatggagaagcagtccaaccttcacagagtgcttatggacctccagaaccaaaaactcaaagaactcaatgattggctgactaagactgaagaacggacccgtaagatggaagaagaaccgttgggcccagatctggaggatctgaaacggcaagttcagcagcacaaggtgcttcaggaggacctcgaacaagaacaagtgagagtcaacagtctgacccacatggtagtggtggtcgatgagtcatcaggtgatcacgccaccgctgcacttgaggaacagctcaaggtgctcggagataggtgggcaaacatctgtcgatggaccgaggatcggtgggtgcttctccaagatattcttctgaagtggcaacggttgactgaagaacaatgtctcttttcggcttggctgtcagaaaaggaggatgcagtcaataagatacataccactgggttcaaagatcaaaatgagatgctgagcagcttgcagaagctggcagtcctgaaggcagatctcgagaagaagaagcagtcgatgggtaagttgtattctctgaagcaagacttgttgtctactctgaaaaacaaaagcgtcacgcaaaaaactgaagcatggttggacaactttgcaagatgctgggacaacctcgtgcagaaattggaaaaaagcactgcacaaatttcacaagccgtgaccactacgcagccatctctgactcaaactaccgtgatggaaaccgtcactacggtcactactagagagcaaattcttgtgaaacacgcacaggaagaactgccacctcctccccctcaaaagaaaaggcaaattaccgtggacacgcttgaacgactgcaagaactgcaggaagcgacggatgagcttgacctgaaactgcgacaagccgaagtgattaagggctcatggcaaccagtcggggatctgctgattgacagccttcaagatcatttggagaaggtaaaggcgctgagaggggagatcgcccccctgaaggaaaacgtgtcgcacgtaaatgatcttgcacggcaactcactaccctcgggatacaactttcgccttacaacctttcgacgctggaagatctcaacaccagatggaagctgctgcaggtggcagtggaggatcgtgttaggcagctccatgaggcgcatcgtgattttggaccagcatcgcagcatttcttgagcaccagcgtgcagggcccttgggaaagggcaatttctcccaataaagtcccctactacattaatcatgaaacccaaaccacttgttgggatcacccaaagatgacggaactctaccagagcttggctgatctgaataacgttcgtttttccgcataccgaaccgccatgaagttgcgccgtctccaaaaggctctttgcctggacttgcttagcctttccgcggcatgcgacgcattggaccaacacaatcttaaacaaaacgaccaacctatggatatccttcaaatcatcaactgtctgacgactatttacgaccggctcgaacaagagcataacaacctggtgaatgtgcctttgtgtgtggatatgtgcttgaattggttgctgaatgtgtacgataccggcaggaccggaaggattcgcgtgctttcctttaagactggtataatcagcctgtgcaaagcacatcttgaggacaagtaccggtaccttttcaagcaggttgcttcaagcaccggcttttgtgaccaacgacgcctcggacttcttcttcatgactcgatacaaatccccagacagctgggtgaggtggcatccttcgggggttccaacatagagccgtcagtgcgttcgtgtttccagtttgccaataacaagccagaaatcgaagctgccctttttctggattggatgcgcttggaacctcaatcgatggtgtggcttccggtcttgcatcgtgtggccgcggccgaaactgcaaagcatcaagcaaaatgtaatatctgtaaagaatgtcctatcattggattcagatacaggagccttaagcactttaactacgatatttgccagagctgcttcttttccggaagggtcgcaaaaggtcataagatgcattatcctatggtggagtactgcacccctactacttccggcgaagatgtcagagattttgcaaaggttctcaagaacaagtttagaaccaagcggtactttgcaaagcatccccgaatgggctaccttcctgtgcagaccgtcctcgaaggcgataacatggaaactgataccatg

SEQ ID NO: 251250 - DNA, 3591 bp, Artificial Sequence
  Description of Artificial Sequence: Synthetic coding sequence
atgctgtggtgggaggaggtggaagactgctacgagcgcgaagatgtacagaagaagacattcactaagtgggttaacgcacagttttcaaagtttggcaagcagcatattgagaaccttttcagtgatctgcaagacggaagaaggcttctggatttgttagagggtctcacaggccagaagctccctaaggaaaaggggagcaccagggttcacgccctcaataatgttaacaaggccctccgtgtcttacagaataacaatgtggatttagtgaacatcggctccactgacatagtcgatggcaaccataaattgacattgggattgatctggaacatcatcttgcattggcaggttaagaatgttatgaagaatataatggcaggattgcagcagactaattcagaaaaaattctgctctcgtgggtacgacagtccacgagaaactatcctcaagttaacgtgatcaatttcactactagctggtccgatggtctggccctgaatgccctgatccattcccaccgacccgacctcttcgattggaactctgtggtgtgccaacagtccgcaacacaacgtctggaacatgcttttaatatcgcaagataccagttgggtatcgaaaagttgctcgatcccgaagacgtagataccacttacccggacaaaaagtctatactcatgtacatcaccagtctcttccaggtcctgccccagcaggtatctattgaagccatccaagaggtggaaatgctgccaagaccccccaaggtgacaaaagaggaacacttccaactgcatcaccagatgcattacagccagcaaataaccgttagcctggcccaagggtacgagaggacatcttcccccaagccaagatttaaatcatatgcttacacacaggcagcatatgttacgacatccgatcctacccgcagcccattcccgagtcaacatctcgaggcgcccgaggataagagtttcggcagttccctgatggaaagcgaggtcaatctggaccggtatcagaccgcattagaagaggttctctcatggctcctatccgccgaggatactttacaggcacagggggaaatctccaatgatgttgaggtggtgaaggaccagtttcatacccatgaagggtacatgatggacctaactgcacatcagggcagagtggggaacattctccagctgggaagtaaactcataggaaccggaaaactgtcagaagatgaagagaccgaggtgcaggagcagatgaatttgctgaattcaagatgggaatgcttacgagtagcatcgatggagaaacagagcaatttgcatagagtgctcatggacttacaaaaccagaagctgaaagagctgaatgactggctgactaagacagaggagcgaactcggaagatggaagaagagcccctcggccccgatttggaggatctgaagaggcaagtgcagcaacacaaagtgttgcaggaagatcttgagcaggagcaggtgcgcgtgaacagtcttacacacatggtggtagtggtcgacgaaagctccggtgatcacgctacggccgctctcgaggagcagttgaaagtgttgggagaccgttgggcaaacatctgcagatggactgaagacaggtgggtgctacttcaggacatcctcttgaagtggcaaagacttactgaagagcagtgcttgtttagtgcctggttgtctgaaaaggaggatgccgtgaataagattcatactacagggtttaaagatcagaatgaaatgttgtcatctctgcaaaagcttgcggtcctaaaggccgatttagaaaaaaaaaagcagagcatggggaaactgtactcccttaagcaagacctgctgtccaccctcaagaataagtcggtcacgcaaaaaaccgaggcttggctggacaactttgcacgctgctgggacaacctggtgcagaagcttgaaaagtccaccgcccagatttctcaggccgtcacaacgactcaaccctcactgacacagaccacagtgatggaaacggttactaccgtgactacaagggagcaaattctagttaagcacgcacaggaggagttacctccccctccacctcagaaaaagcggcagattacagtggatacgctggagcgattgcaagaactccaagaagcaactgacgaactggatctgaagctgcgccaggctgaggtgatcaagggctcctggcaacctgtcggcgatcttctcatcgactccctgcaggaccacctggagaaggtgaaggctctaaggggggagatagctccgctgaaagagaacgtgagccatgtgaacgacttagcccggcagctgacaaccctgggcattcaattgagcccctacaatctgtcaacgctggaagacctgaatacacggtggaaacttctccaagtggcggtggaggatcgcgttcgccagctgcacgaggctcacagggacttcggtcccgcttcccagcactttcttagtacatcagtgcaagggccgtgggaacgagcaatttccccgaataaagttccgtactacatcaatcatgaaacccaaacaacctgttgggatcacccaaagatgactgaactctaccaatcactggctgatttaaataacgtgagattttctgcatatcgcaccgccatgaagctgaggagactccagaaggctttatgtctggacctgctctcgctctcggctgcttgcgatgcgttggatcagcataacttgaaacagaacgaccagccaatggacatccttcagataatcaattgccttaccacgatctacgatagactagagcaggaacataacaacttagtgaacgtaccactgtgcgtggatatgtgcttaaactggctcttaaacgtgtacgatacagggcggacagggcgcatcagagtgttgagctttaagacagggattatttcattgtgtaaggcacacctggaagacaagtatcggtatctgttcaaacaggtcgccagctctaccggattttgtgaccagagaagactaggtctgctgctacacgactctattcagatcccccgccagctcggggaagttgcctcgtttggtggcagtaacatagagcccagcgtaagatcctgcttccagtttgctaacaataagccggagatcgaagccgcccttttccttgattggatgaggttagaaccgcaatcgatggtctggcttccagtgctacacagagtggctgctgccgaaaccgctaagcaccaggcaaaatgcaacatttgtaaagagtgcccgattattggcttccgttacaggagtctgaagcacttcaattacgacatttgtcaatcttgcttcttttctggaagggtcgctaaagggcacaagatgcattaccccatggtcgagtactgtaccccaaccactagtggggaagacgtgagagatttcgcaaaagttctgaaaaacaaattccgaaccaaacgatacttcgccaagcacccaaggatggggtatctgccagtccagaccgtgctggaaggggataatatggagactgacaccatg

SEQ ID NO: 251251 - DNA, 3591 bp, Artificial Sequence
  Description of Artificial Sequence: Synthetic coding sequence
atgttatggtgggaagaagtcgaagactgttatgagcgcgaggacgtgcaaaagaaaacttttacgaaatgggtgaacgcccagttttctaagttcggaaaacagcatatagaaaaccttttttcggacctccaagacggccgccgactgctagacctgcttgagggcctgaccggccagaaactcccgaaagagaaggggtccacaagggtccacgctctgaacaacgtgaataaggccttgcgtgtgctgcagaacaataatgtggacctcgttaatatcggatctacagatatcgttgatggtaaccataagctcaccttgggattgatatggaacatcatactgcattggcaggtgaaaaacgtgatgaaaaacatcatggccggattgcaacagacgaacagcgagaagatcctcctgagttgggtacggcagagcaccagaaactaccctcaggtgaacgtgatcaatttcaccacttcctggtcagatggtctcgcgctgaatgccttgatccactcccaccgtcccgacctgtttgactggaacagcgtggtgtgccaacagtccgcgacccaacggcttgaacatgcattcaatattgcgagatatcagctcgggattgaaaaactgctggatcccgaggacgtggacacaacctatcccgacaagaagtccatcctcatgtacatcacctccttgtttcaggtgctgccacagcaggtgagcattgaagcaatccaggaagtcgagatgctcccccgaccccctaaggtgacgaaggaggagcactttcagttacatcaccagatgcactactcacagcagattaccgtgtcattggctcaggggtacgaacgtacgtcctctcccaaaccccggttcaagagctatgcttacactcaggccgcatacgtgacaacctccgacccgacaaggtctcccttcccaagccagcatctcgaggctcctgaagataaaagcttcggctcctcactcatggaaagcgaggtgaatttggatagataccagaccgccttggaggaggtgctgtcttggctcctgtccgcagaagacacgctgcaagcacagggagagattagtaatgatgtcgaagtggtcaaggaccaattccatacacacgaaggttacatgatggatctgaccgctcaccagggaagggttggaaacattctgcagctaggctcgaagctcattggtacaggcaagctgagcgaagatgaagagacggaggtgcaggagcagatgaacctgttgaactcccggtgggagtgcttgagagttgcgagcatggaaaaacagtctaacttgcatagggtgttgatggatctccagaaccagaagctgaaggagcttaacgactggcttacaaaaactgaagaaaggactaggaagatggaggaggaaccactggggccagatcttgaagacctcaagaggcaggtgcaacagcacaaggttttgcaagaggatctggagcaggaacaggtgagggtgaacagtctgacacacatggtcgttgtcgtcgacgaatcctccggcgaccatgctactgcagcacttgaggagcaactcaaggtgcttggagaccggtgggccaacatctgtcgctggaccgaggaccgttgggtactcctccaggatattttactgaagtggcagaggcttactgaagaacagtgtttattctccgcatggctcagcgaaaaagaggacgccgtcaataagatccacaccacaggcttcaaggatcagaatgaaatgctctcctcacttcaaaagctggcagtgctcaaagcggatctggaaaaaaaaaagcagtcaatgggaaagctttacagccttaagcaagatctgctgtcaacactgaaaaataagtcagttacccaaaagacagaggcctggctggataactttgcacggtgttgggataatctcgtccagaagctggagaaaagtactgctcagatctcccaagccgtcacgaccacccagccttctctgacacagaccactgtgatggaaacggtgacaactgttacaacacgggagcagattctggtcaagcacgcacaggaggaacttcctcccccccctccacaaaagaagcgccagatcactgtcgacactttagagcgcctccaagagcttcaggaggccaccgacgagctggacctgaagctgcgccaggctgaggtaattaagggcagctggcagcccgtcggagatctgttgatcgactcccttcaggaccacctggaaaaggtgaaggccctgaggggagaaattgcgcctttgaaggagaacgtctcacacgtgaatgatcttgctcgccagctgacgacactaggaattcagctgtccccctataatctcagcacgttggaagacctcaacacccgctggaaactacttcaggtggctgtcgaagatcgggtgcgccagctgcatgaagcacatcgtgacttcgggccagccagccagcatttcttgtcgacttcggttcaggggccctgggaacgtgccatttcaccaaataaagttccatactatatcaatcatgaaacacagacaacctgttgggaccaccctaagatgaccgaactgtatcagagtttagcagatttaaataacgttagattctccgcttaccgcactgctatgaagctacgaagacttcagaaggcactgtgtttagatctgctatccctgagtgcagcctgcgatgcacttgaccaacataatctgaagcaaaatgaccagccaatggatattctccaaattattaattgcctgacaactatctatgatcgcctggagcaggaacataataatctggtgaacgtccctctctgcgttgacatgtgtttgaattggctgctcaatgtctacgacaccggaagaaccggtagaatccgcgtgttgtccttcaagactggtataatcagcctatgtaaggcacatctggaggacaaatacaggtatctattcaagcaggtggcatcctctaccgggttctgcgaccaacgccgactcggactgcttctgcatgattccatccagatcccaaggcaactgggggaggtggcttcattcggcggctcgaatatcgagccctctgtgcggtcctgcttccagtttgccaataacaagcccgagattgaggctgcactgttcctggactggatgcgtctggagccgcaatctatggtctggttgccagttctacatagagtggccgccgcggagactgctaagcatcaggctaaatgcaatatatgcaaggagtgccctattatcgggtttagatatcgaagcctgaagcatttcaattacgacatatgccagtcatgcttttttagtggccgcgtcgccaaaggccacaagatgcactatccaatggtggagtattgcactccaaccacatctggtgaggacgtcagggattttgcaaaggtcttgaaaaacaagtttaggaccaaaaggtacttcgccaaacacccccgcatggggtatctacccgtgcagacagtgcttgagggcgacaacatggaaaccgatactatg

SEQ ID NO: 251252 - DNA, 3591 bp, Artificial Sequence
  Description of Artificial Sequence: Synthetic coding sequence
atgctctggtgggaagaagtggaggactgctacgaacgcgaagatgttcagaaaaagacgtttacgaagtgggtcaatgcgcagttttccaaattcggtaagcaacacatcgaaaatctgtttagcgacctgcaggatggacgcagacttctggacctcctggaaggcctgactggccagaagctgccgaaggagaagggcagcacgcgcgtccatgctctgaacaacgtcaacaaggcgctcagagtgctgcagaacaacaacgttgacctggtgaacatcggatccaccgacattgtcgatgggaaccataagctgaccctcggactcatctggaatatcattctccactggcaggtgaaaaacgtcatgaagaatatcatggcaggactgcagcagactaattcagaaaagatcctcctgtcgtgggtgcggcagtcaactcggaactacccgcaggtgaatgtgatcaatttcaccacttcgtggtcggacggactcgcactcaatgcactcatccatagtcataggccggacctgttcgactggaactccgttgtgtgccagcagtcagccacccagagactggaacatgcattcaacatcgcccggtatcagttgggaatcgaaaaacttctggaccctgaagatgtggataccacttaccctgataagaagtccatcctcatgtacatcacttccctgttccaagtgctgcctcagcaggtttcgatcgaggccatacaggaggtggaaatgttgccccggccgccgaaggtgaccaaggaggagcacttccagctgcatcaccagatgcactacagccaacagattactgtctcgctggctcagggatacgagcgcacctccagtccaaagccaaggtttaagtcatacgcatacacccaagccgcctatgtcactacttcggacccaaccagaagccctttcccgtcacaacatttggaagcgccggaagataaatcattcggatcatcgctgatggagtcggaggtgaaccttgatagataccagaccgcgctggaagaagtgctgtcctggctcctctcagcagaggacaccctccaagcacagggcgaaatctccaacgacgtcgaagtggtcaaagatcagttccatactcatgagggatacatgatggatctcaccgctcaccaggggcgcgtgggaaacatcctgcaactgggatccaagctgatcggcaccgggaagctgtcagaagatgaagaaaccgaagtgcaggagcaaatgaacctcctgaattcacggtgggaatgtctgcgcgtggcgagcatggagaaacagagcaacctgcatcgggtgctgatggatttgcagaatcagaaacttaaagaactgaatgactggctcaccaagaccgaggaaaggacccggaagatggaagaagagcccttgggtcctgatctcgaagatctgaagcgccaggtccagcaacacaaggtgctgcaagaggacctggagcaagaacaggtccgcgtgaactcccttacccatatggtggtggtcgtggacgagagctcgggcgatcacgccaccgccgccctggaagagcagttgaaagtcctcggcgaccgttgggccaacatctgccgctggaccgaggacagatgggtgctgctgcaagacatcctgctgaagtggcagcgactcacggaggaacagtgtctcttctcagcctggctgagcgagaaagaggacgcagtgaacaaaatccacaccacggggttcaaggaccagaacgaaatgctgtcgtcgctgcagaagctggccgtgctgaaggctgacctcgagaagaaaaagcaaagcatggggaagctgtactcgctgaagcaagacctgctctccaccctcaagaacaagagtgtcacgcaaaagactgaggcatggcttgataactttgctcggtgctgggataacctggttcagaaattggaaaagtcgactgctcaaatttcgcaggccgttaccaccacgcagccgtctcttacgcaaacgaccgtgatggaaaccgtcaccaccgtgaccaccagagagcagattcttgtgaagcatgcccaagaggaactcccacctccgcctccgcagaaaaagaggcaaatcactgtggatactctggaaaggctgcaggaactccaagaggccactgatgagctcgatttgaagctgagacaggcggaagtgattaagggttcatggcagccggtcggtgaccttcttatcgactcgctgcaagaccatttggaaaaggtcaaggcactgcggggggagattgccccactgaaggagaatgtgagccatgtcaacgatctcgcacggcagctgactaccctgggaattcaactgagtccttacaatctctcaaccctcgaggatctcaacacccgatggaagttgttgcaggtggcagtggaggacagagtgcggcagctgcacgaggcgcaccgggacttcggaccagcctcccaacatttcttgtcaacctcggtgcaaggcccttgggagcgagcaattagcccaaataaggtgccgtactacatcaatcatgaaactcaaaccacttgctgggaccatcccaaaatgactgaactgtaccagtctcttgctgatctcaacaacgtccgcttttccgcctaccgcacggctatgaagctcagacgcctgcaaaaagccctttgcctcgacttgctctcgttgtcggcggcatgtgacgcactggaccagcacaacctcaaacaaaacgaccagcctatggacatcctgcaaatcataaactgcctgaccaccatctacgaccgcctggagcaggagcacaacaacctcgtgaacgtgcccctgtgtgtggacatgtgcctgaattggctcctcaacgtgtatgataccggacgcactgggcgaatcagagtcctctcgttcaagaccggaatcatctcattgtgtaaagctcatttggaggacaaataccgctacctcttcaagcaagtggcttcgtccaccgggttttgcgaccaaaggcggctgggcctgttgctccatgactcgatccagatcccccgccaactgggagaagtcgcgtcatttggagggtcaaacatcgaaccatcggtgagatcctgcttccagtttgctaacaacaaaccagaaatcgaagcggcgctcttcttggactggatgagactggagccccaatcaatggtgtggcttcctgttctgcatagagtggcggccgccgaaactgcaaagcaccaggctaaatgtaacatatgcaaggaatgcccaatcatcggcttccgctacagaagcctgaaacacttcaattatgacatttgccagtcctgcttcttttccggacgcgtggcaaagggccataagatgcactacccgatggtggaatactgtactccaaccacttccggagaggatgtgcgggacttcgctaaagtgctcaaaaacaagttcagaactaagcgctacttcgcgaagcaccctcggatgggttacctgccggtgcagactgtgctggaaggcgacaatatggaaaccgacacgatg

SEQ ID NO: 251253 - DNA, 3591 bp, Artificial Sequence
  Description of Artificial Sequence: Synthetic coding sequence
atgctttggtgggaggaagtggaggactgttatgaacgagaggacgtccagaaaaaaacatttacaaagtgggtgaacgcacagttctcaaaattcggtaagcagcatattgaaaacctcttcagtgacctacaggacgggcggagactgcttgacttgttggaggggcttactggccagaaattgcccaaggaaaaggggagcacccgggtgcatgctcttaataatgtgaacaaggctctacgggtgttgcagaacaataacgtcgacctggttaatatagggagcactgatatagttgatgggaaccacaaactcaccttgggtctcatttggaacatcattttacattggcaggtgaaaaacgttatgaagaacattatggctggcctacagcagaccaacagcgagaagatcttgctgagttgggtgcgacagtccacccgaaattatccacaagtcaacgtgatcaacttcacaacatcatggtcggatggccttgcactaaatgctcttattcactcacacaggcctgatttgttcgattggaatagcgtagtgtgccagcaaagcgctacccagcggttggagcatgccttcaacattgccagataccagctcggcatagagaagttgctggaccctgaggatgtcgacacaacctaccctgacaagaagagcattcttatgtatatcacaagcctttttcaggtcttgccacagcaggtcagcatcgaggccatccaggaggtggagatgcttcctcggccacccaaggtcactaaggaagaacatttccagctgcatcatcagatgcattattctcagcagatcaccgtctcactcgcgcaggggtatgaacgaacatcttcacccaaacctcgcttcaagagctacgcctatactcaggcagcctacgtgactacatcagaccccacccgttccccttttcctagtcaacacctcgaagcgccggaagataagagctttggcagctctttgatggaatcagaagtaaatctggatcgctaccagactgcactggaggaggtgctgtcatggctgttgtcagccgaggacaccctccaggctcagggggaaataagcaacgatgtggaagtggttaaagatcagttccatacccacgagggctatatgatggaccttaccgctcaccagggaagagtcggaaatatcctgcagctgggttcaaaactgattggcaccggtaaactctcggaagatgaagaaactgaagttcaggagcagatgaacctgttgaactctaggtgggagtgtctgcgggtggccagtatggaaaagcaaagcaacttgcaccgagtgttgatggatctacagaatcagaaattgaaggagctgaacgattggctgactaagaccgaggagcggacgcggaagatggaggaggagccactcgggccggacctggaggacttgaagaggcaggtccagcagcacaaggtgctacaggaagacctcgagcaggaacaggtccgggtgaacagtctcacccacatggtagtcgtggtggacgagagcagtggtgaccatgccacagccgctttggaagaacagctgaaagttttaggagatcgatgggcaaatatctgccggtggacagaggacagatgggttctcctgcaggatatactgcttaaatggcagagactcacagaggagcagtgcctgttctccgcgtggctcagcgaaaaggaggacgcagtcaacaagatccatacgaccggcttcaaggatcagaatgagatgctgtcctcgctacagaagctcgccgtcctgaaggccgacctggagaagaagaagcagtcaatggggaagctctacagcctcaaacaggatttgcttagtacacttaagaacaaatcagtgacccagaaaacagaggcatggctggacaattttgcaaggtgctgggataacctagttcaaaagttggaaaagtctacggctcagatttcccaggccgtgaccactactcagccgtcactgactcagacaactgtgatggagaccgtgacgacggttacaacgcgggaacagatactcgtcaaacatgcacaggaggaactgccccccccgcctccacagaaaaagaggcaaataaccgtcgatactctagagcggctacaagagttgcaggaggcaaccgatgagctcgatctgaaattgcggcaagcagaagtgataaagggctcatggcagcctgttggcgatttgctgatcgactccctgcaagatcatctggaaaaagtgaaggccttgcgtggtgaaatcgccccactgaaggagaatgtgtctcacgtaaatgacctggcccgccagctaaccactcttggaatacagctgagcccttacaaccttagtaccctcgaagacctaaatacccgctggaaactactacaagtggcggtggaagatagagtcaggcaactacacgaggcacaccgtgattttggaccagcgtcacaacattttctgtctactagtgtccagggcccttgggagcgggctatcagtcccaacaaagtcccatattacattaaccatgagacacagacgacctgttgggaccatccaaaaatgaccgagctataccagagtctcgcggatctgaacaacgtgaggtttagcgcatacagaacagccatgaagcttcggagactccagaaggccctgtgcttagacctcctgtccctgtcggcggcatgcgatgcgctggatcaacacaatctaaaacagaatgatcaacctatggacattctgcagatcatcaattgtttaaccacaatatatgatagacttgagcaagagcataataatctcgtgaacgtgccgctgtgcgtggacatgtgcctgaactggttactaaatgtctatgacaccggtcgaactggcagaattcgggtcctgtcttttaagaccggcatcatttctttgtgtaaagcgcatctcgaagacaaataccgctacctattcaaacaggttgcttcctccactggtttttgtgaccagaggcgattggggcttctcctgcacgactccatccaaattcctcgccagttaggcgaagtcgctagtttcggcgggtctaacatcgagccctccgtgagatcctgctttcagtttgccaataacaagcctgaaatcgaggctgccctttttctcgactggatgcgtcttgaaccgcagtcaatggtctggcttccagtgctgcatcgagtggctgcggcggagactgctaagcatcaggctaagtgtaacatctgcaaagagtgcccgataattggattccgctaccgctctcttaaacattttaattatgatatttgtcaatcctgttttttctcggggagagtggcgaagggccataaaatgcattaccccatggtcgagtactgcactcctacaacaagcggagaagatgtacgcgattttgccaaagtgctaaagaacaagttcagaacgaagcgatactttgcaaagcatcccagaatgggctatctcccggtgcagacagtcctggagggagataatatggagacggacacaatg

SEQ ID NO: 251254 - DNA, 3591 bp, Artificial Sequence
  Description of Artificial Sequence: Synthetic coding sequence
atgctgtggtgggaagaagtcgaggactgctacgaacgcgaggacgtccagaagaaaacgttcactaagtgggtcaatgcgcagttcagtaaattcggcaaacagcacatcgaaaatctgttttcagacctgcaagacgggcggcgcctgcttgatcttctggaaggactcaccgggcaaaagctgccgaaggaaaaaggtagtaccagagtgcacgccttgaataacgtcaataaggccctgagggtcctccagaataacaatgtggatctcgtgaacattggatcgaccgatatcgtggacggaaaccacaagttgacccttggattgatctggaacataatcttgcactggcaggtgaagaacgtgatgaaaaacatcatggccggactgcagcagaccaactccgagaagatcttgctcagctgggtgcggcagtcaacccgcaactacccccaggtcaatgtgatcaacttcactacgtcatggtcagatggattggccttgaacgcactcatccattcccaccggccggacctctttgactggaactcagtggtgtgccaacagtcggccactcaaagactcgaacatgccttcaatatcgcccggtaccaacttggaatcgaaaaactgctcgaccccgaagatgtggacaccacgtacccagacaagaaatccatcctgatgtacattacctccctgttccaagtattgccacagcaagtctctattgaagcgatccaagaagtggaaatgctgccgcggccgccgaaggttaccaaggaggaacacttccagttgcatcaccagatgcactactcgcagcagataaccgtcagcctcgcccaaggatatgagcgaacttcctccccgaagccgcggttcaagtcctacgcatacactcaggcagcctacgtgactacctctgaccccacgaggtcgccctttccgtcccagcatctcgaggcaccggaggacaaatcctttggatcaagcctcatggagtccgaggtgaacttggacaggtaccaaaccgctctggaggaagtgcttagctggctgctgtcagcagaagatactttgcaagcccaaggagagattagcaatgatgtcgaagtggtgaaggatcaattccacactcatgaaggatacatgatggatctgaccgctcatcaaggtcgagttggaaatatcttgcaattgggaagcaagctcatcggaaccggcaagctgagcgaggatgaagagacggaggtccaggagcagatgaacctgctgaattcgcggtgggagtgtctgcgggtggcctcaatggaaaagcagagcaacctgcatcgggtgctcatggacctgcagaaccaaaagctgaaggagctcaatgactggctgaccaagaccgaggagcgaacgcgcaagatggaggaagaacccctcggcccagatcttgaggatctgaaaagacaggtgcaacagcacaaagtgctccaagaagatcttgaacaggaacaggtgcgcgtgaactcactgacccatatggtggtcgtggtggacgaatcttcaggggatcacgcaactgccgccctcgaagagcagctgaaggttctcggggaccgttgggcgaacatctgccgctggactgaggacagatgggttctgctgcaggacatcctgctcaagtggcaacggctgactgaagagcagtgccttttcagtgcctggctctccgaaaaggaagatgcggtcaacaagatccacaccactggattcaaggaccagaacgaaatgctgtcatcgctccaaaaactcgccgtgctcaaggcggacctggagaagaagaagcagtccatgggaaaactttacagccttaagcaagatctcctctctaccctgaaaaacaagagcgtgactcaaaagaccgaagcctggctcgataactttgctcggtgctgggacaacctggtgcaaaaactggagaaatcgaccgcacaaattagccaggctgtgactactactcaacctagcctgacccaaactaccgtaatggaaaccgtcactaccgtgactactcgtgaacagatactcgtgaagcatgctcaggaggaactgcctcctccaccaccgcaaaagaagcgacagatcaccgtcgataccctcgagcgcctgcaggagctgcaagaagcgaccgacgagctggacctgaagctgcggcaagcggaagtgatcaagggatcctggcagcctgtgggggacctcctgatcgacagcttgcaagaccatctcgagaaagtcaaggcactcagaggcgagatcgcccctcttaaggagaacgtgtcccacgtgaatgatttggcccgccagctgactacgctgggaatccagctgtcaccatacaacctgtcgactctcgaagatctcaacacccgctggaaacttctgcaggtcgctgttgaagatcgcgtgcgccagctgcatgaagcgcaccgcgacttcgggcctgcctcgcagcacttcctgtccactagcgtccagggcccatgggagagagcaatttcccccaacaaagtgccgtactatatcaatcatgaaacgcagaccacttgttgggaccatccgaaaatgaccgaactctaccagtcgctggccgacctgaataatgtgcgcttctcggcgtatcgcaccgccatgaaactgcgcagattgcaaaaggcgctgtgccttgacctcctttccttgagtgcagcctgcgacgccctggaccagcacaaccttaagcaaaatgatcaaccgatggacatcttgcagatcattaactgcctcactactatctacgaccgcctcgagcaggaacacaataatctcgtcaacgtgccgctctgcgtggatatgtgtctcaactggttgctgaacgtgtatgataccggtagaactggcagaatccgggtcttgtccttcaagaccggaatcatatcgctgtgcaaggcgcacctggaagataagtacagataccttttcaagcaggtcgcctcttcgaccggtttctgtgaccagcgacgacttggactgctcctccacgattctattcaaatcccgagacagctcggtgaggtggcgtcctttggcggctccaatatcgaaccttccgtgcggtcgtgttttcagttcgctaataacaagcctgagattgaggctgccctgtttctcgactggatgcgcttggagccacaaagcatggtgtggctgcccgtcctgcaccgcgtcgcagcggcagaaactgcgaagcaccaggcaaagtgcaacatctgcaaggagtgcccaattatcgggttcaggtaccggagcctcaaacatttcaattacgatatctgccagtcgtgcttcttttcaggccgcgtggctaagggtcacaaaatgcattaccctatggtcgagtactgcactccgacgacgtcaggagaagatgtgcgggatttcgctaaagtcctgaagaacaaatttcggacgaagcgctatttcgctaagcacccgagaatgggatacctgccggtgcagaccgtgttggaaggcgataacatggaaactgacaccatg

SEQ ID NO: 251255 - DNA, 3591 bp, Artificial Sequence
  Description of Artificial Sequence: Synthetic coding sequence
atgctgtggtgggaggaagtcgaagattgctacgagagggaagatgtgcaaaagaaaacttttaccaagtgggtgaatgcacaattttctaagttcgggaaacaacatattgagaaccttttttcggatctgcaggacggcagacgcctcctggacctgctggagggactcaccggacagaagctcccaaaggaaaaaggctccacccgcgtgcacgcacttaacaatgtgaataaggcattgagagtgcttcaaaacaacaatgtcgaccttgtgaacattggctcgacggacatcgtggatggaaaccataagttgaccctgggactgatctggaatatcatccttcactggcaagtcaagaacgtgatgaagaacatcatggcaggactgcaacaaacgaattccgaaaagatcctcctttcgtgggtgaggcaatcaactcgtaactaccctcaggtgaacgtgataaacttcactactagctggtcggacggactggccctcaatgcacttatccattcacacaggccagacttgttcgattggaatagcgtggtctgtcagcagagcgcgactcaaagactggaacatgcttttaacattgcccgataccagctgggaattgagaaactccttgaccctgaggatgtcgataccacctaccctgataagaagtcgatcctgatgtacattacgtccctctttcaagtgctgccgcaacaagtgtcgattgaggcaattcaggaagtggaaatgcttccaagaccgcctaaggtcacgaaagaggagcacttccagctgcatcaccagatgcattactcccagcagattaccgtgtcccttgcacagggctacgaacgtacctcgtccccgaaaccacgcttcaagtcctacgcatacacccaggcagcgtacgtgaccacttcggatcctacccggtccccttttccatcccaacatctggaagcaccagaagataagtcatttggttcgtcgctgatggaatccgaagtgaatcttgatagataccaaactgcactggaagaagtgctttcgtggcttctctcagcggaggataccctccaggcacaaggtgaaatatccaatgacgttgaggtcgtcaaagaccaattccatactcacgagggatacatgatggatcttactgcacatcaaggaagggtgggaaacatactccagctcggaagcaaacttattggaactggaaaacttagcgaggatgaagaaaccgaagtgcaggaacagatgaaccttcttaatagccgctgggagtgtctgagagtcgccagcatggaaaagcaatcgaacctgcacagggtgcttatggatctgcaaaaccaaaaacttaaagaactcaacgattggctgaccaagaccgaggagcggactcgaaagatggaagaagaacccctgggtcctgacttggaggaccttaaacgacaggtgcagcaacacaaagtcctccaagaggaccttgagcaggaacaggtcagagtcaacagcctgacccacatggtggtcgtggttgatgagtcgtcaggagatcacgcgactgctgccttggaggagcaacttaaggtgcttggagacaggtgggcaaacatttgtcgctggaccgaggaccgctgggtgctcctgcaggatatcctcctgaagtggcagagactgacggaggagcaatgcctgtttagcgcatggctgtcggaaaaagaagatgcagtcaacaagattcataccactggattcaaggatcaaaatgaaatgcttagctctcttcaaaagctggctgtgcttaaggcggaccttgaaaagaagaagcagtctatgggcaagctctactctctgaaacaagatctgctgagcacccttaagaataagtccgtgacccaaaagaccgaagcatggcttgacaattttgcccggtgttgggacaacctggttcagaagttggaaaagtccactgcacaaatcagccaagcagttaccactacccaacctagcctgacccaaactaccgtgatggaaaccgtgacgaccgtgacgactcgagagcagattctggtcaagcatgcgcaggaggaactgcctccgcctccgccacagaagaagcggcagataacggttgataccctcgaaaggcttcaggagctgcaagaagccactgatgaattggatctgaagctgagacaggcagaggtcattaaaggatcgtggcaacctgtcggtgaccttctgatagattcccttcaagatcatctcgaaaaagtcaaggccctccggggagaaattgcaccccttaaagaaaatgtgtcccatgtcaacgacctggcaagacagcttaccactcttggcatccaactctccccatacaacctgtccaccctcgaagatctgaataccagatggaagctgctccaggtggccgtcgaagatcgggtccgccagcttcacgaagcacatcgagactttggaccagcgagccaacatttcctgtccacctctgtgcaaggtccttgggagagagcaatctcccccaacaaggtgccgtactacattaaccatgaaactcaaactacctgttgggaccatcccaagatgactgagctgtatcagtcacttgcggacctcaacaacgtgcgcttctcagcgtaccggactgcaatgaagctcagaaggctgcagaaggccctttgtcttgatcttctttcgctgtccgccgcatgcgacgctctcgatcaacataatcttaaacagaacgaccagccaatggacattctgcaaatcataaactgccttactaccatttacgacaggcttgaacaggagcacaacaatctggtgaatgtcccactgtgtgtggacatgtgccttaattggttgctcaacgtgtacgacacgggtagaaccggccgtatcagagtgctgtcgttcaagaccggtataatcagcctttgcaaagcacacctggaagataagtatcgctacctgttcaagcaggtcgcatcgagcaccgggttttgcgatcaacggagacttgggctccttctgcatgacagcatacagatccctcgtcagctgggcgaggtggcctcgtttggaggttcgaatattgagccttcagttcgctcgtgtttccagtttgcaaacaataaacccgaaattgaagcagctttgttcctggattggatgcgtctggaacctcagagcatggtgtggctccccgtcctccatcgggtggcggctgctgaaaccgcaaaacatcaggccaagtgtaacatttgtaaagagtgccccatcataggattcaggtacaggtcgcttaagcatttcaactacgatatttgtcaatcgtgcttctttagcggaagagtcgcaaagggacataagatgcattatccaatggtcgagtactgtacccctactacttcgggcgaagatgtccgggattttgctaaagtgctcaagaacaagttcagaaccaaacgctattttgctaagcatccacgaatgggttacctccctgttcaaactgtccttgaaggcgacaatatggaaactgacactatg

SEQ ID NO: 251256 - DNA, 3591 bp, Artificial Sequence
  Description of Artificial Sequence: Synthetic coding sequence
atgttgtggtgggaggaagtggaagattgttatgagagagaagatgtccagaaaaagacgttcactaaatgggtgaacgcccagttttcaaagttcgggaagcaacatattgaaaatttgtttagcgacctgcaggacgggcgccggcttctggacttattggagggactgacaggacaaaaacttccaaaagaaaaggggtccacacgggtgcacgctctaaataatgtcaataaagctttaagggtgctccagaataacaatgttgacctggtgaatattggttccaccgatatcgtggatgggaatcataaactaacacttgggttgatctggaatatcattctccattggcaagttaagaacgttatgaagaatatcatggctgggttacagcagaccaactctgagaagatcctattgtcctgggttcggcaatccacccgtaactaccctcaagtcaacgttatcaacttcactacatcgtggagcgacggtctagccctcaatgctctgattcacagccatcggcccgatcttttcgactggaattctgtggtctgccagcagtctgctacccagagactagaacacgcctttaatattgccagatatcaattggggatcgagaaactgctggatcccgaagatgtcgacactacttatccagacaaaaagtccattctgatgtacatcaccagcctgtttcaagtcctgccgcaacaggtgtctatcgaagccatacaggaggtcgagatgctgcctcgcccaccaaaggtcactaaggaggaacattttcagttgcaccatcagatgcactattcccagcaaatcaccgtgtcattggctcagggctatgagagaacgagttcacccaaacccagatttaaatcctacgcctacactcaggccgcttacgtgactacttctgaccctactcggtcgcccttcccctcccagcatctggaggcaccagaggataaatccttcggctcctctctgatggagagtgaagtgaacctggatagatatcagacagcactggaagaggtgctgtcatggctgctgagcgccgaggacacactccaagctcagggcgaaataagtaacgatgtcgaggtggtgaaagaccagttccatacacatgaggggtatatgatggacctgacggctcaccagggacgcgtgggcaacattttacagcttgggtcgaagctaataggcacgggcaagctgtctgaagacgaggagacagaagtgcaggaacagatgaatctgctaaactcgagatgggagtgtcttcgggttgcttccatggaaaagcagagtaatcttcaccgggtgttgatggacttgcagaatcaaaaattgaaagagctcaatgactggctgactaagactgaggagaggacgcgtaagatggaggaagaaccgctcggcccagatctagaggaccttaagaggcaggttcaacagcacaaggtactccaggaggacttggaacaggaacaggtacgagtaaactcgctaacccatatggtggtcgttgtggatgagagttctggcgaccatgcaactgccgcgcttgaagaacagctgaaagtcctaggtgataggtgggcaaatatctgccgctggaccgaggaccggtgggtgttactgcaggacatactgctgaagtggcagcggctgactgaggagcagtgtctattctccgcttggctctcagaaaaggaggatgctgtaaacaaaattcatacaaccgggttcaaagaccagaacgagatgttaagtagtctacaaaagctggctgttctcaaggcagatcttgagaaaaaaaaacagagcatgggaaagctgtacagtctgaaacaggatctgctctctacactcaaaaataagtctgtcacgcagaaaaccgaagcctggttggacaattttgcacgttgttgggataatctggtccaaaaacttgaaaaatccacagcccaaatttctcaggccgtgactacaacccagccctcgctaacccaaaccacagtgatggagacagtcacaacagtgacgactagagaacagattctcgtcaagcacgcccaggaggaattgcccccccccccacctcagaagaaaagacaaattaccgtggataccttggagaggctgcaggaacttcaagaggctaccgatgaactggatttaaagctcagacaggccgaggtgatcaaagggtcatggcagccggtcggggatctgctaattgactccctgcaggaccacctggagaaagtcaaggccctgcgtggagagattgcccctctaaaggaaaacgtgagtcatgtcaacgacctggcccgacagctgactactctgggcatccagctatccccatataatctgagtacgctggaggatctgaataccagatggaagctgttacaggtggcggtggaagatcgagtgcgtcagctccacgaagcacatcgagatttcgggcctgcgtctcaacatttcctgtctaccagtgtgcagggcccgtgggagagagccatctcacctaataaggtcccatactacattaaccatgagacccagactacctgctgggatcacccgaaaatgacggaactctaccagtctctcgccgatctaaataacgtgaggttcagcgcttaccgcaccgccatgaagttaaggcgcctgcaaaaagcgctgtgcctggatttgctctccctcagcgccgcttgtgacgccctcgatcaacacaatctcaagcagaatgatcaaccgatggatattctgcagatcatcaactgcctgaccacaatttacgaccggcttgagcaggaacataacaatctggtcaatgttcccctgtgtgtcgacatgtgtctgaactggctattgaatgtctacgatactggtaggaccggccggattagagtattgtcatttaaaacgggaatcattagtctctgtaaggcccacttggaagacaaatacaggtatcttttcaagcaggttgcctcgtccacaggtttctgcgaccagcgccgcttggggctactgctccatgactccatccagatcccccgtcaactcggggaggttgcctcctttggaggtagtaacatcgagccttcggttcgcagctgcttccagtttgctaataataagcccgagatcgaagccgccctcttcctggattggatgagacttgagccccagtcaatggtgtggctgccggtcctgcaccgcgttgcggcagctgagaccgctaaacatcaggccaaatgtaatatctgcaaagagtgccccatcatcgggttcagatacaggtcactgaagcattttaactatgacatatgtcaaagctgttttttctcagggcgggtggcgaaaggccataagatgcactaccccatggtcgagtactgcacaccaacaacctccggcgaggacgtgagagattttgcaaaagtacttaaaaacaaatttcgtactaagcggtactttgctaagcatccgcggatgggctacctaccagtgcagacggtgctcgaaggagacaacatggagacagatacaatg

SEQ ID NO: 251257 - DNA, 3591 bp, Artificial Sequence
  Description of Artificial Sequence: Synthetic coding sequence
atgctgtggtgggaagaggttgaggactgttatgaaagagaagacgttcaaaaaaagacctttaccaaatgggtcaatgctcagttttcaaaatttggaaagcagcatattgagaatttattttctgatctgcaggatggccgtagattattggatttattggaggggttaacaggacaaaaacttcctaaagaaaaaggtagcacccgggtgcacgctctgaataatgtgaacaaggcgctcagggttcttcagaacaacaatgttgatttagtcaatatcggttcaactgacattgtcgatggaaatcacaaactgacactcgggcttatatggaatattattctgcattggcaggtcaagaatgttatgaaaaacattatggctggattgcagcaaacaaattctgaaaaaatcctgttatcatgggtccgtcagtccacacgtaattatccccaggtgaatgtaattaattttactaccagctggagcgacggccttgccctgaacgcacttatccatagccacagaccagatctgttcgactggaatagcgtggtgtgccagcaaagtgctacacagcggttagagcatgcctttaacattgccaggtatcaattagggattgagaaattgcttgacccagaggatgtcgatacgacgtatccggataaaaaatctattttgatgtatataacgtctttattccaagtccttcctcagcaggtcagcatcgaagccattcaagaagttgaaatgcttccgagaccgccgaaggttactaaagaagagcattttcagctacaccatcagatgcattatagtcaacagatcaccgtgagtcttgcacaaggttatgaacggacgtcatccccgaaaccgagattcaaatcatacgcttatacgcaagctgcatatgtgacaacatccgaccctacccgatctccatttccgtctcagcatttggaggcgccagaagacaaatctttcggctcatcgttaatggaatctgaagttaatcttgatcgatatcagacagccctcgaagaggtgttgtcttggcttctctccgcagaagacacgttgcaagcacaaggagaaatcagtaatgatgtggaagttgtcaaagatcagtttcatactcacgaagggtacatgatggaccttacagcgcaccaaggccgggtcggaaatatcttgcagctgggctcaaaattgattggaacggggaagttgagcgaagacgaagagacagaagtacaggaacagatgaacctgctgaattctcggtgggagtgtttacgggtagcgtcaatggaaaaacaatctaatttgcatagggtgttaatggatttgcagaaccaaaaactgaaggaactgaacgactggctaactaaaacagaggagcgtacacgaaaaatggaggaggaaccgcttggccctgatctggaggaccttaagagacaggttcaacaacacaaggtgctgcaggaagatctggaacaggagcaagtacgggtcaattcgctgacgcatatggtcgtcgtggtggacgaatcgtccggagatcatgcaacagctgcactggaagaacaattgaaagttttgggagaccgctgggccaacatttgccgatggaccgaggataggtgggttctattacaggatatcctgcttaaatggcaacgtcttacagaagaacagtgtctgttctcggcctggctgtccgagaaagaggatgcggttaataaaattcatacaaccggctttaaggatcaaaatgaaatgttgtctagcctccagaaactggccgttttgaaagcagatcttgagaagaaaaaacagagtatggggaaactgtattcacttaaacaagacctgttatctacactcaagaataaatctgttacccaaaagacagaggcatggctcgacaactttgctaggtgttgggacaatctcgttcaaaaattagaaaagtctacggcccagataagccaagcagttacgaccacgcagccgtcactgacgcagacaactgtgatggaaacagtaactaccgtcacaacccgagagcagatccttgttaaacatgcgcaggaagaacttccaccgcctccgcctcagaaaaaacgccagattacggtagacacccttgaacggcttcaggaacttcaggaagcaacggacgaattagatctcaaactgcgacaagctgaagttatcaagggatcgtggcaaccagttggtgatctcctgatagattcactgcaggatcacctggagaaagtaaaagctctccggggtgagatcgcaccgctgaaagaaaacgtttctcacgtcaacgacctcgcaaggcagctaacaacacttggtatccagttaagtccatacaatcttagcactttagaagatctcaatacacgctggaaacttttgcaggtggcggtagaagatagggtccgtcaacttcatgaagcgcatagagattttggacctgcttcacagcatttcctgtcaacatcggtgcaaggtccgtgggaacgtgcaatttcccccaataaggtcccatattacattaatcacgaaacccaaacaacatgctgggatcatccaaaaatgacggaactatatcaatcgttagctgatctcaacaatgttagattttccgcatatcgtacagcgatgaagctgcggcgtttacaaaaagccttatgcttagatttactttctctaagtgcagcatgtgatgccctagatcagcataacctcaaacagaacgaccagccaatggatatcctgcagattatcaactgtctgacaacgatctatgatcgccttgagcaagagcataataacctggtaaacgtccctctatgtgttgatatgtgtctcaattggttgctgaatgtctacgatactgggagaactggtcgtatcagggtgctttcgtttaagaccggcatcatttcattgtgtaaagctcaccttgaagacaaataccggtatctttttaaacaggttgcgagcagcactggattctgcgaccagaggcgtctcggacttctcttacacgattccattcagatccctcggcagttaggcgaagtagcaagctttggaggctcgaacatcgagccctcggtgcgatcatgttttcaattcgccaataacaagccagagattgaagcagcgttgttccttgattggatgcgcctcgaacctcaatcgatggtatggctgccggttctgcacagagtcgcggctgcagaaactgcaaaacaccaggctaaatgtaacatttgcaaagagtgtccaattattggatttcgatatagatccctgaaacactttaactatgacatatgtcaatcttgtttcttctctggacgtgtcgcaaagggtcataagatgcactatcctatggtcgaatactgtacaccaacgacgtcaggagaggacgtaagagatttcgcaaaagttctgaaaaacaaattccggacaaaacgatattttgctaaacatccgcgtatggggtaccttcctgtccaaacggtactagagggagataacatggaaaccgacactatg

SEQ ID NO: 251258 - DNA, 3591 bp, Artificial Sequence
  Description of Artificial Sequence: Synthetic coding sequence
atgctttggtgggaggaagtagaggattgttatgaaagggaagacgttcaaaaaaaaacgttcactaagtgggtaaacgcccagttctctaagtttggtaaacaacacattgaaaaccttttttcagatttacaggatggtagaagacttctggaccttctggagggtctcaccggacagaaattgcccaaggagaagggtagcactagggtgcatgcgctgaacaatgttaataaagccctcagggtgttgcaaaacaacaacgtggacctcgtaaacattgggagcacggatatcgtcgatggaaatcacaaactgacccttggactgatatggaacatcatcctgcactggcaggtgaagaatgtcatgaaaaacattatggcgggactgcagcagacaaactccgagaagatactgctgtcttgggtgagacaaagcacccgcaattatccccaggtgaatgttatcaattttacaacaagttggtccgatgggctggctttaaatgctctgatccacagccatcgaccagacctgttcgactggaattccgtggtgtgtcagcagtctgcaactcaacggctggaacacgctttcaacatagcaaggtatcaactggggattgaaaaactgctggatcccgaagatgtggacacaacttatccagacaaaaagtcaatattgatgtatatcactagcctgttccaggtgctcccccaacaggttagtatcgaggcaattcaagaggtggaaatgcttcctaggcctccaaaagtaacaaaagaggagcacttccagctgcaccaccagatgcattatagtcagcaaatcactgtgagcctggcccagggctatgagagaaccagctcgccaaagcctaggttcaaaagctacgcctacacgcaggctgcttacgttacaacttcggaccctactcggtctcccttccccagccagcacctggaagccccagaagataaatctttcggatcaagcctcatggaaagtgaagtgaacttggatcggtaccagacagcattggaagaagtactttcatggctgctctcagccgaagacacgctgcaggctcagggtgaaatctcgaacgatgtcgaggtagtgaaggaccaatttcacactcacgaaggatatatgatggaccttacagcacaccagggccgcgtcggcaacatactgcagctgggctctaagctgatcggaactgggaaattaagcgaagacgaagagacagaggtccaggaacagatgaatttgttgaatagtcgctgggaatgcctccgagttgccagtatggagaagcagagtaatctgcacagagttctcatggatctccagaatcagaagctgaaagaactgaatgattggttgactaaaactgaagagagaacaagaaagatggaggaggagccacttggccccgatctggaagatctaaaaagacaggtgcagcaacataaagttctccaagaggacctggagcaggaacaggtgcgggtcaactcgcttacccacatggtcgtggtagtggacgagagtagtggtgaccacgccaccgctgcactcgaggagcagctgaaagtcctgggggatcgctgggccaatatatgcaggtggactgaggatcgctgggtgctactgcaagacatcctgctgaagtggcaaaggctcacggaggagcagtgtctgttcagcgcctggctgtcggagaaggaagatgctgtgaacaagatccatactactggtttcaaagatcagaatgaaatgttgagttccctgcaaaagctggccgttctgaaggcagacctggaaaagaagaaacagagcatggggaaactgtactccctgaagcaggatcttctctccacactgaagaacaagagtgtcacacagaagactgaagcgtggcttgataatttcgcaaggtgctgggacaatctggtgcaaaagctggagaagtcaacagcacagatctcccaggctgtcacgaccacccagccgtcattgacacagacaacagtgatggagactgtcacgaccgtcacaactagagaacagattctggtgaaacatgcacaggaagaactgcctcccccacctccccagaagaaaagacagattaccgtggataccctggagagactgcaggagttacaggaagctactgacgaactggacctgaagctgcgccaagccgaagtaataaagggttcttggcagccagtcggggacctcctgatagatagccttcaggaccatctggaaaaggtgaaggctctccgtggggaaatagctccactcaaggagaatgttagccacgtgaatgacctcgcacgccaactcactaccctgggtatacagctgtcgccctataatctgtcaaccttagaagacctgaatactcgatggaagctgttgcaagtcgctgtcgaagacagggtgcgccaactccatgaagcccatagggatttcgggcctgccagccagcactttctgtccacatcagtccaggggccctgggagcgcgccatcagtccaaacaaagtgccctattatatcaaccacgaaactcaaactacttgttgggatcatcctaagatgacagagctttatcaaagcctggcggatctaaacaacgttcggtttagcgcctatcgaactgctatgaaactgaggcggttacagaaggcgctctgcctggacctgctcagcctgtccgcagcctgcgatgcgcttgaccagcacaacctgaagcagaatgaccagccaatggatatactccaaattatcaactgtttgaccactatatacgatcggttagagcaagaacataataatctggttaacgtgccgctctgtgtcgatatgtgcttgaactggctgcttaacgtgtacgatacaggtagaacaggcaggattcgagttctgtcgtttaaaactggaattatttccctatgcaaagcccacctagaggacaaatacaggtacctgttcaaacaggttgcctcttcaaccggattctgtgaccagcgaagactcggcctgctgcttcacgactccatccagatcccccggcaacttggcgaggtagcctctttcgggggctctaacatcgaaccctctgtccgcagctgtttccagttcgcgaacaataagccggaaattgaggcagcattgttcctggactggatgcgcttagaaccgcagagcatggtctggctgcctgttctgcaccgggtcgcagcagccgaaaccgctaaacaccaggccaaatgtaatatttgtaaagagtgcccaatcatcggttttcggtacaggtctctgaaacactttaattacgatatatgtcaatcatgttttttttctgggagagtggcaaaagggcataaaatgcactaccccatggtggagtattgcacgcctaccacatctggggaagacgtgcgagacttcgctaaagtgctcaagaataagtttcggaccaaacgctactttgccaaacatccgagaatgggctatctgcccgtgcagactgtgctggaaggcgacaacatggaaactgacaccatg

SEQ ID NO: 251259 - DNA, 3591 bp, Artificial Sequence
  Description of Artificial Sequence: Synthetic coding sequence
atgctgtggtgggaagaagtcgaggactgttacgaaagagaagatgtgcagaaaaagacttttactaagtgggtcaacgcccaatttagcaaattcggaaagcaacacattgagaacctgttttccgatcttcaggacgggcgcagattgctcgaccttctggaaggactgaccggccagaaacttcccaaggaaaaaggaagcactagagtgcacgcattgaacaacgtgaacaaggcactgcgcgtgctgcagaataacaacgtggatctcgtgaatattggttccaccgacatcgtggacggtaaccataaactcacgcttggtcttatctggaacattatactgcattggcaggtgaagaacgtgatgaagaacattatggcaggactgcaacagaccaactccgaaaagatcttgctctcgtgggtgagacagagcacgcgtaactacccacaggtcaacgtgataaactttaccactagctggtcggacgggcttgcactgaacgcccttatccattcccacagacctgacttgttcgattggaacagcgtggtgtgtcagcaatcagccacccaacgcctggaacatgccttcaacattgcccggtaccaactcggaattgaaaaacttctggaccctgaagatgtggacactacttatcccgataagaagagcatccttatgtacattacttcgctgtttcaagtcctgccccagcaagtgtcaattgaagcaatccaggaggtggaaatgctcccacgaccgcctaaggtaaccaaagaagagcacttccagcttcatcaccagatgcactactcccagcagattaccgtgtcactggcgcagggatacgaacggactagcagcccaaaaccaagatttaagtcttacgcatacacccaagcggcgtacgtgaccacctcggatccaactcggagccctttcccatcgcagcatcttgaagcacccgaagataagtcgtttggttcgtcactgatggagtcggaggtgaacctggatcggtaccagaccgcgctggaagaagtcctttcgtggctgctgtccgcagaggacactcttcaggcccagggtgagatcagcaatgatgtggaagtcgtgaaggatcagtttcatactcacgaggggtacatgatggatctgaccgctcatcagggcagagttggtaacattcttcagctcggcagcaaactgatcggcactgggaagctgtcggaagatgaagaaactgaggtccaggaacaaatgaaccttctgaactcgagatgggagtgtctccgggtggcatctatggaaaaacagtcgaatctgcatagagtccttatggaccttcagaaccagaagctcaaagaactgaacgactggttgactaaaactgaggaacgcactagaaagatggaagaagagccccttggtcctgatcttgaggatctcaagcggcaagtgcagcagcataaggtgttgcaagaggatctggaacaggaacaggtgagagtgaactccctcactcacatggtggtcgtcgtcgacgaatcttcgggtgaccacgcgaccgcagcacttgaggaacaacttaaagtcctgggagatcgctgggcaaacatttgcagatggaccgaggataggtgggtgctgcttcaggacatactcctgaaatggcaaagactcactgaagaacaatgtctgttctcggcatggctctccgaaaaagaggatgccgtcaacaaaattcataccacgggatttaaggaccagaatgagatgctttcctccctccaaaagctggcagttctgaaggccgatttggagaagaaaaaacagagcatggggaagttgtactcattgaagcaagatctgctctcaaccctgaagaacaagtccgttactcaaaagactgaagcatggcttgataacttcgctagatgttgggataacctcgtgcaaaaacttgaaaagtccaccgcccaaatcagccaggccgtgaccacgacccaaccttccttgacccagacgactgtcatggagactgtgacgactgtcaccacgcgcgaacagatcctcgtgaagcacgcgcaagaggagttgccacccccaccccctcagaagaagagacaaattaccgtggatactcttgagagactgcaggaacttcaagaagcaaccgacgagcttgatctgaagctgcggcaagcagaggtcattaaaggctcatggcaacctgttggtgatctgttgattgatagccttcaggatcatttggaaaaggtcaaagcactcaggggggagatcgcgcctctgaaggagaatgtgtcccatgtgaatgatcttgcccggcagctcaccaccttgggtattcagctgagcccttacaatttgtcgaccctggaagatctcaatacccgctggaagctccttcaagtggcagtggaagatcgcgtgcgccaactccacgaagcacatagagactttggtcctgcctcacaacacttcctttccactagcgtgcaaggtccctgggaacgcgccatttcgcctaacaaggtcccatactacattaaccatgagactcaaactacctgttgggatcatccaaagatgaccgagctgtaccagtccctcgcagacctgaataatgtcagattctcagcataccggaccgccatgaagctgaggcggcttcaaaaggcactttgcctggatctgctctccctttcggcagcgtgtgacgccctcgatcagcataatctcaagcaaaacgatcagccaatggatattctgcaaatcatcaattgtctgaccactatttacgatcgccttgaacaagaacacaataacctcgttaatgtccctctgtgtgtggatatgtgcctgaattggctcctcaacgtctacgatactggtaggactggaagaatccgtgtccttagtttcaagaccggcattatctccttgtgtaaggcacatcttgaggacaagtacagatacctgttcaaacaggtggcatcgagcaccggattttgtgatcaaaggcgtctgggtttgcttctgcatgatagcatccagatccctagacaacttggtgaagtcgcgagctttggaggatccaatatcgagccttccgtcagatcctgctttcagttcgctaacaataaacctgaaatcgaggctgctctgtttctggattggatgaggctcgagccccagtcgatggtctggctgccagtgcttcatcgagtggccgcagcagaaaccgcgaaacatcaggcaaagtgtaatatctgtaaagaatgtcccattattggctttcgttacagatcgttgaaacacttcaattacgatatctgccaaagctgttttttctcgggacgagtcgcgaagggacataagatgcactacccaatggtcgaatactgcactcccactacttcgggtgaagatgtccgtgatttcgccaaggtgcttaagaataagtttagaaccaagaggtacttcgcaaagcacccacgtatgggttatctccctgtccagactgtcctggagggcgacaatatggaaacggacactatg

SEQ ID NO: 251260 - DNA, 3591 bp, Artificial Sequence
  Description of Artificial Sequence: Synthetic coding sequence
atgttgtggtgggaggaggtggaggactgctacgaacgagaggacgtacagaaaaaaacctttaccaagtgggtgaatgcacaattctcgaaattcgggaaacagcacatcgaaaatctcttctccgacctgcaggatggacgcaggctgctggatttgctggagggcctgacaggacaaaagctcccgaaagaaaaaggcagcacccgggtgcacgccctgaacaacgtgaacaaggccctgagagtgcttcagaacaacaacgtagatttagtcaacatcggatccaccgatatagtggatgggaaccacaagctaaccttgggcctgatctggaatatcattctgcattggcaggtgaagaatgttatgaaaaacatcatggccggcctgcagcaaaccaattcagagaagatcctgttgagttgggttaggcagagcacccggaactaccctcaggtcaacgtgattaatttcacaacttcgtggagcgacggactggccttaaacgccctgatccactcacaccgtccagacctgttcgactggaactccgtcgtttgccagcagtcagcgacccagcggctggaacacgccttcaacatcgcccgctaccagctcggtatcgaaaaactgctggaccctgaggacgtcgacacgacctatcccgataagaaatctatcttaatgtatatcacttccttatttcaggtccttccccagcaggtgtccatcgaagccatccaagaggtagaaatgctgccgaggcctccaaaggtgacgaaggaagaacactttcaactccatcatcagatgcattactcacagcagatcacagtttccttggcccaaggatatgagaggacaagtagccccaagccccgcttcaagtcatatgcttatacacaggctgcatacgtcaccaccagtgacccaacccgctcgccctttcccagtcagcacctcgaggccccagaggataagtccttcggctcctccctgatggaatcagaagttaatctggataggtatcagacagcactggaagaggtcctttcctggctcctatccgccgaagacaccttgcaggcgcaaggtgaaataagtaacgacgtggaggtggtcaaagaccagtttcatacacatgagggttacatgatggatctgactgcacaccagggccgcgtgggaaacattctacagctggggtcaaagttgattggaactgggaagctttcagaggatgaagagactgaggtgcaagagcagatgaacctgctgaatagccggtgggaatgtctgcgggtcgcatcaatggagaagcaatctaatctccacagagtgctgatggaccttcaaaatcagaagctaaaggagctgaatgactggctgaccaaaactgaagagcgtacacggaaaatggaagaggaaccactcggtcccgatctggaggatctgaagcggcaggtacagcagcataaagtgctgcaggaggatcttgagcaagagcaagtgagggttaacagtcttacacatatggtggtcgtggtagatgaaagttccggagatcatgccacggccgcattagaggaacagctcaaggtgctcggtgatcgctgggcaaacatttgcagatggacggaagatcgctgggtactgctgcaggatattcttcttaagtggcaaaggctgaccgaggaacagtgcctgtttagcgcctggttgagcgaaaaggaagacgccgtaaacaagatccataccacaggtttcaaagatcagaacgagatgctctccagtcttcagaaactcgctgtcctgaaggccgaccttgaaaaaaagaagcagagtatgggcaaattgtacagtttgaagcaggacttgttgtcgactctgaagaacaagagcgtcacacagaagaccgaggcctggttagacaatttcgccaggtgctgggacaacttggtgcagaaactcgaaaagtccactgcccagatctctcaagccgttactaccacacagccttcattgactcagaccacggtgatggaaacagtgacaactgtcacaactagagaacaaattcttgtgaagcatgcccaagaagaactgcctccgccacccccccaaaagaaacgccaaattacggtggacaccctggaacgactccaagagttgcaagaagccacagatgagctcgatctcaaactccgtcaagccgaagtgataaaagggtcgtggcaacctgtgggagatctcctgatcgactccctccaggatcatctcgaaaaagtgaaggctcttcgaggcgaaatcgcgcctctgaaggagaatgtctcccatgtgaatgatctggccaggcagctgactacccttggcatccaactgagcccttataatttgtctaccctggaggatttgaacacccggtggaagctgctgcaggttgccgttgaggacagagtgcgacaactgcatgaagcccatcgggatttcgggccggcttctcagcactttctttcaactagtgttcagggcccatgggagagagccatcagtcctaacaaagtgccctattatatcaaccacgagacgcagaccacgtgttgggatcaccctaaaatgaccgaactgtatcagagcttggctgatctgaacaatgtacggttctccgcatatcgaacagctatgaagctgcggaggctgcaaaaggccctctgcctggatctgctgtcgctttccgcggcatgtgatgccctggatcagcacaacttaaaacagaacgaccagcctatggatatcctgcagattattaattgcctgacaactatatacgaccgcctggaacaagagcacaacaatctagtcaacgtcccattgtgtgtggatatgtgccttaactggttgctcaacgtgtacgatacgggacgaacaggtaggattagagtactgtcctttaaaacaggcatcatctcactctgtaaagcccacctggaagacaaataccggtacctgttcaagcaagtggcatcttcaacaggcttctgtgatcagaggcgcttagggctgctgctacatgactctattcagattcctaggcagctgggagaggtggcatcattcgggggcagcaatatcgaacccagtgtgaggtcttgcttccagttcgctaacaacaagcctgagatagaagcagccttattcctcgattggatgcggttagagccccagtcgatggtgtggctccccgtcttacaccgggtggccgcagccgaaacagcgaagcaccaggcgaaatgtaatatctgcaaagaatgtcccattatcgggttcagatatcgaagcctgaagcactttaactacgacatatgtcagagctgcttcttttccggacgcgtggctaaggggcacaagatgcactacccgatggttgagtactgtactccgacaacaagcggggaggatgtgcgggattttgccaaggtgctcaaaaacaaatttagaactaaacgttatttcgcaaagcaccctaggatgggttatttgccagttcagaccgtcttggaaggggacaacatggagaccgataccatg

SEQ ID NO: 251261 - DNA, 3591 bp, Artificial Sequence
  Description of Artificial Sequence: Synthetic coding sequence
atgttgtggtgggaagaagtggaagattgttacgaacgggaggacgtgcagaagaaaactttcactaagtgggtgaatgctcagttctcgaagtttggaaagcaacacattgaaaatctgttctccgacctgcaggacggtagacgcttgctcgacctgctggagggactcactggacagaaactgccgaaggaaaagggttcgaccagagtccatgcactcaacaacgtcaacaaggccctgcgcgtcctgcaaaacaacaatgtggatctggtcaacatcggttccactgatatcgtggatggaaaccacaaactcaccctcggtcttatctggaatatcatccttcactggcaagtgaaaaatgtgatgaaaaacatcatggccggcctccaacaaactaactctgaaaagattctcctgtcatgggtgcggcagtcaactcgcaactacccgcaggtgaatgtgatcaactttacgacctcgtggtcagacggactggctcttaacgccctgatccactcacacagacctgatttgttcgactggaactcagtggtgtgccagcaaagcgctacccagcggctggaacacgcattcaatatcgcgaggtaccaacttggaattgaaaaactgctggatccggaggacgtcgatactacttacccggacaagaaatcgatcttgatgtacataacgtcactgtttcaagtgctgccgcagcaggtcagcattgaggccattcaagaagtggaaatgctcccgcggccaccgaaggtgactaaagaggagcactttcaactgcaccaccagatgcattactcacagcaaatcaccgtgagcctggcccagggctacgaacggacttcctcgccgaaacctagattcaaatcctacgcctacacccaggctgcttacgtgactacgtccgacccgacccggtcgcccttcccatcccagcatctggaagccccggaggacaaatcatttggttcgagcctgatggaatcggaagtgaacctcgaccggtatcagactgcacttgaggaggtgctcagctggctgctctcagccgaagatactctgcaagcacaaggagaaatctccaacgatgtggaggtcgtgaaagatcagttccatactcacgaaggctacatgatggaccttaccgcccaccagggccgggtggggaacatcctgcagctcggatcaaagctgatcggaaccgggaaactttccgaggacgaagaaaccgaagtgcaagaacagatgaatcttctgaactcacgttgggaatgtctccgcgtggcgtcgatggagaaacagtccaaccttcacagagtgctgatggacctgcagaaccagaagctgaaggaactgaacgactggctcaccaaaacggaggaacggaccagaaagatggaggaggaaccactcggccctgatcttgaggacttgaagcgccaagtccaacagcacaaggtgcttcaggaggacctggaacaggagcaggtgagggttaattccctgactcacatggtcgtcgtggtggacgaatcgtccggagatcacgcaactgccgccctggaggaacagcttaaagtgctgggcgaccggtgggctaatatctgcaggtggactgaggataggtgggtgctgctccaagatatcctgctcaagtggcagcgcctcaccgaggagcagtgtctgtttagcgcgtggctcagtgagaaggaggatgccgttaacaagattcatacgaccggatttaaggaccagaacgaaatgctctcgtctctgcagaaactggccgtgctgaaggccgatcttgaaaagaagaagcaatccatgggaaaactgtattccctcaagcaagacctcttgagcaccttgaaaaacaagagcgtgacccaaaagaccgaagcgtggctggacaacttcgcgcgctgctgggacaacctggtgcaaaaactggagaagtcaaccgcgcagatctcccaggcggtgactaccacccagccctcactgacccagaccaccgtcatggagacggtcaccaccgtgacgactcgggagcagatcctggtgaagcacgcacaggaggaacttcctccgccgccaccacagaaaaagaggcagatcactgtcgacaccctggagcgccttcaagaattgcaagaggccaccgacgagcttgatctgaaactgcgacaggccgaggtgatcaagggatcatggcagccggtgggcgacctgcttattgactctctgcaggaccatctcgaaaaagtgaaggcactgagaggagaaatcgcacccctgaaagagaacgtgtcccatgtgaatgatctcgccaggcagctcacgaccctcggaatccaactctcgccttacaatctgtccacccttgaggacctgaatacccggtggaagctgctgcaggtcgcagtggaggatcgcgtgcgccaactccatgaggcgcatcgggacttcggaccagccagccagcatttcctttccacttcggttcagggcccctgggagcgtgctatctctcctaataaggtcccgtactacattaaccatgaaacccagactacctgctgggatcacccaaagatgaccgaactgtaccagtcactggccgatttgaataacgtgcgcttctcggcctacaggacggcaatgaagctccgcaggctccaaaaggcgctgtgcctcgatctcctgtccctttccgccgcatgcgatgcattggaccagcacaacctgaagcagaatgaccagcccatggacattctccagattatcaattgcctgactactatctacgaccgcctggaacaagagcacaacaatctggtgaacgtgccgctctgtgtcgatatgtgccttaattggctgttgaatgtgtacgatactggccgcaccggccgcattagagtgctctcatttaagactggaatcatctccctgtgcaaggctcatctcgaggacaagtacagatacctctttaaacaggtggccagctcgacgggcttctgcgaccaacggcgcctcggcctgctgcttcatgattccatccagatcccgaggcaactgggagaagtggcgtcctttggaggctctaacattgaaccaagcgtccgctcgtgtttccaattcgcaaataacaagccggaaatcgaagctgcactgttcctcgactggatgaggctcgagccacagagcatggtctggttgcctgtgcttcatcgcgtggccgccgctgaaaccgcaaagcatcaggccaagtgcaacatctgtaaggaatgtccgatcatcgggtttagataccgctcactcaagcacttcaattacgacatctgccagtcgtgctttttctcgggacgcgtggccaaaggccacaagatgcactacccgatggtggagtactgcactccaaccacttcaggagaagatgtgcgggacttcgcaaaagtgctcaaaaacaaatttcggaccaaacgttactttgccaagcatccgaggatgggatacctcccagtgcagactgtccttgaaggtgataacatggagactgacaccatg

SEQ ID NO: 251262 - DNA, 3591 bp, Artificial Sequence
  Description of Artificial Sequence: Synthetic coding sequence
atgctgtggtgggaggaggtcgaggactgctacgaacgggaagacgtgcaaaagaagacatttacaaaatgggtgaatgcccagttctccaagttcggaaaacagcacatcgagaaccttttcagcgacctgcaagatggtagaagattgttggatttgctcgagggccttaccggacagaaacttccaaaggaaaagggctcaacaagagtgcatgctctcaataacgtaaataaagcactccgggttttgcagaacaataatgtcgacctcgtgaatattgggagcacagatatcgtggatggcaaccacaagttgacgcttggcctgatttggaacattattttgcattggcaggtgaagaacgtgatgaagaacatcatggctggtctgcagcagactaatagtgagaaaatcctcttgagttgggtgagacagagtacaagaaactacccccaggtgaatgtgataaacttcactacctcttggtctgacggcctggcactgaacgctctgatacatagtcatagaccggatctctttgactggaatagcgtggtgtgtcagcagagcgcaactcagcggctggagcacgccttcaacatagcacgataccagcttgggattgagaagctgctggatccagaagacgtagacaccacatatccagataagaaaagcatactgatgtatatcactagccttttccaagtgctgcctcaacaagtgtccatcgaagctatccaagaagtggagatgctcccacggccacctaaggtgacgaaggaagagcactttcagctgcaccaccagatgcactactcacagcagatcacagtgagtctcgcacaaggttacgaaagaacatcctctcctaaaccaagatttaaatcttacgcctacacacaggccgcatacgttactacttctgacccaactagatctccgttcccctcacagcacttggaggctcccgaggacaagtcctttggctcttcactcatggagagcgaggtgaatctggatcgctatcagactgccctcgaggaggtgctgtcttggcttcttagcgctgaggacaccctgcaagctcagggagagattagcaacgacgttgaagtcgtaaaagatcaatttcatacccacgaaggctatatgatggatctcacagcccaccaaggacgggtcggtaatatactgcagctgggatctaagctgatcggtacagggaagcttagtgaagatgaggagacggaggtgcaagaacagatgaacctgctgaactctcggtgggagtgcctccgcgtcgccagcatggaaaaacaaagcaacctgcatagagtcctgatggatctgcagaaccagaaactcaaagagttgaatgattggctgacgaaaacagaggaaagaacaagaaaaatggaagaagagccgctcggccctgatcttgaggatctcaagaggcaggttcaacagcacaaggtgctgcaggaagatctcgagcaggagcaagtgagggtaaactcactgactcacatggtagtcgttgtggatgaatcatctggtgatcacgcgacagccgcattggaggaacagctgaaggtactgggtgataggtgggcaaacatctgccgctggaccgaagataggtgggtgctgctgcaggacattctgcttaagtggcagaggttgactgaggagcagtgtctgtttagcgcctggctgtctgaaaaggaggatgcagtgaacaagatccataccacagggttcaaggatcagaatgagatgctgagttccctgcagaaactcgctgttctgaaggcagacttggagaagaagaaacagagtatgggaaagctgtacagcctgaagcaggatctcttgtctactctgaagaataagtccgtgactcagaaaactgaggcatggctggacaattttgcccgctgctgggacaacctcgttcagaaactggaaaaaagtactgcccagatttcccaggctgtaaccacgacacagccctccctcacacaaactaccgtgatggagacagtgaccacagtcaccacaagggagcagatacttgttaagcacgcccaggaggagctgccccctccaccccctcagaagaagcggcagatcacagtggatacactcgaacgcctgcaggaactccaggaggcaactgatgagctggacctgaagctgaggcaggcagaagtcatcaagggcagttggcagcccgtcggtgaccttcttatcgactcacttcaagaccaccttgagaaggtgaaggccctgcgcggtgagatcgcccctttgaaggaaaatgtctcacatgttaacgatttggcacggcaactgactacgctcggaatccagctcagcccatataacttgtccacgctggaggaccttaacacgcgctggaagttgctgcaagtggccgttgaggatcgggtccggcagctgcacgaggctcatagggactttggccccgcttctcagcacttcctgtccacctccgtgcagggcccttgggaaagagctatcagcccaaataaggtgccatactatataaaccatgagacccagaccacttgttgggatcatccgaagatgactgaactctatcaaagtctggccgatctgaacaacgtcagattcagcgcctaccggaccgccatgaaactccgacgcctccagaaggcgctgtgcctcgatctgctttcactttccgcagcgtgtgacgcactggaccagcataacctgaaacagaacgaccaacccatggacatcctgcaaattatcaattgccttaccaccatttatgaccgacttgaacaggaacacaacaacctggtaaacgtccctctgtgtgtggatatgtgtctcaactggttgttgaacgtttatgacaccggcaggacgggtagaatccgcgtcctgagctttaagacaggcatcatttcactgtgcaaagcccacttggaagacaaatatcggtaccttttcaagcaggtcgcttcctcaacgggattctgcgaccagcgcagactgggactccttctccatgattccatacagataccccgccagcttggcgaggtggcctcctttggaggcagcaatatagaaccatccgtgcgaagttgctttcagtttgccaataacaagccagagatcgaagctgccctgtttctggactggatgaggctggagccgcagtctatggtgtggctgcctgtgctccacagggtagcagccgctgagaccgcgaaacaccaagccaagtgtaatatctgtaaggagtgccctatcattgggttcaggtacaggtcattgaagcactttaactatgacatatgccagagttgcttttttagtggcagggtggccaaaggacacaaaatgcattaccccatggtggagtactgcacgcctacaactagtggtgaggatgtgcgagatttcgccaaagtgctcaagaacaagttccgaactaaacggtatttcgccaaacaccctagaatgggctatctgcccgtgcagaccgttctggaaggcgacaatatggagaccgacacgatg

SEQ ID NO: 251263 - DNA, 3591 bp, Artificial Sequence
  Description of Artificial Sequence: Synthetic coding sequence
atgttatggtgggaagaagttgaagattgttatgaacgtgaagatgtacaaaaaaaaacgtttacgaaatgggttaatgcgcaattttcgaaatttggtaaacaacatatagaaaatctattttcggatttacaagatggtcgacgtttactagatttattagaaggtttaacgggtcaaaaactaccgaaagaaaaaggttcgacgcgtgtacatgcgttaaataatgttaataaagcgttacgagtactacaaaataataatgtagatttagttaatataggttcgacggatatagtagatggtaatcataaactaacgttaggtttaatatggaatataatactacattggcaagtaaaaaatgtaatgaaaaatataatggcgggtctacaacaaacgaattcggaaaaaatattattatcgtgggtacgacaatcgacgcgaaattatccgcaagtaaatgtaataaattttacgacgtcgtggtcggatggtttagcgttaaatgcgttaatacattcgcatcgaccggatttatttgattggaattcggttgtatgtcaacaatcggcgacgcaacgactagaacatgcgtttaatatagcgcgatatcaactaggtatagaaaaattattagatccggaagatgtagatacgacgtatccggataaaaaatcgatattaatgtatataacgtcgttatttcaagttttaccgcaacaagtttcgatagaagcgatacaagaagtagaaatgttaccgcgtccgccgaaagtaacgaaagaagaacattttcaattacatcatcaaatgcattattcgcaacaaataacggtatcgttagcgcaaggttatgaacgaacgtcgtcgccgaaaccgcgttttaaatcgtatgcgtatacgcaagcggcgtatgtaacgacgtcggatccgacgcgatcgccgtttccgtcgcaacatctagaagcgccggaagataaatcgtttggttcgtcgttaatggaatcggaagtaaatttagatcgttatcaaacggcgttagaagaagtattatcgtggctactatcggcggaagatacgttacaagcgcaaggtgaaatatcgaatgatgttgaagtagtaaaagatcaatttcatacgcatgaaggttatatgatggatctaacggcgcatcaaggtcgtgttggtaatatactacaactaggttcgaaactaataggtacgggtaaattatcggaagatgaagaaacggaagtacaagaacaaatgaatttattaaattcgcgttgggaatgtctacgtgtagcgtcgatggaaaaacaatcgaatctacatcgagttttaatggatttacaaaatcaaaaactaaaagaattaaatgattggctaacgaaaacggaagaacgtacgcgtaaaatggaagaagaaccgttaggtccggatttagaagatttaaaacgtcaagttcaacaacataaagttttacaagaagatctagaacaagaacaagttcgtgtaaattcgttaacgcatatggttgttgtagttgatgaatcgtcgggtgatcatgcgacggcggcgttagaagaacaattaaaagttttaggtgatcgatgggcgaatatatgtcgatggacggaagatcgttgggtattactacaagatatactactaaaatggcaacgattaacggaagaacaatgtctattttcggcgtggttatcggaaaaagaagatgcggttaataaaatacatacgacgggttttaaagatcaaaatgaaatgctatcgtcgttacaaaaattagcggtattaaaagcggatctagaaaaaaaaaaacaatcgatgggtaaattatattcgctaaaacaagatctattatcgacgttaaaaaataaatcggtaacgcaaaaaacggaagcgtggctagataattttgcgcgatgttgggataatctagtacaaaaattagaaaaatcgacggcgcaaatatcgcaagcggtaacgacgacgcaaccgtcgttaacgcaaacgacggtaatggaaacggtaacgacggttacgacgcgtgaacaaatactagtaaaacatgcgcaagaagaattaccgccgccgccgccgcaaaaaaaacgtcaaataacggttgatacgctagaacgtctacaagaactacaagaagcgacggatgaattagatttaaaattacgtcaagcggaagtaataaaaggttcgtggcaaccggtaggtgatttattaatagattcgctacaagatcatttagaaaaagttaaagcgctacgtggtgaaatagcgccgctaaaagaaaatgtatcgcatgttaatgatctagcgcgacaattaacgacgctaggtatacaactatcgccgtataatttatcgacgctagaagatttaaatacgcgttggaaattattacaagtagcggtagaagatcgagttcgacaattacatgaagcgcatcgtgattttggtccggcgtcgcaacattttctatcgacgtcggtacaaggtccgtgggaacgtgcgatatcgccgaataaagtaccgtattatataaatcatgaaacgcaaacgacgtgttgggatcatccgaaaatgacggaactatatcaatcgctagcggatttaaataatgttcgtttttcggcgtatcgaacggcgatgaaattacgacgtctacaaaaagcgttatgtttagatttattatcgttatcggcggcgtgtgatgcgctagatcaacataatttaaaacaaaatgatcaaccgatggatatactacaaataataaattgtctaacgacgatatatgatcgtttagaacaagaacataataatctagtaaatgtaccgttatgtgtagatatgtgtttaaattggctactaaatgtttatgatacgggtcgtacgggtcgaatacgtgttctatcgtttaaaacgggtataatatcgttatgtaaagcgcatctagaagataaatatcgttatttatttaaacaagtagcgtcgtcgacgggtttttgtgatcaacgacgactaggtttattattacatgattcgatacaaataccgcgacaattaggtgaagttgcgtcgtttggtggttcgaatatagaaccgtcggttcgttcgtgttttcaatttgcgaataataaaccggaaatagaagcggcgttatttctagattggatgcgactagaaccgcaatcgatggtttggttaccggttttacatcgagttgcggcggcggaaacggcgaaacatcaagcgaaatgtaatatatgtaaagaatgtccgataataggttttcgttatcgttcgctaaaacattttaattatgatatatgtcaatcgtgttttttttcgggtcgagtagcgaaaggtcataaaatgcattatccgatggttgaatattgtacgccgacgacgtcgggtgaagatgtacgagattttgcgaaagtattaaaaaataaatttcgtacgaaacgatattttgcgaaacatccgcgtatgggttatctaccggtacaaacggtactagaaggtgataatatggaaacggatacgatg

SEQ ID NO: 251264 - DNA, 3591 bp, Artificial Sequence
  Description of Artificial Sequence: Synthetic coding sequence
atgctgtggtgggaagaggtggaggactgctacgaacgagaggatgttcagaaaaagactttcaccaagtgggtcaacgcacagttctccaagttcggcaagcaacatatcgaaaaccttttctccgatttgcaagacggccgacgattgctcgacctgctggagggtctgactggtcagaagctgccaaaggagaagggttcgaccagggtccacgccctcaataacgttaacaaggcattgcgcgtcctgcagaacaataatgtggacttggtgaacatcggttctacggacatcgtggacggtaaccacaaattgacccttggactcatctggaacattatcctgcattggcaggtgaagaatgtgatgaagaatatcatggcgggactgcagcaaaccaactccgagaagattcttctgtcctgggtgcgccaaagcaccagaaattacccacaggtcaatgtgatcaactttactacctcgtggtccgacggactcgctttgaatgcccttatccattcccacagaccggacttgttcgactggaactctgtcgtctgccaacagtccgcaactcaacggcttgagcatgcgttcaacattgcccgctaccaactgggtattgagaagctgctggaccccgaggatgtggacaccacttacccagataagaagtccatccttatgtacatcacttcgctgttccaagtgcttccacagcaagtctccatcgaggccattcaggaagtggaaatgcttccacgcccgcctaaagtgaccaaggaagaacacttccagctccatcaccagatgcactattcgcaacaaatcaccgtttcactcgcccaaggctatgagcggacgtcgtcgccgaagcctcgctttaagtcatacgcctacactcaagcggcgtacgtcaccacctccgatccaacccgatctccgttcccgtcccagcacttggaagccccggaagataagagtttcggttcatcactgatggagtctgaagtgaacctggaccgataccaaactgctcttgaagaggtgttgagctggctcctgtcggcggaggatactctccaagcgcagggcgaaatctctaatgacgttgaagtggttaaagaccagttccacacgcatgaagggtacatgatggacctcaccgcccaccaggggcgagtggggaacattctccagctgggatccaaactgatcgggactggaaaactgtcggaggacgaagagactgaagtccaagagcagatgaacctcctcaactccaggtgggaatgcttgcgcgtggccagcatggaaaaacagagcaacctgcatagagtgctgatggacttgcaaaatcagaagctcaaggaactgaacgactggctgaccaagaccgaggagcggactcgcaaaatggaggaggagccgctcggaccggatctggaagatctgaagcggcaggtgcagcagcacaaggtgctgcaggaagatctggaacaggaacaggtccgcgtgaattcactgacccatatggtggtcgtggtggacgaaagctccggagatcacgcaaccgccgcgctggaggaacagcttaaagtgctgggagacagatgggcgaacatctgccgctggactgaggacagatgggtcttgctgcaagatatcctgctcaaatggcagcgactgaccgaagaacagtgtctgttttcagcctggctgtcggagaaggaagatgccgtgaacaagatccatactactggcttcaaagatcaaaatgaaatgctgagctccctgcaaaagctcgcggtgctgaaggcagatctggagaagaagaagcagtcgatgggaaagctgtactcgttgaaacaggatttgctgagtaccctgaaaaacaaatcagtcacccaaaagactgaggcttggcttgataacttcgcgcgctgttgggataacttggtgcagaaactggagaaaagcaccgcacagatctcccaagcagtgaccaccacccagccgtcgctcacccaaactactgtgatggaaaccgtgactacggtaactaccagagaacaaatcctggtgaagcacgcgcaggaggagctgcctccgccgcctcctcaaaagaagaggcagatcaccgtcgacactcttgagcggttgcaggagctgcaggaggccaccgatgagttggatctcaagctcagacaagctgaagtcattaagggctcgtggcaaccagtcggtgatctgctcatcgacagcttgcaggatcacctcgagaaagtcaaggcgctgcgcggcgagatcgcgcctctgaaggaaaacgtgtctcacgtgaatgatctcgctagacaactcaccaccctgggaatccagctctcgccgtacaatctgtccactctcgaggatctgaacactcggtggaaactcctgcaggtcgcggtggaggatcgggtgcgtcaactgcatgaagcccaccgtgatttcggaccggcgtcgcaacacttcctttcaacgtccgtccagggaccctgggaacgcgccatctcgcccaacaaggtcccgtactacatcaatcatgagactcaaacgacttgctgggaccaccctaaaatgactgaactgtaccagtcgctggccgatctgaataatgtgagattttcggcttataggacggccatgaaacttcggcgcctgcagaaggccttgtgcctggatctcctgtcactgtcggcagcgtgcgatgccttggaccaacacaacctgaaacagaatgaccaacctatggacatcctccaaatcatcaactgccttaccaccatctacgatcgcctggaacaggagcacaataatctcgtcaacgtcccgctgtgcgtggatatgtgtctgaactggctccttaacgtgtacgacaccggaagaaccggacggatccgcgtgctcagcttcaaaacgggaatcatctcactgtgcaaagcgcacttggaagataagtaccggtacctcttcaagcaggtggcctcctctaccggattttgtgatcagcgccgcctgggactcctgctccatgactcaattcagatcccaaggcagctgggagaggtggcctcattcggtgggagtaatatcgaaccgtcagtgcgcagctgctttcagttcgccaataacaaacccgagatcgaagctgcgctctttctggactggatgcgcctggagccacagtcaatggtctggctcccggtgcttcatcgcgtggccgcagccgaaacggccaagcaccaggctaagtgcaatatctgcaaagaatgccctatcatcggattcagatacagaagcctgaaacactttaactacgacatctgccaatcgtgtttcttttccggaagagtcgctaagggacacaaaatgcactaccccatggtggagtactgcacgcctacgacttccggggaagatgtccgggacttcgccaaggtccttaagaacaagttcaggaccaagcgctatttcgccaaacacccacgcatgggctacctccccgtgcagaccgtactcgaaggcgacaacatggaaactgacaccatg

SEQ ID NO: 251265 - DNA, 3591 bp, Artificial Sequence
  Description of Artificial Sequence: Synthetic coding sequence
atgctttggtgggaagaagtcgaagactgttatgaaagggaagacgttcagaaaaagactttcacaaaatgggtaaacgcacagttttccaaattcgggaaacaacatattgagaatctctttagcgatcttcaagacggccgccgccttctggacttgctggagggcctgactggtcagaaacttcccaaggagaagggctcaacgcgagtgcatgccttgaataacgtgaataaagcgctacgtgtcctgcagaataataatgtcgacctggtcaacatcggatctactgacatcgttgatggaaaccataaattgacgttagggctgatctggaacattatcctgcactggcaggtgaaaaatgtgatgaaaaatataatggctggtttgcagcagacgaactctgaaaaaatcctgctcagctgggtgcggcagagcactcggaattatccccaggtaaatgtaatcaactttaccacctcctggagcgatggcctggcattgaacgcacttattcatagccatcgacccgacctgtttgattggaattccgtcgtatgccagcagagcgctacacagaggcttgaacatgcttttaatatagcacggtatcagctcggcatagagaagctgctcgacccagaggacgtcgacacaacataccctgacaagaagtcaatcttaatgtacattaccagcctgttccaggtgcttccccagcaggtaagtatcgaggcgattcaagaagttgagatgttgccacgccccccaaaggtgaccaaggaagagcactttcagttgcaccaccagatgcactacagccagcagattacagtgagcctggcacagggctacgaacgcacttcttctcccaagccacgctttaagtcttatgcctatactcaggctgcctacgtcacaacgtccgacccgactaggagcccatttccatcgcagcacctggaagctccggaagataagtccttcggctccagcctgatggaatccgaagtcaacctggatcgctatcagaccgctttagaggaggtcctaagctggttgctgtctgcggaagacaccctccaggcccagggagagattagcaatgacgtcgaggtggtcaaagaccagttccacacacatgaaggctatatgatggatcttactgctcaccaagggagagtgggtaatatcctgcaacttgggtctaaactgatcggcaccggcaaactcagcgaagacgaagagactgaagttcaggaacaaatgaacctgctcaattcccggtgggaatgcctcagagttgcaagcatggagaagcagagcaacttacaccgcgtgctcatggatctgcagaatcagaaactgaaggaactcaacgactggctgacaaagaccgaggaaaggactagaaaaatggaggaggaacccctgggtcccgatctggaggatttgaagaggcaggtgcagcagcataaggtgctgcaggaagacctggaacaggagcaagtacgcgtcaattcactaacacatatggttgtcgtcgtcgatgagtcatcaggggaccacgcaacggccgcgcttgaagaacagcttaaggtgctgggggataggtgggccaacatatgtcgttggacagaggacaggtgggtgctgctgcaggacatcttgctgaagtggcagcgtttgacagaggaacaatgcctgttttccgcttggctttccgagaaagaagacgccgtgaataagatccacacaacaggattcaaggatcagaacgaaatgctgtcttctctccagaaactggcggtgctgaaagcagacttggagaagaaaaaacagtctatgggaaaactctactcccttaaacaggacctactcagcacgctgaaaaataagagcgtcacccagaagaccgaggcatggttggacaatttcgcacgatgctgggacaacctcgtgcagaagctggagaaaagtacagcccagatcagccaggctgttacaaccacacagcccagcttgacgcagaccaccgttatggagaccgtcactacggtgactacacgcgagcagatcctcgtgaaacacgcacaggaagaactgccaccaccacctccccaaaagaagagacagattactgtggacactttggagagactgcaggaactgcaggaggcaacagacgagttagatctgaagctgcgccaggccgaagttataaaaggttcctggcagccagtgggtgatcttttgattgactcgcttcaagaccacctggagaaggtgaaggctttgagaggtgagatagcgcctctgaaggaaaacgtgtctcacgtgaacgacctggctcgacagctcactaccttgggtatccagctgagtccatataacctgagcaccttggaggaccttaatacacggtggaagttgcttcaggttgctgtggaggatagggtgcgccaactgcacgaggctcatcgagattttggtccggcttcacagcactttctcagcacctccgtacagggcccttgggaaagggctatttcacccaataaggtcccctattatatcaatcatgaaacgcagacaacctgttgggatcaccccaagatgacagagctctaccaatcactggcggatctcaacaatgtcagattttccgcctataggaccgccatgaagctgagacgcttacagaaagccttgtgcttggatctgctcagcctgtcggcggcttgcgatgcactggatcagcacaatcttaagcagaatgaccagccaatggacatcctgcagataattaattgtctgacaacaatctatgataggctggaacaggaacacaacaatctcgtcaatgtgcccttgtgcgtcgatatgtgtctgaactggctcctcaatgtgtatgacacaggcaggacagggcgtatccgggtgctgagtttcaaaacaggcatcatttccctgtgtaaggcccacttggaagacaaatacagataccttttcaaacaagtggcgagcagtaccggcttttgtgatcaacggcgactgggtcttctcctgcacgatagcatacagattcctcggcagcttggagaggtcgcgtcctttggcggcagtaacatcgaacctagcgtacgctcttgcttccagttcgctaataacaaacctgagatcgaggccgctctcttcttggattggatgaggttggagccacagtctatggtgtggctgcctgtgctccatcgagtcgctgctgctgaaacggcaaaacaccaggccaagtgcaacatctgtaaggagtgtccaatcataggtttccgctatcgctccctcaaacactttaactatgatatctgccagagctgcttcttctccgggagggttgccaaaggccacaaaatgcactatcccatggttgaatactgcacaccaactacatctggagaagatgttcgggacttcgccaaagttctcaagaacaaattccggaccaagcggtactttgctaaacaccctcggatgggctacctcccggttcagactgttttggagggtgacaacatggagacagataccatg

SEQ ID NO: 251266 - DNA, 3591 bp, Artificial Sequence
  Description of Artificial Sequence: Synthetic coding sequence
atgttgtggtgggaggaggtggaggattgttatgaacgggaggatgtgcaaaagaagacctttaccaaatgggttaatgcccagttctccaagtttgggaaacaacacattgagaacttattctccgaccttcaggatggcaggcgactgctggatctgctggagggcctcaccggccagaagctgccaaaggagaaaggatctacgcgtgtccacgctctaaacaatgtgaataaggccctcagggtgctgcaaaataataatgtggatctggttaacatcggaagcaccgatatcgtggatggaaaccacaagctcacactggggctgatatggaatattattctacactggcaggtgaagaacgttatgaagaacatcatggcggggctacagcagacaaactcagagaagatactgctgtcttgggttcgccagtctactaggaattatccacaggtgaatgtaataaacttcaccacgagttggtcggacgggttggctttgaatgcacttattcatagccacagaccagatttgttcgattggaactctgtggtttgtcagcagtcagcaacgcagagattggagcatgctttcaacattgccaggtatcagctgggcattgaaaagttgctagatcctgaagatgtcgataccacgtatcctgacaagaaaagtatactgatgtacattacctcgctgtttcaggtgttaccacagcaggtctctatcgaggccatccaggaggtggagatgctgcccaggccacctaaagttaccaaggaggagcactttcagctgcaccaccagatgcactactctcagcaaattaccgtatcattagctcagggctatgagaggacatcctcccccaaaccacgctttaaatcatacgcatacacgcaggctgcgtacgtaaccacaagtgatcctacacgatccccctttccctcccagcaccttgaggcccctgaggataaatcctttggcagttccctgatggaaagtgaggttaacctcgatcggtatcagactgctctcgaagaggtcctcagttggctgctctcagcagaggacacgctgcaagcccagggggaaatcagcaatgatgtggaggtggtgaaagaccaatttcatacgcacgagggatatatgatggacttaactgctcaccagggaagagtaggaaacatactccaacttggctcaaagctgataggaacagggaagctcagtgaggacgaggaaacagaagtgcaggaacaaatgaacctcctgaatagccggtgggagtgtttacgagtcgcctcgatggagaagcaaagtaatctgcatcgcgtcttaatggacctccagaatcagaaacttaaggaattgaatgattggctcaccaagacggaagagagaacccggaagatggaagaggagcccctaggtcctgacctggaggacctgaagagacaggtccagcagcacaaagtcctgcaagaggacctggaacaggagcaggtccgagtaaacagcctgacgcatatggtagtggtggttgatgagagttcaggtgaccacgccacagccgccctggaagaacaactgaaggttctgggtgatagatgggctaacatctgtagatggacagaggataggtgggtcttgctgcaggacatcctgctgaagtggcagcgattaaccgaggagcagtgcctgttcagcgcctggctgtccgaaaaggaggacgcagtgaacaagatccacacaaccggattcaaagatcagaacgagatgttgtcgtcgctgcagaagctcgcagttcttaaagcagatttggaaaagaagaagcagtctatgggcaagctttacagcctcaagcaagatttgctgagtactctgaagaataagagcgtgacacagaaaaccgaagcctggctggataatttcgctaggtgttgggataatctcgtgcaaaagttggagaagagcaccgctcagatctcccaagctgtgaccacaacacagccgagtctcactcaaactaccgtgatggagaccgtcactaccgtgacaacacgcgaacagatcctcgtcaagcatgcccaggaagagttgccgccccctcctccccagaagaagcgacagatcacagtcgataccctagagcgcttgcaggagcttcaggaggccacagacgagctcgacttaaagttgaggcaggccgaggttattaagggctcatggcagcccgtgggggatctgctaatcgacagtctccaggaccacctggagaaagtgaaagccttgagaggggagatcgcgcccctgaaagagaatgtttcccacgtgaatgatctggcccggcagctcacaacgctggggatccaactgtccccctataacctttctaccctggaagatttgaatacccgctggaaacttctccaggtggccgtggaagatcgggttaggcagttgcatgaagcccatcgagattttgggcccgccagccagcacttcctatcaaccagtgtgcaaggcccctgggagcgagctatctcccctaacaaggtgccctattatattaatcatgagacgcaaacaacctgttgggaccaccccaagatgacggaactctatcagagtttagcggacctgaataacgtgagattttcagcctaccgtaccgcaatgaagctgagacggctgcagaaagcattgtgcctggatctactgagcttaagcgcagcctgtgatgccctggatcagcacaatctcaaacagaatgatcagccaatggatattctccagatcatcaactgtctcaccactatatacgatcgcctcgagcaggaacataataacctcgttaatgtgcctctgtgcgttgacatgtgtcttaattggctgcttaatgtctacgacacaggccgtaccggtcggattcgcgttttgagttttaaaacaggaattatctccctgtgcaaggcgcacctcgaggacaagtatcgctacctgtttaaacaggtcgcatcttctactgggttctgcgaccaaagaaggctcggcctgctcctccacgattcgatccagattccccgtcagctgggtgaagtggccagctttggcggctctaacatcgagccaagtgtccgcagttgcttccaatttgctaacaacaagcccgaaatcgaggctgcgctgtttctagattggatgaggctagaacctcagtcaatggtgtggttaccagtcctacaccgcgtggcagcagccgagacagccaagcaccaggcaaagtgcaatatatgtaaagagtgcccgataattggctttcgataccgttcactgaagcattttaattatgatatatgccagtcctgttttttttccggacgcgttgccaagggacataagatgcattacccaatggtcgagtattgcacccctacgacatccggggaagatgtgcgagattttgccaaggttctgaaaaacaagtttcggacaaaacgctatttcgccaaacaccctcggatgggctatctaccggttcagaccgtgctggagggagacaacatggagactgataccatg

SEQ ID NO: 251267 - DNA, 3591 bp, Artificial Sequence
  Description of Artificial Sequence: Synthetic coding sequence
atgctctggtgggaagaagtcgaggactgctatgagcgtgaggatgttcagaaaaaaacctttactaagtgggtgaacgcgcagttcagtaaattcggcaaacagcatatcgaaaatttgttctccgacttacaggatggaaggcggctcctagatctgctggagggtctgaccggacagaaactgccaaaagaaaagggctcaaccagagtgcatgccctgaataacgtgaataaagccttgcgcgtgctgcaaaataacaacgtggatctggttaacatcggctcaaccgacatcgtggacggcaaccataaactcaccctgggactgatatggaacatcatacttcactggcaggtgaaaaacgtgatgaagaatatcatggccggtctgcagcagacaaattcagagaagatccttctctcctgggtcaggcagtctacccggaactatccccaggtgaatgtgattaattttactacaagttggagtgacggactcgccctgaacgctctcattcactctcacaggcccgacctctttgactggaattccgttgtctgccagcagtcagccacccagagactggagcacgctttcaatattgccaggtatcagctgggcatcgaaaagctgctggaccccgaggatgtggacactacttatccagataagaagtcgattttgatgtatatcacaagtctcttccaggtcttgccgcagcaggtctctatcgaagccatccaggaagtcgaaatgctcccaagaccacctaaggtcactaaagaggaacactttcagctccatcatcagatgcactacagccagcagatcaccgtgagtcttgcccaggggtacgagagaacgagtagccctaagcctagatttaagagttacgcctatacccaggctgcttacgtcaccactagtgacccaacgcggtctccgttcccaagccagcacctggaggctcccgaagataaatctttcgggtccagcttgatggagtccgaggtcaatttagatcggtatcagaccgcacttgaggaagtgctttcatggcttctgtccgcagaagatacgctgcaggcacagggggagatcagtaatgatgtcgaggtagtaaaagatcagttccatacacacgaaggctatatgatggacttgactgctcatcaaggaagggtgggaaacattctgcagctcgggtcaaaactgatcggcactggaaagctgtccgaagacgaggagaccgaggttcaggaacagatgaacctgctgaactcgcgttgggagtgtttgcgagtcgccagtatggaaaagcagagcaacttgcatcgggtcttgatggatctgcaaaatcaaaaattgaaagagctgaacgattggctcaccaagaccgaagagagaactcgcaaaatggaggaagagccacttggcccagaccttgaggatctgaagcgacaagttcagcagcataaagtactccaagaagacctggagcaggagcaggtgcgagtaaatagcctgactcatatggtggtggtggttgacgagagctccggagaccacgccactgccgctctggaagagcagctgaaagtcctcggcgaccgctgggcaaatatttgccgctggactgaggaccgatgggtactgctccaggatatcctattgaagtggcagcggctgaccgaggaacaatgtttgttttctgcgtggctgtccgaaaaggaggatgctgtaaataagatccacacaaccggatttaaagaccaaaacgaaatgctgtcctctctgcagaaactcgcggtcctgaaagcagatctggagaagaaaaagcagtcgatggggaaattatactctctcaagcaggatctgctcagcaccctgaaaaacaagagtgttacgcagaagacagaggcgtggctggacaatttcgccagatgctgggacaatctcgtgcaaaagttagaaaagagtacagcccagattagccaggctgtgacgaccacccagcccagtctcacccaaaccacagtgatggagactgttacaaccgtgacaactcgtgaacagatactagtaaagcatgcccaagaggaactgccaccgccacctccacagaagaagaggcaaatcactgtggacactttagaaagactgcaggaactgcaagaggctaccgacgagctggatctgaaactgaggcaggctgaagttatcaaagggtcttggcagccagtgggggatctgcttattgacagcctccaggaccatctagaaaaagttaaggctctgaggggcgagatcgcacctctgaaggagaatgtgtctcacgtcaatgacctggcgcggcagttaaccacactgggtatccagctctccccgtataatctctccacactagaggacttgaacactcggtggaagctgctccaggttgccgttgaggacagggttcgacaactgcacgaggcgcatagagacttcgggcccgcttcacagcatttcctcagcaccagcgtccaaggcccatgggaaagggccatcagccccaataaggtaccctattacatcaaccatgagacgcagaccacctgctgggatcatcctaaaatgacggaactataccaatctcttgccgacctaaataatgttcgattcagcgcctataggacagcgatgaaacttaggcgcctgcagaaggccttgtgtctggatttgctaagtctgtccgccgcctgtgacgcgctcgaccaacacaatctgaagcagaacgaccagcccatggacattcttcaaatcatcaactgtctaactaccatatacgatcgcctcgagcaagaacataacaaccttgtgaatgtgcccctgtgcgttgacatgtgcttgaactggctgttgaatgtatacgacacaggacggacgggacgcatccgcgtgcttagcttcaagaccgggattattagtctttgcaaagcccacctcgaggataagtataggtatctattcaagcaagtggcctcttcaacagggttttgcgatcagcggaggttgggccttctgttgcatgattctatccagatcccacgtcagttgggtgaagtagctagttttggcggaagtaatattgagccaagcgtgcgcagttgcttccagttcgccaataacaaacccgaaatagaggccgcgctcttcttagattggatgagactagagccacagtcgatggtgtggctgccagtcctgcacagggtggctgcagcggagactgctaaacaccaggctaagtgtaatatctgtaaagagtgtcccataataggctttaggtataggtcactgaagcacttcaattatgatatctgtcagtcatgctttttcagcggccgagtggcaaaggggcataagatgcactatcccatggtcgaatactgcacccccacaacttctggtgaggatgttcgggacttcgccaaagtgttaaagaataagttccgcaccaaacggtattttgccaagcatccgcgaatggggtacctgcccgtgcagactgtccttgaaggagacaacatggagacggacaccatg

SEQ ID NO: 251268 - DNA, 3591 bp, Artificial Sequence
  Description of Artificial Sequence: Synthetic coding sequence
atgctgtggtgggaagaggttgaggattgctatgagagggaagacgttcaaaaaaaaacctttaccaaatgggtgaacgcccaattctccaagttcggtaagcagcatatcgagaacctgttctctgatttgcaggacggccgtcggcttctggatctgcttgaggggctcacgggacagaaactgcctaaggagaagggaagcaccagagtccacgcgctgaacaacgtgaataaggccttgagagttctgcagaacaataacgttgatttggttaacattgggtcaactgatatagttgacgggaaccacaagttaacccttggcctgatatggaatataatactgcattggcaggtgaagaacgtgatgaagaatataatggcaggcctgcagcagacaaactccgagaagattctcctctcctgggtgcgccagagcacacgtaattacccccaggtgaacgtcattaacttcacaacctcctggtccgatggcttggcacttaatgccttgatacattcccatcggccggatctctttgactggaacagtgtggtgtgtcaacagagtgctacacagcgacttgagcacgcttttaacatagctagatatcagctagggatcgagaaactgctggatcccgaggatgtggatacgacctaccccgacaaaaagtccatcctcatgtacatcacttccttgtttcaggtgctgcctcaacaggtcagcatcgaggcaatccaggaagtggaaatgcttcccagacctcctaaggtgacgaaagaggagcacttccagctgcatcatcagatgcactactcacagcaaattacagtgtccctggcgcagggctacgaacgcacttcctctccaaagccaaggtttaagagttatgcttacactcaagctgcttacgtaacaacctccgacccaacccggtcgccttttcctagccaacacctggaggctcccgaggataaatcttttggctccagtctcatggagtccgaggtgaatctcgatcgctatcagacggcgctggaggaggtcctcagctggttgctgagtgctgaggataccctccaggcacagggtgaaatttccaacgacgtcgaagtggtcaaggatcagtttcatacacacgaagggtacatgatggatctgacagctcaccagggacgtgttgggaatatcctgcagttgggtagtaagctcatcggcacgggaaagctttccgaagatgaggagaccgaggtgcaggagcagatgaaccttctgaattctaggtgggagtgcctaagagtggcttcaatggaaaaacagagcaacctgcaccgggtgttgatggacctccagaatcaaaaacttaaggagttaaacgactggctgactaaaactgaggagagaacacgcaagatggaagaagagcccctaggacccgacctggaagacttgaagcgtcaagtgcagcagcacaaggtccttcaggaggacctcgaacaggagcaggtaagagttaactccctcacacatatggtggttgtggtagacgagagcagcggggaccacgcaaccgcagcccttgaggagcaactcaaagttctgggggaccggtgggcaaacatctgcaggtggacagaggatcggtgggtcttgctccaggacattctgctcaagtggcagcggttgaccgaagagcaatgtctcttttctgcatggttgagcgagaaagaagacgcggtgaacaagatacatacaaccgggttcaaagaccagaacgaaatgctgtcctcactacagaagttggccgtgctcaaggcggacttggaaaaaaaaaagcagagtatgggcaaattgtattcactcaagcaggatctcctgtccactctgaaaaacaaatcagttactcaaaagacagaggcttggctcgacaattttgctcgctgctgggataatctcgtgcagaagttagagaaaagtaccgcccagatatcgcaggccgttaccactacacagccctccttaacccagacaaccgtgatggagactgtgacgactgtgaccactagggaacaaattcttgtcaaacacgctcaggaagagttgccacccccaccaccacagaagaagcgacaaatcaccgtagatacgcttgaaagactgcaggagttacaggaggccaccgacgagctagaccttaagctcaggcaagcggaggtaatcaaaggaagctggcaacctgtgggggatcttctaatagacagcctgcaggatcacctggagaaggtgaaagcgcttaggggcgagattgcacctctcaaggagaacgtctcacatgtcaacgaccttgcacgtcagctaacaacgctgggcatacaactgagtccctataatctctcgacactggaggacctcaataccagatggaaactactacaggttgccgttgaagacagagtccggcagcttcatgaggcccatcgagatttcgggcccgcttcgcagcactttttgtcgacttcagtgcaaggcccctgggagagggccattagcccaaacaaggtgccgtactatataaatcatgagacacaaacaacctgctgggaccatccgaaaatgacagagttgtatcagtctttggcagatctgaataacgtcaggttctcagcatacagaaccgccatgaagttgcgcaggttgcagaaagccttgtgccttgacctcctgtctctgagcgctgcatgtgacgccctcgaccaacataacctaaaacaaaacgaccaacccatggacatccttcagatcataaattgcctgacaacgatctacgatagattggaacaggaacataacaatttagtaaacgtccctttatgtgtggacatgtgtcttaattggctgttaaatgtctatgatactggtaggacgggccggattagggttctctcatttaagacagggatcatctctctgtgcaaagcccacttagaagataagtacagatatctgtttaaacaggtggcctcgtctacggggttctgcgaccagcgcagattgggactcctgctacatgacagcattcagattccgaggcaactcggggaggtcgcatcatttggaggctctaatatcgagccctctgtgcgatcctgcttccagtttgcaaacaataaaccggaaatcgaggctgcactgttcctggactggatgcgactggaaccccaatcaatggtctggctccctgttctgcacagagtcgcggctgccgaaacagctaagcaccaggccaagtgcaatatttgtaaagaatgtccaatcattggtttccgatatagatcgttaaagcattttaactacgacatttgtcagtcttgtttcttctcaggccgggtggctaagggccataaaatgcattatccaatggtggaatattgtacaccaactacaagcggcgaagatgtgagggatttcgccaaggtccttaagaacaagtttcggaccaagcgatatttcgctaagcatccacggatggggtatctacccgtccagaccgtgttagaaggtgacaatatggaaactgataccatg

SEQ ID NO: 251269 - DNA, 3591 bp, Artificial Sequence
  Description of Artificial Sequence: Synthetic coding sequence
atgctgtggtgggaggaagtcgaggactgttacgagagagaggacgtccagaagaaaacttttaccaaatgggtgaacgctcagttctcgaaattcggcaagcaacacatcgagaacctcttttccgatctgcaagacggtcgcagattgctggacctgttggagggactgaccggccaaaagctgccgaaggagaagggttcgactcgagtgcacgccctgaataacgtgaacaaggcacttcgggtccttcagaacaacaacgtggatctggtgaatatcgggtcgaccgacattgtcgacggaaaccacaaattgacccttggactcatctggaacatcatcttgcactggcaggtgaagaacgtcatgaagaatatcatggcaggactgcagcaaactaactccgagaagatcctgctgtcttgggtccgccagagcactcgcaattacccacaagtcaatgtgatcaatttcactacttcttggtcagacggcctcgcgctcaatgctcttattcatagccataggccggacctcttcgactggaactcagtggtctgccagcaatccgccactcagcggctcgaacacgcgttcaacatcgcacgttaccagctgggcattgaaaagctcttggatccagaagatgtggacactacctaccctgacaagaaatcgatcctgatgtatatcacgagcctgttccaggtgctgcctcagcaagtgtccatcgaagcgattcaggaagtggaaatgctcccacggccaccgaaggttaccaaagaagaacacttccagctccatcaccagatgcactattcgcagcagatcaccgtttcgctggcacagggttacgagagaactagctcgccaaagcctcggttcaagagctacgcctacactcaagccgcttacgtgaccacctccgatcccacccgatccccattcccgtcgcagcacctcgaagcaccagaggataagtcattcgggagcagcttgatggaatccgaggttaacctggacagatatcagactgccttggaagaggtcctgtcatggctgttgtcggcggaggacacgctccaagcccagggagagatctcgaatgatgttgaggtggtcaaggatcagtttcacacccatgagggatacatgatggacctgaccgctcatcaaggtagggtgggaaacatcctccagctggggtcgaaactgatcggcactggcaaattgtcggaagatgaggagactgaagtgcaggagcagatgaatctgctcaattcacgctgggagtgcctccgcgtggcgtcaatggaaaagcaatccaacctccatcgcgtgctgatggacttgcagaaccagaagctcaaagagttgaacgactggcttacgaaaaccgaagaaagaaccaggaagatggaggaagagcctctggggccggatctggaagatctgaagcggcaagtccagcaacataaagtgctccaggaagatctggaacaagaacaggtgagagtgaattcgttgacccatatggttgttgtggtggatgagagctcgggagatcacgccaccgcggcccttgaggagcagctcaaggtgctgggggaccgttgggccaatatctgcagatggacggaggatcgctgggtgctgctgcaggacatcctcttgaagtggcagagactgactgaagagcaatgccttttctccgcctggctctcggagaaggaggacgcggtgaacaaaatccacacgactgggttcaaagatcaaaacgagatgctgtctagcctccagaagttggcagtgctgaaggccgatttggagaaaaagaagcaatctatgggaaagctgtacagcctgaagcaagacctgctgtccactctgaagaataagtcagtgactcaaaagaccgaagcgtggctggacaatttcgcgcggtgctgggacaatcttgtccagaagctggaaaaatccaccgcgcaaatatcgcaggccgtcactaccactcaaccttctctcactcaaaccaccgtgatggaaactgtcaccactgtgactaccagagaacagatcctggtgaagcacgctcaagaagagctgccacccccgccgcctcaaaagaaacgccaaatcactgtggacactctggaaagactccaagaacttcaagaggccactgatgaactcgacctgaagttgaggcaggcagaagtgattaagggatcgtggcagccggtcggcgatctgctgattgactccttgcaagatcatctggagaaggtcaaggcgctgaggggagaaatcgcccctctgaaggaaaatgtctcgcacgtgaacgacctcgcccggcagctgaccacgctgggaattcagctctccccgtacaacctgtcaacccttgaagatttgaacacgcgctggaaactgctccaggtcgctgtggaagatagggtccgccaattgcacgaagcgcaccgggattttggacctgcctcccagcacttcctgagcacttccgtgcagggcccgtgggagagggccatctccccgaataaggtgccgtactacattaatcacgaaacccagactacgtgctgggatcaccccaagatgacggagctgtaccagtccctggcggatctgaacaacgtgcgcttctcggcctaccgcacggcgatgaaactccgacgccttcagaaggcgctgtgcctcgatctcctgtctcttagcgccgcgtgcgatgctctggaccagcacaacctgaagcagaacgaccaaccgatggacatactgcagatcatcaactgcctcactactatctacgacagactggagcaggagcacaacaatcttgttaatgtgcctctctgcgtggacatgtgcctcaattggctgctcaatgtttacgataccggtcgcactggacggatccgggtgctgagctttaagaccggaatcatctccctgtgcaaagcgcatctggaggataagtatcgctacctgttcaagcaggtcgcatcctccaccggcttctgtgaccaacggagactgggactgctcctgcatgactccattcagatccctcgacagctgggagaagtcgctagctttgggggcagcaacatcgaaccgtcggtgcggtcctgttttcaattcgcaaacaataagccagaaatcgaagcagccttgtttctggattggatgcgcctcgagccgcagtcaatggtctggctccccgttcttcatagggtcgccgccgccgaaaccgcgaagcatcaagcgaaatgcaacatctgtaaggaatgtcccatcattggtttccgctacagaagcctgaaacactttaactatgacatttgccaatcatgcttcttctctggcagagtcgcaaagggtcacaaaatgcattacccgatggtcgaatactgtactccgacgacctcgggagaagatgtgcgcgacttcgctaaggtcctcaaaaacaagtttcgaaccaaacgctacttcgccaagcatcctcgcatggggtacctgcctgtgcaaaccgtgctggaaggggataacatggaaaccgacacgatg

SEQ ID NO: 251270 - DNA, 3591 bp, Artificial Sequence
  Description of Artificial Sequence: Synthetic coding sequence
atgctttggtgggaagaggtcgaggactgctacgagcgggaagatgtgcagaaaaaaacttttactaagtgggtgaatgctcagtttagtaagttcgggaagcaacacattgaaaaccttttctcggatcttcaggatggccggcgcctgctggacctactggaggggctgacaggccagaagctgcctaaggagaaagggtccacacgcgtgcacgcactaaacaatgtaaacaaggctctgagggttctgcagaataataacgtggacttggtaaacattggtagcaccgacatcgttgatggcaaccacaaactgacactgggcctcatctggaacatcatcctgcactggcaggtgaagaacgtgatgaagaatataatggctggcctgcaacaaacgaactctgagaaaattttgttgtcctgggtgcgtcagagcacgaggaactatcctcaggtgaatgtgataaatttcacaaccagctggagtgatgggctagctctgaacgccctgattcactcccaccggccagatctgtttgattggaattcagtcgtctgccaacagagcgcaactcaacgtcttgaacacgccttcaatatagccaggtaccagctcggcatcgagaaactccttgaccccgaagatgtggacacgacgtatccagataagaagtctatcctgatgtatatcacttcccttttccaagtgctcccccagcaggtaagcattgaggccattcaggaggtcgagatgctgccaaggccaccaaaggtaacaaaggaggaacactttcagctgcatcaccagatgcattattcccaacaaatcacggtaagcctggctcagggttacgagcgcacttcgtcccctaagcctagatttaagtcctacgcttacacacaagcggcctacgtgaccacttctgatccaacaaggtcaccctttccttcccagcatctagaggcgcctgaggacaagtccttcggctcgagtcttatggagtcagaagttaacctcgaccggtaccaaactgccttggaggaggtgctatcctggcttctcagtgcggaagatactctacaggcccagggcgaaatatccaatgacgtggaggtggtgaaggatcaatttcacacccacgagggctatatgatggatctgaccgcccatcaggggcgggtgggcaatattctgcagctagggtctaagctaatcgggacgggaaaactctcagaagacgaagaaacggaagtgcaggaacaaatgaacctgcttaatagcagatgggaatgtcttagggtagcctcaatggagaagcagagtaatctgcaccgcgttctcatggacctccagaatcagaagttgaaggagctgaatgattggcttacgaaaaccgaggagcggaccaggaaaatggaagaggagcccctcggcccggacctggaggatctgaaacgtcaggtgcaacagcacaaggtcctgcaggaggacttagaacaggagcaggttcgcgtgaacagcttaactcatatggttgtggtggtagatgaaagctccggagaccacgccaccgccgccctggaagaacagctcaaggtgctcggggaccgatgggccaatatctgtcgttggacggaggaccgctgggtcctgcttcaggatatcctgcttaagtggcagcggctcacagaggagcagtgccttttttctgcttggttatcggaaaaagaagatgccgtgaacaagatacataccactggcttcaaggaccagaacgagatgctctcatcattacaaaagctggcggtactgaaggctgaccttgaaaagaagaagcaaagtatgggtaaactttatagtcttaagcaggaccttctttctacactcaagaacaaaagcgtcacccagaagacagaggcatggttggacaattttgcgcggtgttgggacaaccttgtgcagaagctggagaagtctaccgcccaaatttcccaggccgtgacgaccactcagccctctttaacccagactacagttatggaaactgtaacgactgtcacaacccgagagcagattttggttaagcacgcacaggaggaactgcctccgccgccgcctcaaaaaaaaaggcagatcacagtagacactctcgaaaggctgcaggagttacaagaagccaccgatgagctggaccttaaactgagacaagctgaagtgatcaaggggtcttggcagcccgttggggatttgctgattgattcgttgcaggaccacttggagaaggtgaaggccttaaggggggaaatcgctccactgaaagaaaacgtctcccacgtgaacgaccttgctcgacaactgacaactcttggaattcagctctcaccttacaaccttagcacactcgaagacctcaacactcggtggaaattgctgcaggttgccgtcgaggatcgggtgagacagcttcacgaggcccaccgcgacttcggacccgctagtcagcactttctgtctacatccgttcagggaccatgggaacgggccatctctcccaacaaagtcccctactatataaatcacgaaacgcagacaacatgctgggatcaccctaagatgaccgagttgtatcaatcactggcagaccttaacaatgttcggttttctgcttacaggaccgccatgaaattaaggcgactccagaaggccctctgtctcgacctgctgtctctttctgctgcctgcgacgcactggatcagcacaatctgaaacagaacgaccagcctatggacatcctgcagattattaactgcctgactacaatctacgaccgattagaacaggagcacaacaacctggtgaacgtgccactgtgtgtcgacatgtgcctgaactggctgctcaacgtctacgacacaggccgaactggaagaatcagagtcctctcattcaaaacgggaatcatcagcctgtgcaaggctcatctggaggacaaatatcggtacctgtttaagcaagtggcctctagtactggattttgcgaccaaagacggctggggctcttacttcacgactccatacaaatcccacgccagctgggagaggttgcgagcttcggcggtagcaacatcgaaccaagcgttcgcagctgctttcagtttgcaaataataagccagaaattgaggcggcgttattcctggattggatgcgccttgaacctcagtccatggtgtggctgcctgtgcttcaccgcgttgccgcagcagagacagccaaacaccaggctaaatgtaacatctgcaaagaatgtcccatcattgggttccgctatcggtcactgaaacacttcaactacgatatctgccagagctgcttcttttccggccgcgtagccaaaggacacaaaatgcactatccaatggtggaatattgcacgcccacaacctctggggaggatgtaagagattttgcgaaggtgctcaagaacaagtttaggactaaaaggtatttcgcgaagcatccacggatgggctacctgccggtacaaacagttctagagggggacaatatggagaccgacacaatg

SEQ ID NO: 251271 - DNA, 3591 bp, Artificial Sequence
  Description of Artificial Sequence: Synthetic coding sequence
atgctgtggtgggaggaggtggaggattgctacgaaagggaggacgtccagaaaaagactttcacgaagtgggtgaacgcccaattttcgaaatttggtaaacaacatatcgaaaacttgttttcggacctccaggacggcagacggctgctggaccttcttgaaggactgactggacagaaactcccaaaggaaaagggatcgactcgcgtccacgcgctcaataacgtgaataaggccctgcgcgtgctgcaaaacaacaacgtcgacctggtgaacatcggctccaccgacatcgtcgatggaaaccacaagctgaccctcggactgatctggaatatcatcctgcattggcaggtgaagaacgtgatgaaaaacattatggctggactccagcagactaattcagagaaaattctcctctcatgggtgcggcaaagcacccggaattacccgcaggtcaacgtgatcaacttcactacctcgtggtcagacggactggccctgaacgcacttatccactcccacaggcctgacctgttcgactggaactcagtggtctgccagcaatcagccacccagagactcgaacatgcgtttaacatcgcacggtaccagctggggatcgaaaagctgctggacccagaggacgtggataccacctaccctgacaaaaagtccatcctgatgtacattaccagcctgttccaggtgctcccgcaacaggtgtctatcgaggccattcaggaagtcgaaatgcttcctagaccaccgaaggtgacgaaagaggagcacttccaactgcaccatcagatgcattactcgcaacaaattaccgtgagcctggctcaaggatacgaaaggacctcctcccccaaaccgcggttcaagtcctacgcctatactcaggctgcatacgtgaccacctcagatccgacgcgctccccgttcccgtcacagcatctggaagcaccggaggataagtcattcggatctagcctgatggagtcggaggtcaatttggatcggtaccaaacggccctggaagaggtgctgtcgtggctcctgtcggccgaggatactcttcaggcgcagggcgagatctccaacgacgtagaagtggtcaaggaccagttccacacccacgagggatacatgatggacctgacggctcatcagggccgagtcggaaatatcctgcaactggggtcgaaacttattggtaccggaaaactgtcggaagatgaagagactgaagttcaggagcagatgaatctccttaattcgaggtgggagtgtctgcgcgtggcctcaatggagaagcaaagcaatttgcatagggtgttgatggatctgcaaaaccagaagctgaaggaactgaacgactggctgaccaaaactgaggaacggacccgaaagatggaggaggagccgctcggaccggacctggaagatctcaagcggcaggtgcaacagcacaaagtcctccaggaggatctggaacaagaacaagtgcgcgtcaacagcctgacccatatggtggtggtcgtggatgaatcatccggcgaccatgccaccgcagccctggaagaacaactgaaggtcctgggcgatagatgggcgaatatctgtcgctggaccgaggaccggtgggttcttctgcaagacatcctcctgaaatggcagcgcctgaccgaagaacagtgcctgttttccgcctggctgagcgagaaggaagatgctgtcaacaagatccacactaccggtttcaaagatcagaacgagatgctgtcgtcactgcaaaagctcgcggtcctgaaggctgatctggagaaaaagaagcaatcgatgggtaaactttacagtctcaagcaggatctgctcagcaccctgaagaataagtccgtgactcaaaagaccgaggcctggctggacaatttcgctcggtgttgggacaacctggttcaaaagctcgaaaagtcgaccgctcaaatctcacaggccgtcactaccacccaacctagcctgactcagaccacggtcatggaaaccgtcactaccgtgactaccagggaacagattctcgtgaagcacgcccaggaggaactgcccccgccgccaccgcaaaagaaacggcaaatcaccgtggacactctggagcgcctgcaggagctgcaggaagctacggatgaactggacctgaagctgcgccaggcggaagtgattaaaggctcgtggcagccagtcggagatctgctgatcgactcactccaagaccacctggagaaggtgaaggctctgcgcggcgagatcgctccgctgaaggaaaacgtctcacatgtgaatgatcttgcacggcagttgactaccttgggaatccagctttccccctacaatctcagcacgcttgaagatctcaatacgcgctggaagctgctccaggtggccgttgaggatcgggtgagacagctccatgaagcgcatagggattttgggcctgcctcgcagcacttcctgtccacctccgtccagggaccgtgggagcgggccatctcacctaacaaagtgccgtactatatcaatcacgagactcagactacctgctgggatcaccccaagatgactgaactgtaccaaagccttgccgacctcaacaacgtccggttttctgcgtaccgcactgctatgaaactgaggaggttgcaaaaggccctttgcctggatttgctgtccctctcggccgcatgcgatgctctggaccagcacaacctcaagcagaacgaccaaccaatggatattctgcaaatcatcaattgcctgactacgatctatgatcgcctggaacaggaacacaacaacttggtaaacgtgcctttgtgcgtggacatgtgtctgaattggctgctgaatgtgtacgatacgggacgcactggaaggatcagggtcctgtcgttcaagaccggcatcatctccctgtgcaaggctcacctcgaggacaagtatcgctacttgttcaagcaggtggcaagctctaccggcttctgcgatcagagacgcctcggcttgttgctgcacgactcaattcaaatcccgcgccagctcggagaggtggcgagtttcggcggctcaaatatcgagccatccgtgcggtcctgcttccaattcgctaataacaagcctgagatcgaagccgcgctgttccttgattggatgcggctcgagcctcagtctatggtgtggctgcctgtgttgcatcgggtcgcggccgcagagactgccaagcatcaagcaaagtgtaacatatgcaaggagtgcccgatcataggatttcgctacagatcattgaagcactttaactacgacatctgtcagtcctgctttttcagcggccgggtggctaagggacataagatgcactacccaatggtggagtactgcactcctaccactagcggagaggacgtccgcgactttgccaaggtgctcaagaacaagttcaggactaagcggtacttcgcaaagcatccgaggatgggatacctcccagtgcagactgtcctggagggcgataacatggaaaccgacacgatg

SEQ ID NO: 251272 - DNA, 3591 bp, Artificial Sequence
  Description of Artificial Sequence: Synthetic coding sequence
atgctgtggtgggaagaagtggaagactgttacgaacgtgaagacgtgcagaagaaaacatttaccaagtgggtgaacgcacagtttagcaaatttggtaaacagcatatagagaacctattcagtgatctacaggatggccgaaggctgctggatctgctggagggactgactgggcagaagctgcccaaagagaagggctctactagagtacacgctctgaacaacgtcaacaaggctctgcgtgtgcttcagaataacaatgttgatctggtgaacatcggaagcacggacatagtggatgggaatcataaactgaccctgggcctcatctggaacatcattctgcattggcaggtgaaaaatgttatgaagaacatcatggcagggctccagcaaacaaacagcgaaaaaatcctgctctcctgggtgcggcagtccactagaaactatccccaggtaaacgttatcaacttcacaacttcctggtccgatggcctcgccttgaacgccctcattcactctcacaggcctgatctgttcgattggaatagtgtagtttgtcaacagtctgccacccagcgtctggaacacgcattcaacatcgccaggtatcagttggggattgagaagctgttagatcctgaggacgtggacacaacctaccctgacaaaaagagcatcctcatgtatatcaccagtttgttccaggtcctgcctcagcaggtaagcatcgaagcgatccaggaagtggaaatgctgccccgaccacccaaggtgaccaaggaggagcatttccagctgcaccatcagatgcattactcgcagcagattacagtgagtctggcccagggctacgaacggacttcatctccaaagcctagatttaaaagctacgcctacacgcaagcagcctacgttaccacttcagatcctacccgatcccctttccctagtcagcacctcgaggcgcccgaggacaagagctttggcagcagccttatggaaagcgaggtgaatttggaccgctaccagacagccctggaagaagtgttgtcctggttgttgtccgcagaggatacactgcaggcccagggagaaatttccaatgatgtggaggtcgtaaaagatcagtttcacacacacgagggctatatgatggacttgaccgcccaccaggggcgcgtgggcaacatcctacagctgggctccaagttaatagggacgggcaaactgagcgaagacgaagaaacagaagtgcaggagcagatgaatctgctcaattccaggtgggaatgcctcagggtagcttctatggaaaagcaaagcaatctccatcgtgtactaatggatcttcagaaccaaaaactcaaagaactcaacgactggctcactaaaactgaggaacgcactagaaaaatggaagaagagcctttgggcccagacctagaggacctgaaacgccaggtgcagcagcataaagtcctccaagaggatcttgagcaggagcaagtccgggtgaactccttaacccacatggttgttgtggtcgatgaatccagcggtgatcatgctaccgccgccctggaagaacagctgaaggtcttgggggatcgctgggcgaatatatgcagatggacagaagaccggtgggtcctcctccaagatatactgctcaagtggcagcgactcacagaagagcagtgtctcttctcagcttggctttccgagaaggaggatgccgtaaataaaatccacaccactggttttaaagaccagaatgaaatgttatcttcactgcagaaactagctgttctaaaagccgatctggaaaagaagaagcaatccatggggaagctgtatagtctcaaacaggatctgctgtcaacactgaaaaataagagcgtcacccagaagacggaggcgtggctagataatttcgcaaggtgctgggataacctggtccagaagctggagaaatctacagcccagatttcgcaggctgtcaccacaacacagccatctctcacccaaacgactgttatggagaccgtgactactgtgacaactcgggagcagatcctggtgaaacatgcccaggaggagctgccacctcctcccccccagaagaaacggcagatcacagttgacacacttgagagactgcaagagttacaggaggcaacggatgagctggacctgaagctgcgacaggccgaggtgatcaaaggttcttggcagccagtcggggacttactaatcgatagcctgcaagaccacctagagaaggtcaaggcgctccgtggcgagatagcaccgttgaaagaaaacgttagccacgtgaacgatttagcgaggcaattgacgaccctgggtattcagctatccccctataacctttctacactcgaagatctaaacacccgctggaagttgttgcaggttgctgtggaggatcgggtgcgccagctgcacgaggcgcaccgcgattttgggcctgctagtcagcacttcttgagcacgagcgttcagggaccttgggagcgggctatctcaccaaataaagtgccttattacattaatcacgagacgcaaacaacctgctgggatcacccaaagatgacagagttgtatcaaagcctggctgacctgaacaatgtccgcttctccgcctatagaaccgccatgaagctacgcagactgcagaaagccctgtgtttagacctgctgtcactgtctgctgcttgcgacgccctggatcagcacaacctgaaacagaacgatcaacctatggatattctgcagattatcaactgccttactacaatctacgacaggttggagcaggagcacaacaacttggtgaatgtgccactctgtgtggacatgtgtctaaattggcttttgaatgtttatgataccgggcggaccggccgcatccgagtgctgtctttcaagacaggcatcatttccctctgtaaggcccacctagaagataaatatcggtacctctttaagcaagtggcttcttccactggtttttgtgatcagagacggctgggcctgttgctgcatgactcaatccagattcccagacagttaggagaggtggcctcctttggcggtagtaatattgaaccatctgtgcgatcctgtttccagttcgccaacaacaaacccgaaatagaagctgctctgtttctggactggatgagactggaaccccagtccatggtctggctccctgtgttgcatagggtggcagctgcggaaactgctaagcaccaggcaaagtgcaatatctgtaaagagtgtcctatcatcgggttcaggtaccgctccctcaagcactttaactacgatatctgccagagttgctttttcagcggccgagtggcgaagggccacaaaatgcattaccccatggtggaatattgcacacctacaacatccggggaagatgtgcgggacttcgctaaagtgctcaagaacaaattcaggactaagcgctatttcgctaagcaccccaggatggggtatctacctgtgcagacagttcttgagggcgacaacatggaaaccgatactatg

SEQ ID NO: 251273 - DNA, 3591 bp, Artificial Sequence
  Description of Artificial Sequence: Synthetic coding sequence
atgctgtggtgggaggaggtcgaggattgctatgaacgtgaagacgttcagaaaaaaacttttacgaagtgggtgaacgctcagtttagtaagtttggcaagcagcatatagagaacctctttagcgacctgcaggatggccggaggctgctggacttgctcgagggcctcactgggcaaaagctccccaaggagaaagggtctaccagggtgcatgcgctgaacaatgtcaacaaggcccttcgcgtgctccagaataacaacgtggatctggtgaatatcggctctactgacatagtcgacggaaatcacaagcttaccctgggcctaatttggaacattattctccactggcaggtaaagaacgtcatgaaaaacatcatggccggattgcaacaaactaatagcgagaagatacttctgtcttgggtgcgtcagtcaaccaggaactacccccaggtcaatgtcattaatttcacgacctcgtggagcgacggcttggccttgaatgcactgatccattctcatcgacccgatctgttcgattggaacagtgtggtgtgtcagcagagtgccacccagaggctagaacacgcattcaatatcgcccgctatcagctgggcatcgagaagctgctcgatcccgaggatgttgacacgacgtatccagacaaaaagagcattctcatgtacatcacatcactgtttcaagtcctcccacagcaagtttctattgaggctatccaggaggttgagatgctgccccgaccacccaaagtgaccaaggaggagcattttcaactccaccaccagatgcattattcccagcaaataaccgtttcactagcccaggggtacgagcgtacgagttctcctaagcctagattcaagagctatgcatacactcaggctgcctatgtcacaacttccgatcctacacggagcccttttcctagccagcacctggaggcccctgaggataagtccttcgggtcaagtttgatggaatctgaagttaacctggatagatatcaaaccgccttagaagaagtactttcttggctgctatcggccgaggacactctccaggcccagggcgaaatctctaacgacgtcgaagtggtcaaggaccaatttcacacgcacgagggatacatgatggatcttacagctcaccagggccgcgtgggtaatattctgcagttaggttctaagttgatcggcactgggaaactttctgaggacgaagaaacagaagtgcaggaacagatgaacctcctcaattccagatgggaatgtctacgcgtggcaagcatggaaaaacagtccaacctacaccgcgtcctgatggacttgcagaatcagaagctcaaagaactgaatgactggctcaccaaaaccgaggaaagaactcgcaaaatggaggaggaaccccttggacccgatctagaggacctcaaaagacaggttcagcagcacaaggttcttcaagaggacctcgagcaggagcaagtgagagtgaatagcttgacccacatggtggtcgttgtggatgagtcctccggtgatcatgcaaccgcggcattggaggaacagctgaaagtgctaggcgatcgctgggcaaacatttgccgctggactgaggaccgatgggtcttgttgcaggatatactcttaaagtggcagcggttaaccgaggaacagtgcctatttagcgcatggctgtctgagaaagaagacgcggtgaacaagattcatacaacaggattcaaggaccagaacgagatgctcagttctctccagaagttggctgtgttaaaggcagacttagagaaaaagaaacagtctatgggcaaactgtacagcctgaaacaagacctgctgagcaccctgaagaacaaatccgtcacccagaagacagaggcctggttagacaacttcgctagatgctgggataacctcgtgcagaaactcgagaaatcgacagcccaaatatctcaggctgtgacaacgacgcaacccagtttgactcagacgacagtgatggaaacagttaccactgttacaactagagaacagatcctagtcaagcacgcacaagaagagctccctcctccccccccacagaagaaaagacaaatcacagtcgacactctagaaaggctgcaggagcttcaggaggcaaccgacgagcttgatctgaagctgcggcaggcggaagtgataaaggggagttggcagccggtgggcgaccttttgattgattctcttcaggaccatctggagaaagtcaaagcgctccggggcgagatcgcaccgctaaaagaaaacgtgtctcacgtcaacgatcttgcccgccagctgaccacgctaggtatccagctgtcaccctataacctcagcaccttggaggacctgaacaccagatggaaattattacaggtggcggtggaggatcgtgttagacagctacacgaggcacaccgcgactttggcccagcatctcaacattttctgtccacctcggtgcaagggccgtgggagcgagcaatttctcccaacaaagtgccctactatatcaaccatgaaacccagaccacctgttgggaccaccctaaaatgactgaactgtatcagagcctggcggacctgaacaatgtgcgattttcagcctatcgaaccgctatgaagttacgcaggcttcagaaagcgctgtgcttagatctcctgagtctgtctgctgcctgcgatgcccttgaccagcacaacttgaaacagaatgaccagcctatggatattcttcagattattaactgcctgactacgatttacgaccgattggagcaggaacacaacaatttggtgaacgttcctttgtgcgtggacatgtgtctgaactggctcttgaatgtgtatgacactggccgaaccggccggattagagtgctttccttcaaaaccggcatcatatctttatgtaaagctcacttggaagacaaatacaggtacctgttcaaacaggtcgcctcaagtaccggcttttgtgatcagaggcgccttggtttgctcctacacgactcaattcaaattccgagacagctgggggaggtggcgtcattcggggggagcaacattgagccttccgtccggtcctgttttcagtttgcgaataataagcctgaaatagaagccgctctgttcctcgattggatgcgactcgaacctcagagtatggtgtggttgcccgttttgcaccgtgtggcagccgcagagacagcgaagcaccaagccaagtgtaatatatgcaaggagtgccccattattggattccggtacaggtccctcaaacattttaactatgacatatgtcagtcttgcttcttctcaggacgggttgccaagggtcataagatgcattacccaatggttgagtactgcacccctacaacttctggggaagatgtaagagacttcgccaaggtgctcaagaacaaattccggaccaaaagatatttcgctaagcatccccgcatgggctacttaccagtgcagaccgttctggaaggagataacatggaaacagataccatg

SEQ ID NO: 251274 - DNA, 3591 bp, Artificial Sequence
  Description of Artificial Sequence: Synthetic coding sequence
atgctatggtgggaggaggtggaagactgttacgagcgtgaggatgtgcagaagaagacttttaccaagtgggtgaatgcccagttttcgaagtttggcaaacagcatattgagaacttgtttagcgatctgcaagatggtcgacgattgctggatctcctcgagggcctgacaggccaaaagctgcccaaggagaagggctcgacgcgcgtgcacgccctaaacaacgtgaataaggctctgcgcgtcctgcaaaataacaatgttgatcttgttaatatcggttcgaccgacattgtggacggaaatcacaaattaacactgggcttgatttggaacatcatactacactggcaggtgaaaaacgtgatgaagaatattatggctggcttgcagcagacgaactcggaaaagatattactgagttgggtgcgccaaagtacgcgcaactacccccaggtcaacgtgattaacttcacaacctcgtggtctgatggcctggctctgaacgctctgatccatagccaccgccctgacctgttcgattggaattccgtagtgtgccagcaatctgccacccagcgcctggagcatgcctttaacattgctcgctatcagctgggcatcgagaagttactggaccctgaggatgtggataccacctaccctgataagaaaagcatattaatgtacattacgtccctgttccaggtcctgccacagcaggtgtccatcgaggccatccaagaagtggagatgctgccgagaccgccgaaggttacgaaagaggaacattttcaactgcaccatcaaatgcactattcacaacagatcacagttagcctggctcagggctacgagcgcacaagttcccccaagcccaggttcaagtcatacgcatatacccaagctgcctacgttacgacctccgaccccacccgcagcccctttccgagtcagcatctggaggccccggaggacaagtccttcggatcctcgttaatggagtcggaagtgaatctggaccgctaccagacggcccttgaagaggtcctcagttggctgttgtccgcagaggacaccttgcaggcccagggcgaaatttccaacgacgtggaagtcgtaaaggatcaattccacacgcatgaggggtacatgatggatctcacggcacaccagggaagggtaggtaacatcctccagttgggcagcaaactgattggtaccggaaagctgtcggaggacgaggagaccgaggtacaggagcagatgaacctccttaatagtcgctgggagtgcctgcgggtggctagtatggagaaacagtccaatctccacagggtgctaatggacttacagaatcagaagctgaaggagctgaacgattggctgaccaagacagaggagcgcacgcgaaagatggaggaggagcctctggggcccgatttggaggatctgaagcgacaggtacagcaacataaggtcctgcaagaagatttggaacaggagcaagtgcgcgtaaattcccttacacacatggtggtggtggtggacgagagttcgggcgatcatgccaccgctgccctggaagagcaattgaaggtgctgggcgaccgctgggctaacatttgtcgttggacggaggatcgctgggtcctgctgcaggatattttgttgaaatggcaacgtcttaccgaagagcagtgcttgttcagcgcttggctgtccgagaaggaagacgcggtcaacaagatacatactacaggatttaaggatcagaacgagatgctctcgtccctgcagaagctggcggtccttaaggctgacctggagaaaaagaagcaatcgatgggcaagctctattcacttaagcaggacctattgtccacactgaaaaataagtcggtgacgcagaagaccgaggcgtggttagacaacttcgcacgctgctgggacaatcttgtacaaaaattggaaaagtcgaccgcgcaaatatcccaagctgttacgacgacccagccctccctgacgcagactaccgtgatggagaccgttactacagtgacgacgagggaacaaatcctagtaaaacacgcccaggaagagctgccccctcctccaccacagaagaaacgccagatcaccgtggataccctcgagcgactgcaggagctgcaggaagctacggacgagctcgatctgaagttacgccaggccgaagttatcaagggctcgtggcaaccagtgggtgacctactaatcgactccttgcaggatcatctggagaaggtcaaagcccttcggggagagatcgccccgctgaaagagaatgtgtcgcatgtgaacgatttggcacgtcaactcacaacattaggaatccagctgtctccctataatctgtcgaccttggaagatctgaatacccggtggaagttgctacaggttgcggttgaggatcgggtccgccagctgcatgaggcccaccgtgacttcggaccggcgtctcagcactttctcagcacctctgtacagggcccctgggagcgcgccattagccccaacaaagtgccttattacataaaccacgagactcagaccacctgctgggatcatcccaaaatgacggagctttaccagtcgctggccgatctgaacaatgttaggtttagtgcctaccgaaccgcaatgaagctgcggcgccttcaaaaagcactgtgcctcgatttattgtccctgtcagccgcgtgtgatgctctggaccagcacaacttgaagcagaacgaccagcctatggacattctgcagatcatcaactgccttactactatctatgatcgactcgaacaggaacataataacctggtgaatgtcccactgtgtgtcgatatgtgccttaactggctgttgaacgtctatgataccggccgcaccggtagaattcgagtcctgagcttcaagacaggaattatctcattgtgcaaagcccacttggaagacaaatatcggtacctgtttaagcaagtggcttcctccacgggcttctgcgaccagcgacggctgggtctcctacttcacgactcaattcagatccctaggcagcttggcgaggtggcgtccttcggggggtctaatatagaaccaagcgtacgctcctgcttccagtttgcaaataacaagccggaaattgaggccgccctgtttctggattggatgcgcttggagccgcagtctatggtttggctgcccgtgctgcaccgcgtggcagccgccgaaaccgccaagcaccaagccaaatgtaatatatgtaaagagtgccccattattggcttccgatatcgatccctaaagcatttcaactacgacatctgccaatcctgcttcttttcaggccgcgtcgccaaaggacataagatgcattaccctatggttgagtattgcactcccaccaccagtggtgaggacgtacgggactttgcgaaggtcttgaagaacaagttccgaacgaagcgatactttgcgaagcatcctagaatgggctacctcccggttcagaccgtcttggaaggagataacatggaaacagatactatg

SEQ ID NO: 251275 - DNA, 3591 bp, Artificial Sequence
  Description of Artificial Sequence: Synthetic coding sequence
atgctgtggtgggaggaagttgaggactgctacgaacgggaagatgtgcagaaaaagacctttactaagtgggtgaacgctcaattctctaaattcgggaagcagcacatcgagaacctgttttcggatctgcaggacggacgccgtctgttggacctgctggaaggactgactggccagaagttgccgaaagagaagggttctacccgcgttcacgccttgaacaacgtgaataaggcgctgcgcgtcctgcagaacaataatgtggacctcgtgaacatcggatccaccgacatcgtggacggaaatcacaaactgactctgggcctgatttggaacattatcctccactggcaggtaaagaatgtcatgaaaaacatcatggccgggctgcaacaaactaactccgaaaagatcctgctgtcgtgggtgagacaatcgactcgcaattatcctcaggttaatgtgatcaacttcactacctcgtggtctgatgggctggcactgaatgccctgatccattcgcaccgcccagacctgttcgattggaattcggtggtgtgccagcagtcggcgacccagagactcgaacacgctttcaatatcgcgcgctaccagctgggaatcgaaaagctgttggacccggaggacgtggacacgacctacccggacaagaagtcgatcctgatgtacattacttcgctgtttcaggtgctgccacagcaagtgtccatcgaggcaatccaagaagtcgaaatgctccctaggcctcccaaggtgaccaaggaggaacacttccaactccatcaccagatgcactacagccagcagatcactgtgtcattggcacagggttacgagcgcacctcctcgccaaagcctaggttcaagagctatgcatacactcaagcggcctatgtaaccacgagcgacccgaccagatccccgttcccgtcacaacatctggaggcaccggaggacaagagcttcggatcgtcgctcatggagtccgaagtgaacctcgacagataccagactgccctggaggaggtcttgtcttggcttttgtcggcggaagatactctgcaagcgcaaggggaaatctcaaatgatgtcgaggtggtgaaagaccaattccatacccatgagggatacatgatggatcttacggctcaccagggaagggtgggcaacattcttcagcttggatctaagctgattggaaccgggaagctgtcggaggacgaggaaactgaagttcaggaacagatgaatctcctcaacagccggtgggagtgcctccgagtggcatctatggagaagcagtcgaacctccaccgggtcttgatggatctgcaaaatcagaaactgaaagaacttaatgactggctcaccaagactgaagagagaaccaggaagatggaggaggagccgttgggaccggacctcgaagatcttaagcggcaggtgcagcagcacaaggtgcttcaggaggatctcgagcaagaacaggtgcgggtcaactcactgacgcacatggtggtggttgtcgacgagtcgtctggagatcatgccactgccgctctcgaagagcaactcaaggtccttggcgatagatgggccaacatttgccgctggactgaagatcggtgggtgctgctccaagatattcttctgaagtggcagcgcctgaccgaagagcagtgcctgtttagcgcatggttgtctgaaaaggaagatgccgtgaataagatccacaccaccggattcaaagatcaaaacgaaatgctgagctcactgcaaaagctcgctgtgctgaaagcagatttggagaagaagaaacagtcgatgggaaaactgtactccctgaaacaagatctgttgtcaacccttaagaacaagtccgtgactcagaaaaccgaagcctggctcgacaatttcgcgcggtgctgggacaacctggtccaaaaactggagaagtccaccgcccaaatcagccaggcggtcactactacccagccgagcctcacgcagaccactgtgatggaaaccgtgactactgtgaccaccagggagcaaatcctcgtaaagcacgctcaagaagagctgccgcctccgccaccgcagaagaaacggcaaatcaccgtcgacactctggagcgcttgcaggagctgcaagaggctacggacgagctggatctgaagctccgccaagccgaagtgatcaaaggctcatggcagccagtcggagatctccttattgacagcctgcaggatcacctggagaaggtgaaggccctcaggggcgagatcgccccactcaaggaaaacgtcagccatgtgaacgatctcgcacggcagcttaccacccttggcatacagctgagcccgtacaacttgtcgactctggaggacttgaacactcggtggaagttgcttcaagtggctgtcgaagatcgcgtcagacagctgcatgaagcacatagagacttcggaccagcatcacaacactttctctccacttccgttcaaggcccctgggaacgagccatcagcccgaacaaagtgccatactacatcaatcacgaaacccagacgacgtgctgggaccaccccaagatgaccgagctctaccaaagcctggcagatttgaataatgtgcgcttttctgcgtacagaaccgctatgaaactccgccggcttcagaaggccctgtgcctggaccttctcagcctctccgcagcctgtgacgctctggatcagcataacctgaaacagaacgaccagccgatggacatcctgcagatcatcaattgtctgactaccatctatgaccggttggagcaggaacataacaacctggtcaacgtcccgctgtgtgtcgatatgtgtctgaactggctcctgaacgtgtacgacacgggtcggaccggtaggatccgcgtgctgtccttcaagactgggatcatctcactgtgtaaggcgcatctggaggacaaatacagatatctctttaagcaagtcgcctcgtccaccggattctgcgaccagcggcgactgggtttgctgctgcatgacagtatacagatcccaagacaactcggtgaagtggcttccttcggcggtagcaatattgagccgagcgtgcggtcctgttttcaatttgccaacaacaagcctgaaatcgaagcggctctcttccttgactggatgcggctggaaccgcaatcaatggtgtggcttccagtgctgcaccgcgtggccgcagcggagacggctaaacaccaggccaagtgcaacatctgcaaagagtgcccaattatcggatttcgataccggtcactcaagcatttcaactacgacatttgccagtcctgcttcttctctggaagggtcgcgaaggggcacaaaatgcactacccgatggtcgaatactgcaccccaactacttcgggagaggacgtgagggacttcgcaaaggtcctcaagaacaagttccgtacgaagcggtacttcgcgaagcatcctagaatgggctacttgccggtgcaaactgtgctggaaggagacaacatggaaactgacaccatg

SEQ ID NO: 251276 - DNA, 3591 bp, Artificial Sequence
  Description of Artificial Sequence: Synthetic coding sequence
atgctgtggtgggaggaggtggaggattgttacgagagggaagatgttcagaagaaaacgtttaccaagtgggtaaacgcgcaattctcaaagttcggcaagcagcatatcgaaaacctcttttccgatctgcaggatggaaggcgtttactcgacctgctcgaaggactgaccggccagaagctgcccaaagagaaaggcagcacaagggttcatgcattgaataacgtgaataaagctctccgtgtactgcagaacaataacgtggatctggtgaatatcggtagcacagatattgttgatggaaaccataaactgaccctcggactgatctggaatattattctgcactggcaggtgaaaaacgttatgaagaatattatggccggcctacagcagacgaatagtgagaagattttgctatcatgggtcagacaatccacaagaaactacccccaggtcaatgtcatcaacttcactacatcttggtcagatggactcgccttgaacgccctcatccacagccacaggcccgatctcttcgattggaatagcgtcgtgtgtcaacagtccgctacccagcgcttggaacatgccttcaatatcgccagataccagctgggcatcgaaaagctcttggatcccgaagacgtcgacacgacatacccagataaaaagtccatcctaatgtacatcacctcgctgttccaagtgctgccccagcaggtatcgatcgaagcgatccaggaagtggagatgttgccccggcctccaaaggtgacgaaggaagagcatttccagcttcaccaccagatgcattactctcaacaaatcactgtgagcctggcccagggatatgagcgcacgtcctccccaaaaccacgcttcaaaagctacgcatacacacaggcagcctacgtcacaacaagcgatccaacccggagcccattcccttcccagcatctggaggcaccagaggacaagtccttcgggtcttctctaatggaatcagaggttaatctggatcgataccaaacggccctggaagaagtactgagttggcttctgagcgcggaggacacgttgcaggcccagggggagatctccaacgatgttgaggtagttaaagatcaatttcatacacacgagggttacatgatggatttgaccgcccatcagggcagggtcgggaacattctgcagttaggatcaaagctcatcgggacaggtaaactgagcgaggatgaggagactgaagtgcaggaacagatgaacctgttgaactcaaggtgggaatgcctgcgcgtggcatcaatggaaaagcaatccaatctgcacagagtgctgatggatcttcagaatcagaagttaaaggagctcaacgactggctcacaaaaaccgaagagaggacccgcaagatggaagaggaacctctgggtcctgacctggaggatctaaagcggcaagtgcagcagcataaggtgttgcaggaggatctggagcaggagcaggtgagagtgaactccctgacacatatggtggtagtcgtggacgagtccagtggggatcacgccaccgccgccctggaagaacagctgaaagtactcggcgacaggtgggctaacatatgtcgctggaccgaggataggtgggtcctgcttcaggatatcttactgaagtggcagcgactcaccgaggaacagtgcttgttttcagcctggttgtctgagaaagaggatgcggtcaataaaatacacacgacaggcttcaaggaccagaacgagatgctctcctccttgcagaaactcgccgtgttgaaggcggacctggagaaaaaaaaacagtcaatgggcaaactttacagtctgaagcaggatctcttgtccacgctgaaaaacaagtctgtcacccagaagacggaggcctggctggataactttgccagatgctgggataacctggtgcaaaagctggaaaagtccacggcccagataagtcaggccgtcaccaccactcagccctcacttacacagactacggttatggagacagttactaccgttaccactagggagcagattctggtgaagcacgcccaggaagaacttccaccacccccgccgcagaaaaaacgccagatcactgtggatacactcgaaagactccaggaactccaggaggccaccgacgagctggatctgaagctgcgacaggctgaggtaatcaaaggctcatggcagcccgtcggagacctcctaatcgactccctgcaggatcatctcgaaaaggtgaaggcgctgcggggagagatcgcgccgcttaaagagaacgttagccacgtcaatgacctagcccggcaattgaccactctaggaattcagctttccccgtacaatctgtcgaccctcgaggatctgaatacccgctggaaactgctgcaggtcgcggtggaagatagagttagacagctccatgaggctcatcgagacttcggcccagcctcccaacacttcctctccaccagcgtccaagggccgtgggagcgggccatctctcccaacaaggtgccctattacattaaccacgagactcaaactacctgctgggaccaccccaaaatgaccgaactttatcagagtctcgcggatctgaataacgtgcgattctcggcctacagaaccgccatgaagctccggaggctgcaaaaggcgctgtgccttgatctgctgtcactgagcgccgcttgcgacgctcttgatcaacacaacctcaagcaaaacgatcagccgatggacattctccagattatcaattgcctgacaaccatttacgaccgattagagcaggagcataacaatctggtcaacgtgcctctgtgtgtcgacatgtgcctgaactggttgctcaacgtctatgacactgggaggaccggccgtatccgtgtgctgagctttaagaccgggatcatcagcctgtgtaaggcccacttagaggacaagtatcgttacctctttaaacaggtggcatcttcaacagggttttgtgatcagcgcaggctgggtctgctgctgcatgactccatccaaatcccgaggcagctgggcgaggtggccagtttcggcggctctaatatcgagccatccgtccgaagctgcttccagttcgccaataataagcccgagattgaggcagccctgttccttgactggatgcggctggaaccgcagtcgatggtatggctccccgtcttacatagggtggcagccgctgagaccgctaagcatcaagcaaagtgcaacatttgcaaagagtgtccaattatcggattcagatatcgcagcttgaagcattttaactacgacatatgccagtcttgttttttttccggccgtgtggccaagggccataaaatgcactaccctatggtggagtattgcaccccaaccacgagtggggaggatgtcagggacttcgcaaaggtgctcaaaaataagttcaggaccaagcgctattttgctaagcaccctcgaatgggctatttgccggtacagaccgtcctggagggtgataatatggagaccgatacgatg

SEQ ID NO: 251277 - DNA, 3591 bp, Artificial Sequence
  Description of Artificial Sequence: Synthetic coding sequence
atgctgtggtgggaggaggtcgaggactgttacgagcgagaggatgtgcaaaaaaagaccttcaccaaatgggtcaacgcacaatttagcaagttcggaaaacagcatattgagaatctgttctcagatctccaggatgggagacgactgctggatttgctggaggggctgacaggccagaaactcccaaaagagaagggctccactcgagtgcacgctctgaacaatgtgaataaggcgttgcgcgttctccagaataacaacgttgacttggtgaatatcggatccacagacatcgtggacgggaatcacaagctgaccttaggcctgatttggaatataatactgcactggcaggtcaaaaacgtgatgaaaaacataatggcaggcctgcagcagacaaactcagagaaaatcttattgtcatgggtcagacagtccactcgtaactatccccaagttaatgtgattaactttaccacaagttggtctgacgggctggccttgaacgccctcatccatagccaccgccccgacctgtttgattggaatagtgttgtctgtcagcaatcagccacccaacggctggagcacgctttcaacatcgcccgatatcagctgggtattgaaaaactgctggacccagaggacgtagacacaacatatcccgacaaaaaaagtatcctaatgtacatcactagcttgttccaggtcctcccacagcaggtcagcatcgaggccattcaagaagttgagatgctcccacgcccgccaaaagtaacaaaggaggaacactttcagttacaccaccagatgcactatagtcaacagattacagtgagcctcgcacaaggttatgaaagaaccagctctcctaagcctaggtttaagagctacgcctacactcaggccgcatatgtgacaacctcagatcctacaaggagccctttccccagccagcacctggaagcaccagaggacaagtcctttggttcgagcctcatggagagtgaggtgaatctggatcgctatcagacagctctcgaagaagtcctgtcgtggttgctatctgccgaggacacattacaggcacagggggagatcagcaatgatgtcgaggtagtcaaggatcaattccatactcacgaagggtatatgatggacctcacagcccaccagggccgagtggggaacatcctccagctgggatccaaactaattggtactgggaaactttctgaggatgaagagacagaggtgcaagagcagatgaaccttctaaacagcaggtgggaatgcctgcgcgtggcctctatggaaaaacagtccaatttacaccgcgttttaatggatttgcagaaccaaaaactgaaggagctgaatgattggctgactaagacagaggaacgtacacggaagatggaagaggaacctctgggtcctgacctggaggacctcaagaggcaagtccaacagcacaaggtcctgcaggaagatttagagcaggaacaagtccgggtgaactctctgacacacatggtggtcgttgtcgacgaaagcagcggggatcacgctactgccgcgctagaagaacagcttaaagtgctgggagaccgatgggctaacatttgcagatggaccgaggaccgctgggttctgctacaggatatcctcctgaagtggcagaggcttactgaggaacaatgcctgttctctgcctggctcagtgaaaaggaggatgccgtcaacaaaatccataccaccggttttaaagaccagaatgagatgctcagcagtctgcaaaaactagctgttcttaaggccgacttagaaaaaaaaaaacagagtatggggaaattatactcactcaagcaggacctgctttccaccctgaagaataaaagcgttactcagaaaacagaggcttggctcgacaattttgcccgttgttgggacaatctggttcagaaactggagaagagcacagcccaaattagtcaggccgttactaccactcagccgagtctaacccagacgactgtgatggagaccgtaactaccgtaaccacacgcgaacaaattcttgtcaaacatgctcaggaggagctaccaccaccaccaccacagaaaaagcgtcagataaccgttgacaccctggaacgactgcaggagctgcaggaggcaaccgatgagctcgatctgaagttgagacaggcggaagtgattaagggatcttggcagcctgtaggggacctgttaatcgactctctgcaggaccacctggaaaaagtgaaggctctccgaggcgagatcgctcctctcaaggagaatgtgtcccatgtaaacgacttagctcggcagcttacaaccctaggcattcagctgagcccatataatctgtcaaccctggaggatctcaacacaaggtggaaactcctgcaagtcgccgtggaagatagggtgaggcagctccacgaagcccacagagatttcggaccagcgtctcagcacttcctgtccacttcagtgcagggtccgtgggagcgggcgatttcgcctaacaaagttccatattacataaaccatgagacccagaccacctgttgggatcatccgaagatgactgagctataccagtcattggctgatctcaacaatgtgcggttctccgcgtatcgtacggccatgaaactgcggcggctgcagaaggcgctgtgtctggatctcctgtcactatccgctgcctgtgacgcactcgatcagcataatctaaaacagaatgaccaaccaatggatattttacaaattattaactgtttgacaacaatctatgatagattagaacaggagcataacaatcttgtgaacgttcctttgtgcgtggacatgtgtctgaactggttgctgaacgtgtacgacaccggacgaacaggcagaattcgggtccttagctttaagactggaataatatctctgtgtaaagcccacctggaggacaagtaccggtacctgtttaaacaggtggccagctccacaggattctgtgaccagaggagactaggccttctgctgcacgactctatccagatcccacgccagttaggcgaggtcgcttccttcggcgggtcaaacattgagcctagcgtgcgctcttgttttcaattcgcgaataacaagccagagattgaggctgccctgttcctggattggatgaggttagaaccgcagtccatggtctggttacctgtgttgcacagagtcgccgcggcagagaccgctaagcatcaggcgaaatgcaacatttgcaaagagtgtccaatcatcggattcagataccgcagtttgaaacattttaattacgacatttgtcagagttgttttttcagcgggcgggttgcaaagggccataaaatgcactacccgatggtggagtattgcaccccaaccacctctggagaggacgtgcgcgactttgcgaaagtgctaaaaaacaaattccgcaccaagagatactttgccaaacaccctagaatgggttatctcccggttcagaccgtgttggaaggggataacatggaaaccgatacaatg

SEQ ID NO: 251278 - DNA, 3591 bp, Artificial Sequence
  Description of Artificial Sequence: Synthetic coding sequence
atgctctggtgggaggaggtcgaggattgctatgagcgggaagatgtgcagaaaaagactttcaccaaatgggttaacgctcaattctccaaatttggcaagcagcatatagaaaatcttttctccgacctccaggatggccggcgcctacttgatctcctcgaaggccttactggtcagaagctcccaaaagaaaaagggtcaacgcgggttcatgctctcaataacgtaaacaaagctctacgcgtgttacagaacaacaacgtagatctggtgaatattggctcaacagatattgtggatggaaatcacaaacttacgttgggccttatctggaatattatactgcactggcaggtaaaaaacgtgatgaagaatattatggccggcctgcagcaaacgaactccgagaaaatcttgctgtcctgggtccgacagagtaccaggaattacccacaggttaatgtaatcaacttcacaacctcctggagcgatggccttgctttaaatgcactaattcattcacacagaccagatctgtttgactggaatagcgtggtgtgtcagcagagtgcaacgcagagactggaacatgcctttaatattgctagatatcagttgggcatcgagaaactgctggaccccgaagacgtggatactacatacccggataagaaatccattcttatgtacatcaccagtctgttccaggtgctcccccagcaagtgtctattgaggcaatccaagaagttgagatgctgccccgcccccctaaggtgactaaggaagaacattttcagctccaccaccagatgcactactcccaacagattacagtgtcgttagcccaagggtacgagcgcacctcgtcaccaaagccacgattcaagtcttatgcgtatacacaggctgcatacgtcaccacaagtgaccctacaaggagcccttttccttcacaacacttggaagcaccagaagataagtccttcggtagctcacttatggagtcagaggtgaacttagatagataccagactgctcttgaggaagtgctcagctggctgttatcagctgaagatacactacaggctcagggtgagattagcaacgacgtcgaagtggtaaaggatcaattccatacccacgaaggatacatgatggatctcactgcccaccaagggcgagtgggaaatatcctccaattaggttccaagctgataggcaccgggaaactcagcgaagatgaggaaactgaggtgcaggaacaaatgaatcttctcaactctcgatgggaatgcctgagggtggccagcatggagaaacagtcaaatctccaccgggtgctcatggacttgcaaaaccagaagttgaaagagctgaacgattggttgaccaagacagaagaaagaacaaggaaaatggaagaagagccgctcggcccggacctcgaagatttgaagcgccaggtacagcagcacaaggttctccaggaggacttagaacaggaacaggttcgagtgaatagtctcacccatatggtggtggtcgtggatgagtcctctggcgatcatgccaccgcagctcttgaggagcagttaaaggtgctcggcgaccgctgggcaaacatttgccgctggactgaagacagatgggtcctgctgcaggacatcctgttaaagtggcaacggctgacagaagagcaatgtctgttcagcgcctggctgagtgaaaaggaagatgcagttaacaagatccacaccaccggctttaaagatcagaacgagatgctgagtagtctacagaaactcgccgtgctcaaggctgatcttgaaaagaagaagcagagtatgggcaagctgtatagtctaaaacaggacttgctgagtactcttaaaaacaagagcgtcactcagaaaacagaggcctggctggacaatttcgctagatgctgggacaacctggttcagaagcttgagaaaagtaccgctcagatctcacaggcagttacaaccacgcagccaagccttacccaaacgacggtgatggaaaccgtgactaccgtcactacaagagagcaaattctggtcaaacacgcccaagaggagttgcctccgccaccccctcagaagaagaggcaaataacagtggatacactcgagcgactgcaggaactgcaggaagccactgatgagctcgatttgaagttgcggcaggctgaggtcattaaagggtcctggcagccagtgggggaccttttaattgattccctgcaagatcatctggagaaagtcaaagctttgaggggagagatcgcccccctgaaagagaacgtttcgcacgtgaacgacctggccagacagctcacaaccctcggcatacaactctctccatacaacctctcgacactggaggacctcaatacacgctggaagttgcttcaggtagccgtggaagatcgcgtgcggcagctccacgaagcccacagggactttggcccagcaagccagcatttcctgagcacgagcgttcaggggccatgggagcgggcaatttcaccaaacaaggttccttattatattaatcatgaaactcagaccacgtgttgggatcatcccaaaatgacagagctatatcagtccctggcggatctgaacaacgtgcggtttagtgcctatcgtaccgcaatgaaattgaggcgtcttcagaaggccttgtgcctggatctcctgtctctaagtgcggcctgcgatgcacttgaccagcacaatttgaaacagaacgaccagcccatggatatcctgcagatcataaactgcttgaccacaatttacgatagactcgagcaggaacataacaatctggtgaacgtgcccttatgcgttgacatgtgtttgaactggctcttgaacgtgtacgacacaggccgtactggaaggatccgggtcctcagtttcaagaccgggatcatctctctgtgcaaggctcatctggaagataagtatcggtatctgtttaaacaagttgcttcttctactggcttctgtgaccagcgcaggctcggactgttactgcacgacagcattcaaatccctcgccagcttggcgaggtggcaagcttcggtggctctaatattgagcccagcgttcgatcatgttttcagtttgcaaataataaaccagaaattgaggcagcactgttcctcgattggatgagattagaacctcaaagtatggtttggctcccagtgttgcacagagtcgctgctgcggagactgcgaagcatcaagctaagtgcaacatatgtaaggagtgccccatcatcggattcagataccgctcgcttaaacatttcaactatgatatctgtcagtcatgctttttctccggccgtgtggcgaaagggcacaaaatgcactaccccatggtggaatactgtacaccaacaacaagcggcgaggatgttcgtgattttgccaaggtactgaaaaataaatttcggactaaaagatacttcgctaaacaccctagaatgggatatttgcccgttcagaccgtactcgagggcgacaacatggaaacagataccatg

SEQ ID NO: 251279 - DNA, 3591 bp, Artificial Sequence
  Description of Artificial Sequence: Synthetic coding sequence
atgctttggtgggaagaggtcgaagattgctacgaaagagaagatgtccagaaaaagacctttactaagtgggtgaatgcgcaatttagcaagtttggtaaacaacatattgagaatctttttagcgatctgcaagatggaaggagacttctcgatctgcttgaaggattgactggacagaaactgccgaaagaaaagggttcgactcgagttcatgcgcttaacaatgtcaataaggcactgagagtgctgcagaacaataacgtcgatctggtgaatatcggatcaactgatatcgtggatggtaaccataagctgactctgggattgatatggaacattatcttgcactggcaagtgaagaatgtgatgaagaacatcatggcaggactccaacaaaccaacagcgagaagattctgctctcctgggtgcgccaatcaactaggaattatccacaagtcaatgtcataaactttactacgagctggtcagacggactcgctctgaacgcactcattcactctcaccgtccagatcttttcgattggaatagcgtcgtgtgtcagcaatccgccacccagcgccttgaacatgcattcaatatcgcgagataccagcttggaatagaaaagctgctcgacccagaagatgtggacactacctaccctgataagaagtcgatactcatgtacattacctcgctgtttcaagtgcttccacagcaggtcagcatcgaagcaattcaagaagtggagatgcttccaagaccacctaaggtcaccaaagaagagcactttcaacttcatcatcagatgcattacagccaacaaattaccgtctctctggcccaagggtacgagagaactagcagccctaagcctcggttcaagagctacgcttatacccaagcagcatacgtgaccacctccgacccaactcgatcgccatttccttcgcagcatcttgaagccccagaggataaatcattcggatcctcgcttatggaatcagaggtgaaccttgacagataccaaaccgcacttgaggaggttctttcatggcttttgtcggccgaggatactcttcaagcgcaaggagaaatttcaaacgacgtcgaagtggtgaaggatcagtttcatacccatgagggttatatgatggacctcaccgcacaccagggtcgggtgggaaacatactgcaactgggttcgaagctgattggtaccggaaaactctcggaggatgaagaaaccgaggtccaggaacagatgaacctgctcaactcgcggtgggagtgtctgagagtggcgtcaatggagaagcagtcgaatcttcaccgcgttctgatggatctgcaaaatcagaagctgaaggaacttaacgactggcttactaaaaccgaagaaagaaccaggaagatggaagaagaaccactcggtccggatcttgaagatctcaaacggcaagtgcagcaacataaggtcctccaagaggatttggaacaggaacaggtgagagtcaatagcctgacccacatggttgtggttgtggatgagtcatccggagatcacgctaccgccgcactggaagaacaactcaaggtgctgggtgaccggtgggccaacatctgccgatggaccgaggacagatgggtgctgcttcaagacatcctgcttaagtggcaaagactgaccgaagaacaatgtcttttttccgcatggctttcagagaaggaggatgcggtgaacaagattcatactaccggttttaaggatcagaacgagatgctctcctcccttcaaaagttggcagtgctgaaggcagatctggaaaagaaaaagcaaagcatgggcaagctgtactctcttaagcaagacctcctgtccactctgaagaacaaatccgtgacccagaaaaccgaggcatggctggacaacttcgcacggtgctgggacaatctggtccaaaaactcgaaaagtcgaccgcacagatcagccaagccgttacgaccactcaaccttcccttactcaaaccaccgtgatggagactgtcaccactgtgactactcgggaacagatactggtgaagcatgcacaggaagagctcccgcccccgccacctcaaaagaagaggcagattacggtcgatactcttgaaaggctccaggagcttcaagaagcaactgacgaactcgacctgaagctgcgccaagctgaggtcatcaaaggttcgtggcaacctgttggggatcttctcatcgactcccttcaagatcacctcgagaaggtcaaggctctgaggggagagatcgcaccactcaaagaaaatgtgtcgcacgtgaacgacctggcaagacaacttactacgctcggcattcagctgtccccttacaatctctcaactctggaagatttgaacactcgttggaagttgcttcaggtggcggtggaagatagagtgcgacagcttcacgaagcacatagagacttcggccccgcatcgcaacatttcctttcgacttcagtgcaggggccttgggagagagcaatctcgccgaacaaagtgccctactacattaatcacgaaactcagaccacttgttgggatcatccaaagatgaccgagctttaccaatcgctcgccgatctcaataacgttagattctcggcatacagaactgcgatgaaactccgtaggcttcaaaaggctctctgtctggacctgttgtccctgtcagcggcgtgtgacgcactggaccagcataacctcaaacaaaacgatcagcctatggatatactccagatcataaactgcctgactactatttacgataggttggaacaagaacacaataacctggtcaacgtcccgctctgtgtcgatatgtgccttaactggctcctcaatgtctacgataccgggcgcaccggccggatcagggtgcttagctttaagaccggaataatctccctgtgcaaggcacaccttgaagataagtaccgatacctgtttaagcaggtggcaagctcaacgggtttctgtgatcagcggaggctggggcttttgctgcacgactctattcaaattcctcgtcagctgggagaggtcgcctcctttgggggttccaacatcgaaccttcggtgcgcagctgcttccaatttgccaacaacaaaccagaaatcgaggccgccctctttctcgactggatgagactggagcctcagtctatggtgtggcttcctgtgcttcatcgggtcgccgctgcagaaaccgcaaagcatcaggcaaagtgtaacatctgtaaagaatgccctattatcggattcaggtaccggagccttaaacatttcaactacgatatctgtcagagctgttttttcagcgggagggtggccaagggccataagatgcattaccctatggtggaatactgtactcctaccacttccggagaagatgtcagagattttgcaaaggtgctgaagaacaagtttaggactaaacgatacttcgctaagcacccgcgaatgggctacctgcctgtgcaaactgtgctcgaaggggataacatggagactgatacgatg

SEQ ID NO: 251280 - DNA, 3591 bp, Artificial Sequence
  Description of Artificial Sequence: Synthetic coding sequence
atgctctggtgggaagaagtggaagattgttacgagcgagaagatgtgcagaaaaagacctttacgaagtgggtgaatgcgcaattttcaaagtttggtaagcaacatatagagaatctgttctccgatttgcaagacggccggcggttgctggaccttcttgaaggacttactggccagaaacttccaaaggaaaaaggatccaccagggtgcatgcacttaacaacgtcaacaaggcgcttcgagtcttgcagaataacaacgtcgacctcgtgaacattggatccacggatattgtggatgggaaccataaacttacgcttggacttatctggaacattattctgcattggcaagtcaagaacgtgatgaagaacatcatggcagggttgcagcaaaccaattcggagaagattctgctttcctgggtccgtcagtccaccagaaactacccacaagtcaatgtgattaacttcaccacgagctggtcggacgggcttgcacttaatgcacttatacattcccatcggccggatctgtttgactggaatagcgtggtctgccagcaatcagccactcagagattggaacacgcctttaacatcgcaagataccagcttggcattgaaaagttgctcgaccctgaggatgtggacactacttacccagataagaagtcgatcctcatgtacattacctccctgtttcaagtgcttccccaacaagtgtccattgaggcgatccaagaagtggagatgctgccacggcccccaaaggtgactaaagaagaacatttccaactgcaccaccagatgcactactcacagcagattacggtgagccttgcacaggggtacgaaagaacctcatcacccaagccgcgatttaagtcctacgcttacacccaggcagcatatgtgactacgtcggatcccaccaggtcgccattcccttcacaacatctcgaagcacctgaagataaatcctttggctccagccttatggaatccgaagtcaaccttgataggtaccaaaccgcccttgaagaagtgttgagctggctcctttcggcagaagatacccttcaagcccaaggtgagatttcaaatgatgtggaggtggtgaaggaccagtttcatacccacgaaggttacatgatggacctgaccgcacaccagggaagggtgggaaatatccttcaactgggttcgaagctcatcggaacggggaagctctccgaagatgaagaaacggaagtgcaagaacagatgaaccttcttaatagcaggtgggagtgcctgcgcgtggcatcgatggaaaagcaatcaaacctccatagggtgttgatggatctgcagaatcagaagctcaaggagctcaacgattggcttaccaagaccgaagagcgcacccgtaagatggaagaagaacctctcggaccagacctggaagatctgaagaggcaggttcagcagcataaggtcctgcaggaagatctcgaacaggaacaagtgcgtgtgaattctctcacccacatggtggtggtcgttgatgagtcgtcgggagatcacgccactgcagcactggaagaacagctgaaggtgcttggagatcgctgggcaaacatttgtaggtggaccgaggataggtgggttttgcttcaagatattctgctcaagtggcagagacttactgaagagcagtgtcttttctccgcctggctgtctgagaaggaggatgccgtgaacaagattcatactaccggcttcaaggatcaaaacgaaatgctctcgtcccttcaaaagctggcagtcttgaaggcggacctggagaaaaagaagcaatcaatgggaaagctgtactcgcttaaacaagatcttctctccaccttgaagaacaagtccgtcacccaaaagactgaagcatggctcgacaactttgcgagatgctgggataacctggtgcagaaacttgaaaagtcgactgcccaaataagccaagcagtgaccactactcagccatccctgacccaaaccactgtgatggagacggtaaccaccgtgaccactagagaacaaattcttgtgaagcatgcccaagaggaactgccacctcctccacctcagaagaagcgccaaatcaccgttgataccctggagagactgcaggagctgcaggaagcgactgatgaactggatctgaagctcagacaggcagaggtgataaaaggctcgtggcagcctgtgggcgatctcctgattgattcgcttcaggaccatctcgaaaaagtgaaagcgctgcgaggtgaaatagcaccactgaaagaaaacgtgtcccatgtcaatgatctcgcacgccaacttaccaccctgggaattcaactctccccatacaacctttcgaccctggaggatctgaataccagatggaagctgctgcaggtggccgtggaagatcgagtgcgccaacttcatgaagcacaccgtgattttggacctgcatctcaacactttctcagcacttcggtgcaggggccttgggaacgggccattagccccaacaaagtcccttactacattaaccatgaaactcaaaccacctgttgggatcatcctaagatgactgaactttaccaatcactcgctgatctgaataacgtccggttttccgcgtacagaactgctatgaaactgagacgcctgcagaaggccctctgtctggacctcctgagcctcagtgcagcatgcgatgcgctggatcaacataacctcaagcagaacgatcaaccaatggacattcttcagatcattaactgtctcaccactatctacgaccggttggagcaggagcataacaatctggtgaatgtgcctttgtgtgtggacatgtgtctcaattggctgcttaacgtctacgatactggtcgcaccggacgtatccgcgtgctgagcttcaagacgggcatcatttccctttgcaaggcacatcttgaagataagtaccgctacctgtttaagcaagtcgcaagctctactggattctgcgatcaacggagactggggctgcttctgcatgactcaatccaaatccctagacaactgggagaggtagcatccttcggaggaagcaacatcgaacccagtgtccgttcctgtttccagtttgcaaacaataagcctgagattgaagccgccttgttccttgattggatgagactggaaccacagtccatggtgtggctgcctgtgctgcaccgggtggcagcagcggaaacggcaaagcatcaagccaagtgtaacatttgtaaagagtgtccgattatcggttttcgttacagatccctcaaacactttaactacgatatttgtcagtcatgttttttctccggacgagtcgcaaaaggacataagatgcactaccccatggtggaatactgcactccaaccacttcaggggaagatgtgagggatttcgcaaaggttctcaaaaacaagttccgcaccaagcgttacttcgccaagcatcccagaatgggatacctgccagtgcaaactgtacttgagggtgataacatggaaaccgatacgatg

SEQ ID NO: 251281 - DNA, 3591 bp, Artificial Sequence
  Description of Artificial Sequence: Synthetic coding sequence
atgctgtggtgggaggaagtggaggattgctacgagagggaagacgtccagaaaaagacattcactaagtgggtcaatgctcagttctcaaagttcggaaaacagcatatcgagaatcttttttcagatctacaggacggccgccgattgcttgacctgctggaggggctaactggccaaaaattgcctaaagagaaagggtccacacgcgtgcacgccttgaacaacgtcaacaaagccctccgagtgctgcagaataataatgtggatctggtgaacatcgggagcacggatatcgtcgatgggaatcacaagctgacattgggcttgatctggaacatcatcttgcattggcaagttaaaaatgtgatgaagaacatcatggcgggcctgcagcagaccaattcagagaagatcctcttgagttgggtgcgccaatctaccagaaattacccccaagtgaacgttattaacttcaccaccagctggagcgacggactcgccctgaacgccttgatacactctcacagacccgacctctttgattggaatagtgtggtgtgtcaacagtctgccacgcagcggttggaacatgcctttaacattgctaggtatcagttagggatcgagaagctgctggatcccgaggacgtcgacaccacttatccagataaaaagagcatactgatgtacatcacttccctgtttcaagtgctcccccagcaggtatcgatcgaagctatccaagaggtggagatgctcccccgcccaccaaaggtgacaaaggaggagcattttcagttgcatcaccaaatgcattacagccaacaaatcacagtaagcctggcacagggttacgagcgaacaagcagcccgaaacctcgatttaagagctatgcatatacccaggcggcgtacgtaacaacctctgaccccacgagaagtccttttccaagtcagcacctcgaagcacctgaggataaatcgtttggctcatccctgatggaatccgaagtcaacttagatagataccagactgctctcgaggaagtcctgtcgtggctcctttctgctgaagacactttgcaggcgcagggggaaatatctaatgacgtggaggtggtgaaggaccagttccatacccatgagggatacatgatggacctcaccgcacaccagggacgggtcggtaatatacttcagctcgggtctaaactgattgggaccggtaagctttctgaagatgaagaaacagaagtgcaggagcagatgaatctcctcaattctcgatgggaatgtctaagagtggcttctatggagaagcagagcaacttacatcgagtgctcatggatctgcagaatcaaaagctgaaggagttgaatgactggctcaccaagaccgaggaacggaccaggaagatggaagaggagcccctgggtcccgatctcgaggacttaaaacggcaggtacaacagcataaggtcctgcaggaagacttagagcaggaacaggtcagagtaaatagcttaactcacatggtggtggtagtggacgaaagctctggcgaccacgccactgccgccctcgaagaacagcttaaggtgttgggagaccggtgggcaaacatatgccggtggactgaggaccgttgggtactactacaggacattctgctgaaatggcagagactcaccgaggagcagtgccttttctctgcttggttgtccgagaaggaagatgctgtgaataagatccacacgacgggattcaaggatcaaaatgaaatgctcagctctctgcagaaactggctgttctaaaagctgatctggaaaagaagaaacaatctatgggaaagctgtacagcctgaagcaggaccttctcagtactctcaagaataaatctgtgacccaaaagaccgaagcttggctggacaacttcgcccggtgttgggacaacctggtgcagaaactcgagaaatcgacagcccaaattagtcaggctgttacaacgacacagccatcattgacccagacgaccgtcatggaaacagtgaccaccgtgaccacacgcgagcagattctcgtgaagcatgctcaagaagaactgccccccccccccccacagaaaaaacgccagatcacagtagacaccctggagcggctgcaagaactccaggaggccactgacgaacttgatctgaaactaaggcaagctgaggtgattaagggtagctggcaaccggtgggagatctcctgatagactcccttcaagatcacctagaaaaggttaaagctctccgcggtgaaatcgcacctcttaaagagaacgtgtctcatgtcaatgatctggccagacagctgaccaccctaggtatccagctgtcaccatataatttaagcactctcgaggacctcaacacccggtggaaattactgcaggttgccgtggaggaccgagtgcggcaactgcacgaagcccatcgggatttcggtccggctagtcagcacttccttagtacgagcgtgcagggtccctgggaacgcgcaatatccccgaataaggtcccgtattatattaatcacgagactcagaccacatgttgggaccacccaaaaatgacagagctgtaccagtccctggctgacctcaacaacgtgaggttttcagcctaccgaaccgcgatgaaactacgtaggctgcagaaggcactttgcctagatctgctgtccctctccgccgcatgcgacgctctggaccagcataaccttaagcagaacgaccagcccatggatattctgcagatcattaactgcctgaccaccatctacgacaggctggaacaggagcacaacaaccttgtcaacgtacctctatgcgtagacatgtgtctaaattggctgttgaacgtttacgatacgggcaggaccggtcggatcagggtgctgtcatttaagactggaattattagtctgtgcaaagcgcatctggaagataagtacaggtacctttttaagcaggtggcttcttctacgggcttttgcgaccagagacggctaggtctcttactgcacgacagtattcagatccctcgccagctgggcgaagtggcatcgttcgggggatcaaatatcgaacctagcgtccgcagctgctttcagtttgcaaacaacaagcccgagatcgaagctgcactttttctggactggatgcggctcgagccccagagtatggtgtggcttcccgtgctacatagagtggctgccgcagaaacagctaagcaccaggcaaaatgcaatatatgtaaggagtgtccaataatcggcttccgatatagaagcctgaaacactttaattacgatatttgtcagagctgttttttcagtgggcgagttgctaaggggcacaagatgcactatcctatggttgaatactgtacaccgacgacgagtggcgaagacgtgcgggactttgccaaagttctcaaaaacaaatttaggacaaagcgatatttcgctaagcatccccgtatgggatatctgccagttcagaccgtgctcgagggtgacaacatggaaaccgacacaatg

SEQ ID NO: 251282 - DNA, 3591 bp, Artificial Sequence
  Description of Artificial Sequence: Synthetic coding sequence
atgctgtggtgggaagaagtcgaggactgctatgagcgcgaagatgtgcagaagaaaaccttcaccaagtgggtgaatgcgcagttttccaagttcggtaagcagcatattgaaaacctgttctctgaccttcaggacgggagaaggctgctggacctgctggaaggactgaccggccaaaagctgcccaaggagaagggaagcacgagagtccacgccctcaataacgtcaataaagctctgcgggtgctccaaaacaataacgtcgatctggtcaacatcggatccacggacatcgtcgacggcaatcacaagctgaccctcgggctcatttggaacatcatcctgcattggcaggtgaagaacgtgatgaagaacatcatggccggactgcaacaaacgaattccgaaaagatattgctgtcgtgggtccggcagtccactcgcaactacccgcaagtgaacgtcatcaatttcaccacgtcgtggtcggatggcctcgcgctgaacgctctcatccactcacaccggccggacctcttcgactggaattcggtcgtctgtcaacaatcggccactcaacgcctggagcacgccttcaatatcgcaagataccaattgggtatcgagaaactccttgaccctgaagatgtcgacaccacctacccggacaagaaaagcatcctcatgtatatcactagccttttccaagtcctgccgcagcaggtttccattgaagccatccaagaggtcgaaatgctgccgcgcccgcccaaagtgaccaaagaagagcacttccagctgcaccaccaaatgcattactcccaacagatcactgtctcccttgcgcagggctacgagcgcacctccagccctaagccgcggttcaaatcgtacgcctacacccaggccgcctacgtgaccacctcggaccccacgcggtcgccgttcccatcccagcacctggaggcgcccgaggacaagtcatttggatcatcccttatggagtcagaagtcaatctggaccggtaccaaactgcgctcgaagaggtgctgtcgtggctgttgtccgccgaagataccctccaagcccagggagaaatctccaatgatgtggaggtggtgaaggatcagttccacacccacgagggctacatgatggacctgactgcgcatcaggggagggtgggaaatatccttcagctcggcagcaagctcatcggcactggaaaactgagcgaggacgaagaaactgaagtccaggaacagatgaatcttcttaattcgcgctgggaatgtctgcgcgtcgcatccatggaaaagcaaagtaatctgcaccgcgtcctgatggatctccagaatcagaaactgaaggaactgaatgactggctcactaaaaccgaggagcgcaccagaaaaatggaagaagaaccactcggaccggacctcgaggaccttaaacggcaagtccagcagcataaagtgctccaagaggatcttgagcaggaacaggtgcgcgtgaactcccttacccatatggttgtcgtggtcgacgagagctccggagatcacgcaactgccgccctggaagagcagctcaaagtgttgggcgaccgctgggcgaacatttgccgctggactgaagatcggtgggtcctgctgcaagatatcctcttgaaatggcagcgcttgactgaagaacagtgcttgttttctgcatggctttcagagaaggaagatgcagtcaacaaaatccacactaccggattcaaagatcagaacgagatgctgtcctcgttgcaaaaactggctgtcctgaaagctgatctggagaagaagaagcagagcatggggaagctgtactcactgaagcaggaccttctttcgaccctcaagaacaaatccgtgacccagaaaaccgaagcatggctggacaactttgccagatgctgggataatctggtgcagaagctcgagaagagcaccgcgcagatctcgcaggcagtcaccactacccagccttccctgactcaaacgacggtgatggaaactgtgactaccgtcaccactcgcgagcagatcctggtgaaacacgcccaggaagaactgccccctcctcctccacagaagaagaggcagattactgtggacaccctggaacggttgcaagaactccaagaggctactgacgaactggatctgaagctcagacaagcggaagtgatcaagggatcgtggcaaccggtgggagatctgctgatcgattccctgcaggaccatcttgagaaggtgaaagcgttgaggggcgagatcgctcccttgaaggagaacgtgtcccacgtcaacgatctggctcgccagctgactacgcttggaatccagctgtcgccgtacaacctgtccacgttggaggatctcaacactcgttggaagctgctccaagtggcagtggaagatagagtgagacagctccatgaagcccacagggacttcggcccagcttcgcaacacttcctgtcgacctcggtccaaggaccatgggagcgcgcgatctcacctaacaaggtgccctactacattaatcacgaaactcaaactacttgctgggaccatccgaaaatgactgaattgtaccagtctctggcggacctgaataacgtccggttctcggcataccggactgcaatgaagctgcgccgcctgcagaaagcactgtgcctggacctcctgagcctgtcggcggcgtgcgatgcccttgatcaacacaacctcaagcagaatgaccagccaatggacatcctgcagatcatcaactgcctgaccactatctacgaccgcttggagcaggaacacaataatctggtgaatgtgccactctgcgtggacatgtgtctcaattggctcttgaatgtgtatgatacggggcgcactggccggatcagagtgctgtcattcaagaccggaatcatcagcctgtgcaaagcgcacctggaggataagtatcgctacctgttcaagcaggttgcttcgtcaaccggcttttgcgaccagaggcgcctggggctgctgctccacgactcgatccagatccctcggcaactcggggaggtggcttcgttcggaggtagcaacatcgagccatcggtgcgctcatgtttccaatttgctaacaataagcccgagattgaagccgccttgttcttggactggatgcggctggaaccccagtccatggtgtggctcccggtgctgcatcgtgtggccgctgccgagactgcaaagcaccaggccaaatgcaacatctgcaaggagtgtccgataatcggcttcaggtacaggagcctgaagcacttcaactacgacatttgccagtcctgtttcttttccggtcgcgtcgcgaaaggacataagatgcattaccccatggtggaatactgtactccgaccacctcgggcgaggacgtgagggatttcgcaaaggtcctgaagaacaaattccgtaccaagcgctacttcgctaaacatccacggatgggctacctgccggttcagaccgtcctggaaggagataacatggaaaccgacactatg

SEQ ID NO: 251283 - DNA, 3591 bp, Artificial Sequence
  Description of Artificial Sequence: Synthetic coding sequence
atgctctggtgggaggaagttgaggactgctacgaacgtgaagatgttcagaagaaaacgttcacaaagtgggtcaatgcccagtttagtaaatttggaaaacagcacatcgaaaatttgttctcggaccttcaggatggtcgacgtcttcttgatctattggaaggactgaccgggcaaaagcttcccaaggaaaagggttcgacgcgtgtacatgcacttaacaatgttaacaaggcattgagggtcttacaaaacaacaatgtggatctggtaaacataggttctacagacatcgtagacggaaaccataagttgactctcggactcatctggaacattatcctccattggcaagtgaaaaacgtgatgaagaatattatggccggtttgcagcagactaactctgagaagatcctcttgagctgggtcaggcagagtacacggaactacccccaggtcaacgtaattaattttacgacttcatggtccgacggactggctctgaacgccctgatacattcccatcggccggatctattcgattggaactctgtagtctgtcagcagagcgctacgcaaagactggaacatgcgtttaacattgcgcggtaccagctagggatcgaaaagcttcttgatccggaagatgtggatactacttatcccgacaagaagagtattttgatgtacataacctctctgtttcaagtcctacctcagcaggtgtccattgaggcaatccaggaggtcgagatgctacctcgtccgccaaaggttacgaaagaggaacatttccagttgcatcatcaaatgcattactcgcagcagatcacggtctcactagctcagggatacgaacgcaccagcagccctaagccacgctttaagagctatgcgtacacccaagcagcctatgtcactacgagtgatccaactcgttctccattccccagccagcacctggaggcacctgaagataaatcttttggttcttcgttgatggagagcgaagtcaatttggataggtaccagaccgcgctcgaggaagttttgtcatggctcctcagtgctgaggacactctgcaggcccaaggtgagatatctaatgatgtcgaggtagtgaaggaccagttccatactcatgaggggtatatgatggacttgaccgcacaccagggtcgggttgggaatatcctgcagctgggaagcaagctaatcggtacaggtaagctatctgaagatgaggaaacagaagtgcaggagcagatgaacctgcttaactcccgttgggaatgcctacgggttgcatcaatggaaaagcaaagcaatctacatcgagtccttatggatttgcaaaaccaaaaacttaaggaacttaatgattggttgacgaagactgaagagcgtacacggaagatggaggaagagcctctgggaccagatcttgaagatctaaaacgccaggttcagcagcacaaggttttgcaggaggacttggaacaagagcaggttcgcgtcaactccttgacgcatatggttgtcgtcgttgacgagtcttcaggcgaccatgcgaccgcggcgctggaggaacaactaaaggttctgggtgaccgttgggctaatatctgtcgatggaccgaggaccggtgggtcctgctacaggatatcctattgaagtggcagagactgaccgaggagcagtgcctcttttcggcttggttatctgagaaggaagacgctgttaacaagatccacaccacagggttcaaggatcagaatgagatgttaagctcacttcagaaacttgctgtcctaaaggctgacttggaaaagaagaagcagtccatgggaaaactttattccttgaaacaagacttgctctcaacattgaagaacaagtcagttacgcaaaaaaccgaagcctggctcgataacttcgcccggtgctgggataacctagttcaaaaactggaaaagtccacggcacagatttctcaagccgtaacgacgacccagcctagtctaactcagacgacagtgatggaaacagtgacgactgtgaccacccgtgagcagatcctggtgaaacacgcccaggaggagttgccccctccacctccccagaagaagcggcagattaccgttgatacccttgagcgtcttcaggagttacaagaggcaactgacgaactcgacctgaagctccgacaggcagaggtaattaagggctcctggcaacctgttggcgacctcctcatagacagcctccaagatcatcttgagaaggttaaagcactgcggggcgaaattgcgccactgaaggagaatgtcagccacgtcaatgatctcgcgcgccaactcacgactcttgggatccaactctctccttataacctatcaactctggaggacctgaacactcggtggaagcttcttcaggttgctgtggaagacagggtgcgacagcttcacgaggctcaccgagacttcggtccagcgtcccaacactttctttccacgagcgtccagggtccgtgggagcgtgctataagtcccaataaagtgccctactacataaaccatgaaacccagacgacctgttgggatcacccgaaaatgacagagttatatcaatcattggccgatttgaacaatgttcgcttctcggcttatagaaccgcgatgaaacttagacgactccagaaggctctatgtctcgacctattgagtctatccgccgcctgcgacgcgctagaccaacacaacctcaaacaaaacgaccaaccaatggatattctgcagatcatcaactgcctgaccaccatatacgatcggttggagcaagaacataataacctggtgaatgtccccctctgtgtggacatgtgcctaaattggcttctgaatgtctatgacaccggtcgcaccggacgcatccgtgtactctcctttaagacaggtatcatcagtctctgtaaagctcatctggaggacaagtatcgctacctgttcaagcaagtagcatcttcgacaggtttctgtgaccagagacgtttaggacttctcctccatgacagtattcagatcccacgtcagcttggtgaagtggcatctttcggaggctctaatatagagcctagcgtgcgcagttgcttccaatttgccaataataagcctgaaatcgaggccgccctctttctggactggatgagactggagccacaaagtatggtctggcttccggtcctccatcgggtggcggcagcggaaaccgcaaagcatcaagccaagtgtaacatttgcaaggagtgccctattattggcttcagataccggtcgctgaaacatttcaattacgatatatgccaatcctgtttcttcagcgggagggttgctaagggacataagatgcactaccctatggtggaatattgcactcccacgacttcgggtgaggatgttcgcgacttcgccaaggtcttgaagaacaagtttcgcacgaagagatacttcgctaagcatccacgcatggggtatctccctgttcagaccgtcctcgagggagataatatggagacggataccatg

SEQ ID NO: 251284 - DNA, 3591 bp, Artificial Sequence
  Description of Artificial Sequence: Synthetic coding sequence
atgctgtggtgggaagaagtggaggattgttacgaaagggaagatgtgcagaaaaagacttttaccaagtgggtcaatgcacagttctccaagttcggaaagcaacacattgaaaatcttttctccgacctccaagatggccgccggcttctggacctgctcgaaggtttgactggtcagaagttgccaaaggaaaaaggatcgaccagagtccatgctcttaacaacgtgaacaaggccttgagggtgctgcaaaacaacaacgtggacctcgtgaatatcggctcgacggatattgtggatggcaaccacaagctgactctgggcctcatctggaacatcatcttgcactggcaggtcaagaacgtgatgaagaacattatggccgggctgcagcagactaacagcgagaagattcttttgtcctgggtgcgtcaatccacgagaaattacccgcaggtcaacgtgattaactttactacgtcttggtccgacggactggcccttaatgcactcatccattcgcacagaccagacctgtttgattggaattccgtcgtgtgtcagcagtcggcgactcagcgtctggagcacgccttcaatattgcccggtaccagttgggaatagaaaagctgctcgacccggaggatgttgataccacctacccagataagaaatcaatcctgatgtatatcacctcgctcttccaagtgcttcctcagcaagtatcaattgaagctattcaagaagtggaaatgctccctagacctccgaaggtcaccaaggaggaacatttccagctgcatcatcaaatgcattactcgcagcaaattactgtgtcgctggcacagggttacgaaagaacgtcgtcgcctaagccccggttcaagtcgtatgcatacactcaagcagcatacgtgaccacctcggatcctactcggtcccctttcccttcccaacatctggaggcaccagaagataagagctttggttcctctttgatggagtcggaggtgaacttggatagataccaaaccgcgctcgaagaggtgctttcctggttgctcagcgccgaagataccctgcaagctcaaggtgaaattagcaatgatgtcgaagtggtgaaggatcaattccacactcacgaaggttacatgatggacctcaccgcacatcaaggaagggttggaaatatcctgcaactcggctccaagctcattggcaccggtaaactttcggaggacgaggaaacggaagtgcaagagcagatgaatctgcttaacagccgatgggagtgtcttagagtcgcgtcgatggaaaaacaatcaaatcttcatcgtgtgcttatggacctgcaaaaccaaaaacttaaggagcttaacgattggctcaccaaaaccgaagaacgaactcgcaagatggaggaagaacctcttggtcctgaccttgaggaccttaagaggcaggtgcagcagcataaagtgctgcaagaagatctcgagcaagagcaggttcgcgtgaatagcctcacgcatatggtcgtggtggtggacgaatcatcgggggaccacgcaaccgctgcacttgaagagcaactgaaggtgcttggagataggtgggccaacatttgtcgctggactgaggatcgatgggtgttgctccaagatattcttctcaagtggcaacgacttactgaagaacagtgcctcttcagcgcctggctgtccgagaaggaagatgccgtgaacaaaattcacactaccggattcaaggaccaaaacgagatgctttcttcgctgcagaaactcgccgtgcttaaagcggatcttgagaagaagaagcagtctatgggaaaactgtattcacttaagcaggatctgttgtctaccttgaaaaacaagtccgttacgcaaaaaactgaagcctggctcgataacttcgcccgttgctgggataacctcgtccaaaagctggaaaagtccacggctcaaattagccaagcagtcaccaccacccagccatcactgacgcaaacgactgtgatggaaactgtgactaccgtcaccacgagggaacagatattggtgaagcatgcccaagaggaacttcctccacctcctccacaaaagaaacggcagattactgtcgataccctggagcggctgcaagaacttcaggaggcaaccgatgaactggatctgaagctccggcaagccgaagtgatcaagggatcgtggcagccagtcggtgaccttctgattgactcccttcaagatcatctggaaaaagtaaaagcactgcgcggggaaatagcaccgcttaaggagaacgtttcccatgtgaatgatctggcaagacaactgaccaccctggggatccaattgtcgccttacaacctgtcaaccctcgaagatcttaacacccgatggaaacttcttcaggttgcagtcgaggaccgggtgcggcagctgcatgaggcacatagagactttggacccgcatcccagcatttcctgtcgacctcggtccaagggccatgggaaagggcaatctccccaaacaaagtcccatactacattaaccatgaaacccaaaccacctgttgggaccatcctaaaatgactgaactttaccagtcgctggcagatctgaacaatgtgagatttagcgcgtacagaaccgccatgaaactgcgtcgacttcagaaagctctgtgtctggatctcctcagcctgagtgcagcgtgtgacgcactcgaccaacataacctcaaacagaatgaccagcccatggacattctgcagatcattaactgcctgactactatctacgaccgcctggaacaagaacacaacaacctggtgaatgtgcccctttgtgtcgatatgtgccttaattggctgctgaacgtctacgataccggacggaccgggaggatcagagtcctgtcatttaagacggggataatcagcctctgtaaggcacacctggaagataagtaccgttatctgtttaaacaagtcgcatcatcaaccggattctgtgaccagagaaggctgggtttgctcctgcatgattcaattcagataccacgccaactgggagaagtggcctccttcggaggttcgaacatagaaccctccgtccgttcctgtttccagttcgcaaacaataagcctgaaatcgaggcggccctttttctggattggatgagacttgaaccccagagcatggtgtggctcccagtcttgcaccgcgtagcagccgccgagactgcaaagcatcaggccaagtgtaacatttgtaaagagtgtcctatcatcggctttagatacaggagcttgaagcatttcaattacgatatctgccagtcatgcttcttttcgggtagagtagcaaagggtcacaagatgcactatcccatggtggagtactgtactcccacgactagcggtgaagatgtccgcgactttgccaaagtcttgaagaataagtttaggactaagcggtactttgcaaagcaccctcggatggggtacctgcccgtgcagactgtcctggagggagacaatatggaaactgataccatg

SEQ ID NO: 251285 - DNA, 3591 bp, Artificial Sequence; identical to SEQ ID NO: 251253
  Description of Artificial Sequence: Synthetic coding sequence

SEQ ID NO: 251286 - DNA, 3591 bp, Artificial Sequence
  Description of Artificial Sequence: Synthetic coding sequence
atgctctggtgggaggaggtggaggactgctacgagcgggaagatgtgcagaagaaaactttcactaaatgggtgaacgcgcaattttcgaagttcgggaagcaacacatcgagaatcttttctcagatctgcaagacggacgcagactgctggacctgcttgaaggtctgaccggacagaaactcccaaaggaaaaggggtcaactcgggttcacgcgctgaacaatgtgaacaaagcgctgcgggtgcttcaaaacaacaacgttgacctggtcaatataggatcgacggacatcgtcgatggaaaccacaagctgactctgggtttgatctggaatatcatcctccactggcaagtgaagaatgtgatgaagaatatcatggctgggcttcagcagactaattctgagaagatcctgctgagctgggtgaggcaatccactcgcaactaccctcaagtcaacgtcatcaatttcactacctcgtggtcagacggactggccctcaacgctctcatccactcacaccggccggacctgtttgactggaactccgtggtgtgccagcagtcagcgactcaacgcttggaacacgctttcaacattgcgagataccagctcggtatcgaaaagctcctggacccagaggatgtggatacgacgtatccggacaaaaagtccatccttatgtacatcacctcattgttccaggtgcttccacagcaggtttcgatcgaagcaatccaagaggtcgagatgttgcctcggccgccgaaagtgaccaaagaggaacacttccagctccaccatcagatgcactactcccagcagattaccgtgtccctggcgcagggatacgagagaacctcgagccctaagccacggttcaagtcgtacgcctacacgcaagcggcctacgttactacctcggatccgacccgcagccctttcccctcgcaacatctggaagctcccgaagataaatcgttcgggtcgagcttgatggaatccgaagtgaatttggaccgctaccagactgcactggaggaggtcctgagctggctgctgtcagctgaggacacgctgcaagcccagggcgagatctcgaatgacgtcgaagtggtcaaggaccagttccacactcatgaaggatacatgatggaccttactgcccaccagggcagagttggtaacatactccagttgggatcgaagctcatcggaaccggaaaactctccgaagatgaggaaaccgaagtgcaggaacagatgaacctccttaactcaaggtgggaatgcctcagagtcgcatcgatggaaaaacaatccaatttgcatcgcgtgcttatggatctccagaatcagaaactgaaggagctgaatgattggctgactaagaccgaggagcggacgcggaagatggaggaggaaccgctggggccggaccttgaggatctgaagaggcaggtccaacagcacaaagtcctccaagaagatctcgaacaagagcaggtgagggtgaattccctgacgcatatggtggtcgtcgtggacgaatctagcggcgaccacgccaccgccgcgcttgaggagcaactgaaggtgctgggcgaccggtgggcaaatatctgccggtggactgaagataggtgggtgttgctccaggacattctgctgaagtggcaacggctgaccgaagagcagtgcttgttttcggcgtggctctccgagaaggaagatgccgtgaataagattcacaccaccggctttaaagaccaaaacgaaatgctgtcgagccttcaaaagttggccgtgctgaaagccgatctcgaaaagaagaagcagtcaatgggaaagctctattctctcaagcaggacctgctgtccactctgaagaacaaatctgtgacgcaaaagaccgaagcatggctcgacaactttgctcgctgctgggataacctcgtccagaagctggagaaaagcaccgcacagatatcgcaggctgtgacgaccactcagccatccttgactcagaccactgtgatggaaaccgtcactaccgtgactacccgggagcaaatcctggtgaagcatgcgcaagaagagctgccgccacctccgccccagaagaagcgtcagatcactgtggacactctggagcgacttcaggagctgcaagaagcgactgacgaattggacctgaagctgcgccaggccgaggtgatcaaaggatcgtggcaaccggtgggagatctgctgatcgactcgctgcaggatcatcttgaaaaagtcaaggcgctcagaggagaaatcgccccgcttaaagaaaatgtgtcccacgtgaacgacttggctcgacagctcactactctgggaattcagttgtcgccttacaacctctccacccttgaagatctcaacactagatggaagctcctccaagtggctgtggaggatcgcgtgaggcagctgcacgaggcccatcgcgatttcggcccagcatctcagcatttcctgtcgacgtcggtccagggcccgtgggagcgggcaatcagccctaacaaagtgccatactacatcaatcatgagacgcagactacttgttgggaccacccaaagatgaccgaactgtatcaaagcctggccgacttgaacaacgtgcgcttctcagcctaccgcaccgccatgaagctgcggaggctccagaaagcgctgtgtcttgatctcttgtcactctcagcagcatgcgacgcactggaccagcacaatctgaagcagaacgaccaaccgatggacattctccagattatcaactgcctgaccactatctacgatcgcctggaacaggagcataacaatttggttaacgtcccgctgtgcgtcgacatgtgcctgaattggctgttgaacgtctacgatactggccgcaccggacgaatccgggtgctctcctttaagaccggaatcatcagcctctgcaaagcgcatctggaagataagtataggtacctgttcaagcaggtggccagcagcaccggcttctgcgatcagagacggctgggattgctcctgcacgattctattcagatacccagacaactgggggaggtcgcatcctttggaggttcaaacatcgaaccgtctgtccggagctgtttccagtttgccaacaataagcccgaaatcgaagcggcactgttcctggattggatgcggttggagccacaatcaatggtgtggttgccggtgctgcacagagtcgccgcagctgaaaccgccaagcatcaagccaagtgcaacatctgcaaagaatgcccaatcatcgggtttcgctaccgctcactcaagcactttaactacgatatctgccaaagctgtttcttctcgggacgggtggctaaaggccacaagatgcactacccgatggtggagtactgtacgcccactacctccggcgaggacgtgcgggactttgcaaaggtgctcaagaataagttccgcacgaagaggtacttcgctaagcatcctcggatgggatacctcccggtgcaaactgtccttgaaggagacaacatggaaaccgatacgatg

SEQ ID NO: 251287 - DNA, 3591 bp, Artificial Sequence
  Description of Artificial Sequence: Synthetic coding sequence
atgttatggtgggaagaagtggaggattgctacgagcgtgaggatgttcaaaaaaagactttcacaaaatgggtcaacgcacaattcagcaaattcggaaaacaacatatcgaaaacctcttctccgacctccaggacggccggagattactggatctgctcgaaggcctgactggccaaaaactgcctaaggagaagggatccacaagggtccatgccctcaacaacgtcaacaaagccctgcgggtgctccagaataataacgtggacctggtcaacatcggctccacagatatagtggatggtaatcacaaattgaccctgggcttaatctggaacatcatcctccactggcaggtgaaaaatgtgatgaagaatattatggctggcttgcaacagacgaattctgaaaagatcctgctgtcctgggtgcgccagagcacacgtaactatccccaagttaatgtcatcaacttcaccacttcatggtccgacgggctggccttgaacgcactgatacacagccaccgacccgatctttttgattggaactcggtggtgtgtcagcagagcgccactcagaggctcgagcatgcctttaacattgcaaggtatcaactcggcatagagaagctgctggacccagaagatgtcgataccacttatcctgacaaaaaaagcatactaatgtatatcaccagcctgtttcaggtcttgccccagcaggtctccatagaggcaatccaggaagtggagatgcttccaaggcccccaaaagttacaaaagaggaacatttccagttacatcatcagatgcactatagccagcaaattaccgtctccctagctcagggctatgaaagaacatcctcacctaagcctagattcaagtcctacgcctatacgcaggccgcttacgtgaccactagcgatccgacccgatctccatttccctcccagcacttagaggcaccagaggacaagagtttcggttcatccctgatggaatccgaagtcaatttagacagataccagaccgctctggaggaagtactctcctggctgctgtcagcggaagacaccctgcaggctcagggagaaataagtaacgatgtggaagttgtcaaagaccagttccatactcatgagggatacatgatggacctgacggcacaccagggccgtgtgggcaatatcctacagctgggatcaaaattgatcggaacaggaaagctctccgaagatgaagaaactgaagtccaggaacaaatgaatttgctgaattcacgctgggagtgtctccgggtggcctccatggagaagcagagtaacctccaccgcgttctcatggatcttcagaatcagaagctcaaggaactcaacgactggcttaccaagacggaggagcgtacccgcaaaatggaggaagaacctctgggacctgacctggaggatctgaagaggcaggtccagcagcataaagtacttcaagaggatctcgaacaggagcaggttcgggtcaatagcctgacccacatggttgtggtcgtggacgagagcagcggggatcacgcaacagccgctttggaagaacaactaaaagtcctgggcgaccggtgggctaacatatgccgctggactgaggatagatgggtgttgcttcaggacattctgctcaagtggcagcgcctgacagaggagcagtgcctgttctctgcctggctgtctgaaaaagaggatgctgttaataagatccatactacgggtttcaaggatcagaacgaaatgctgagctctcttcagaagctagctgtgctaaaagctgatctggaaaagaagaaacaatccatgggcaaattatactcactgaaacaagaccttctgtctactctgaaaaataagagcgtgactcaaaaaacggaagcctggctagataactttgcccggtgttgggataatctggtacaaaagctggagaagagtactgcccagatatcccaggcagtcactaccactcaaccttcacttacgcaaacgactgtgatggagaccgtcacgactgtgaccaccagagaacaaattttggttaagcacgctcaggaggaactcccacccccgcctccacagaagaaaaggcaaattactgtggacacacttgagcgtttgcaggaactgcaggaagccacggacgaacttgacctcaaactgcggcaagccgaggtcataaagggctcttggcagccagtcggtgacctcctaattgattcccttcaagatcaccttgaaaaggttaaggcattgagaggcgaaatcgcacctctaaaagagaatgtaagccatgtgaatgatctggcccgccaactaacaacactcggcattcagctttccccttataatctgagtaccctggaggatctgaacactcgctggaagctgctgcaagtggccgtggaggatagagtaaggcagcttcacgaagcgcacagagattttggaccagcttcacagcatttcttgtcaacatcagtccaggggccatgggaacgtgctatctcacctaataaggtgccatactacatcaatcatgaaacccaaacaacctgctgggatcatcccaagatgacagaactgtaccagagtctggctgatctgaataacgtgaggttcagcgcctatcggacggcaatgaagctgagacgcctgcagaaggctctctgtctggatctgctcagcctatcagcggcttgtgacgccttggaccagcataaccttaagcaaaatgaccagccaatggatatcctgcagatcattaattgcctcaccaccatctacgacagactggagcaagaacacaacaacttggtgaatgtaccattgtgcgtggatatgtgcctgaattggctgttgaacgtatatgatactggccgcacaggacgaatcagggtgctctcttttaagacaggaatcatctctctgtgcaaggcacacctggaggacaagtaccgttacctgtttaagcaggtcgctagcagcaccggattctgtgatcaacgacggctcggtctgctcttacacgactcaattcagattccacggcagctgggagaagtggcctcctttgggggcagtaacattgagccatctgtcagatcttgtttccagttcgccaataataaacctgaaattgaggcagcgctgttcctggattggatgcggttggagccccagagtatggtgtggcttcccgtgctgcaccgcgtggcggcagccgagacagcaaaacatcaggccaagtgcaacatttgcaaggaatgccctataattggtttccggtatagatcccttaagcattttaactatgatatatgccaaagttgtttcttctctgggagagtagctaagggacataaaatgcactatcccatggttgagtattgtactccaactaccagcggtgaggatgttagggacttcgcaaaggtgttaaagaacaagttccgcaccaaaaggtacttcgccaaacatcctcggatgggctatctgcccgtgcaaacggtgctggagggcgacaatatggaaacggacaccatg

SEQ ID NO: 251288 - DNA, 3591 bp, Artificial Sequence
  Description of Artificial Sequence: Synthetic coding sequence
atgttgtggtgggaggaggttgaggactgttacgagagggaagacgtgcaaaagaagaccttcacgaagtgggtgaacgctcagttcagtaaatttggcaagcaacacatagagaaccttttctccgatctgcaggacggtagacggctactagacctcctagaagggctcactggccaaaagctccccaaagagaaaggaagtacccgagtgcatgcacttaacaatgtaaataaagccctgagagtgctgcagaataacaatgttgatcttgtcaacattggctccacagatatagtggacgggaaccataagttaaccttggggctgatatggaatattatcctccattggcaggtgaagaatgttatgaaaaacattatggcagggctgcagcaaaccaatagtgagaagattctgttatcttgggtgagacagagcacacgtaattatcctcaggtgaacgttattaattttacaacatcctggtccgacggcctagcactgaacgccttaatccacagtcaccgcccagacctttttgactggaactcagttgtctgtcagcagtctgccacgcagaggcttgagcatgcattcaacattgccaggtaccaactgggaatcgagaagctgctggatcctgaggatgtggatacgacttatcccgataagaaatctattctcatgtacatcacgtccctatttcaggtgctgcctcagcaagtgtctatcgaagccatccaggaggtggaaatgctgcccaggcctcctaaggtcacaaaggaggagcactttcagctgcaccaccagatgcactatagccagcaaataacggtctcgctagctcagggttacgagagaacatcgtccccaaagccgcgatttaagagctatgcttacacacaagcagcatatgtcactacatccgaccccactcgatcccccttcccttcacagcacttagaggcccctgaagataagtcgtttggctctagccttatggagagtgaggtaaacctcgatcggtatcagactgcactggaggaagtgctttcttggctgctgagtgcagaagatactctgcaggcacagggggagattagtaatgatgtggaagtggtaaaagatcagttccacactcatgaggggtacatgatggatctcactgcccaccaggggcgggtcgggaacatcttgcagttgggaagtaagctgataggcactgggaagttgtctgaggacgaagaaacagaagtgcaagagcagatgaacctcctgaactcccgctgggagtgtctgcgagtagcctctatggagaaacagagcaatctgcaccgtgttttaatggacctgcagaatcaaaagctgaaggagctcaacgactggttgacaaagacagaggaacggacccggaaaatggaggaagaacccctgggtcccgacttagaggatttgaaacgccaggtgcagcagcacaaagtgctgcaggaagacttggaacaggagcaggtccgagtgaactcactgacccatatggttgtagtggtcgacgagagctccggagatcatgctaccgctgccttggaggagcagctcaaagtgttaggggacaggtgggcaaacatttgccgctggaccgaagataggtgggtgttgctccaggatattctgctgaagtggcagaggctcaccgaggaacagtgtctgttctccgcatggctttctgagaaagaggacgcggtgaataaaattcacaccaccggcttcaaagatcagaacgaaatgttgagttccctgcagaagttagcagtcttaaaagccgacttggagaagaaaaaacagtccatgggcaaactgtattctttaaagcaggatctactgtcaaccctgaagaataaatctgttactcagaagaccgaagcttggcttgataactttgcccggtgctgggataacctcgtccagaaacttgagaagagcaccgctcagatatctcaggcagtgactaccacacaaccatcactgacccaaactacagtcatggagaccgtgacaaccgttacaacccgcgagcaaatcctggttaaacacgcacaagaggaactaccgccaccaccgccacagaaaaagaggcagatcactgtcgatacgctcgaacggttgcaggaactgcaggaggccaccgatgaactggacctgaagctgaggcaggctgaagttatcaagggatcctggcagccagtcggggatctgctgattgacagtctgcaagaccacctggagaaggtcaaggcactaaggggcgaaatcgcccccctcaaggagaatgtgtcacacgttaacgacctggcgcggcaacttaccacactgggtattcaactgagcccatacaacctgtccaccctcgaggacctgaatacacgctggaaactgctgcaagttgccgtggaagatagagtgcgacaactacacgaggcacatagagactttgggccagccagccagcatttcctctcaacaagcgtgcaaggcccatgggaacgtgccatctcacccaataaagtcccgtactacataaaccacgagacccaaacaacatgttgggatcaccctaaaatgaccgagctgtatcagtccctggcggatttgaataacgtccgtttcagcgcctaccggactgcgatgaagttaaggcggctgcagaaagcactgtgtctggacctcctctctctcagcgccgcctgtgacgcacttgaccagcataatcttaaacagaacgaccagcccatggacatcctacagatcataaactgtcttacaactatctacgaccggcttgagcaggagcacaataatctagtcaacgtgcctttatgtgtggatatgtgtctgaattggcttctgaacgtgtacgacacaggtcgcacgggcagaatcagggtgttatcattcaaaacgggaatcatctctctctgtaaggctcacctagaggacaagtatagatatctcttcaagcaggtcgcatcgtccaccggattttgtgaccagaggcgattggggctcctgctccacgattctatacagatcccacgacagttaggagaagtggccagcttcggtggctcaaacatcgagccatcggtgaggtcatgctttcaatttgccaataataagcccgagattgaggcggcactttttctcgattggatgcgcctggagccccagtctatggtatggttacctgtgctgcaccgcgtcgccgctgctgagacagccaaacaccaggcaaaatgcaacatttgtaaagaatgccccattatcggattcaggtatagatctttaaaacactttaactatgacatctgtcagtcctgtttctttagcggcagagttgctaagggtcacaaaatgcactaccctatggtcgagtactgtacccctactacatcaggcgaggatgtgcgcgattttgctaaggtcctgaagaacaagttcagaactaagcgctattttgctaaacacccccgcatgggctatcttccagtccagaccgttctggagggtgacaatatggagacagatacaatg

SEQ ID NO: 251289 - DNA, 3591 bp, Artificial Sequence
  Description of Artificial Sequence: Synthetic coding sequence
atgctttggtgggaagaagtggaagattgctatgagcgcgaagatgtgcaaaagaaaacgtttaccaagtgggtcaatgcgcagtttagcaagtttggtaagcagcatatcgaaaacctcttttccgatctccaggatgggcggcggctgcttgatcttctggaaggtctgactggacaaaaactgccaaaggaaaagggttcgactagagtgcatgctctgaataatgtcaacaaagctcttagggtgcttcagaataacaacgttgatcttgtcaatataggtagcactgatattgtggatggaaaccacaaactcactttgggtctgatatggaacattatcctccattggcaagtgaagaacgttatgaaaaacatcatggcgggacttcaacaaaccaactcagaaaagatacttctgtcctgggtgagacagtctactagaaactacccccaagtcaatgtgattaacttcaccacttcctggtccgatgggctggcactcaatgcgcttattcactcgcatagaccagacttgtttgattggaactccgtggtctgccagcaaagcgcaacccaacgtctggaacatgcatttaacatcgcacgataccaacttggtatcgaaaagctgttggaccccgaggacgtggataccacctaccctgataagaaatcaatactcatgtacataacttccctgtttcaggtcctcccccagcaagtcagcattgaagccatacaagaagtggaaatgctgccccggccacccaaagtcactaaagaggaacattttcaactccatcatcaaatgcactacagccaacagatcaccgtgtccctcgcacaagggtacgagcgtacttcgtcgccaaaacctagatttaagtcctacgcctacacgcaggcggcatacgtcaccacttcggatcctaccaggtcccctttcccgagccaacatctggaagcacctgaggacaaatccttcggctcgagcctgatggaatccgaggtgaacctggatcgttaccagaccgcactggaagaagtcctgtcttggctgttgagcgctgaggacaccctccaagcacaaggcgaaatttcgaacgacgtggaagtcgtgaaggatcaattccatacgcatgaaggctacatgatggacctgaccgctcatcagggacgagttggtaacattctgcagttggggtccaaactcattgggactggtaagttgtcagaggacgaagagactgaggtgcaagagcaaatgaacttgctcaattcgaggtgggaatgtctgagagtcgcatcgatggagaagcagtcgaacttgcatcgggtcctgatggacctccagaaccagaagctgaaggagttgaacgattggctgaccaagacggaagaacgcacccgtaaaatggaagaagaacctctgggccctgacctggaagatctcaaaagacaagtccaacaacataaggtgttgcaggaagatctcgagcaggaacaagtcagagtgaactcgctgacccacatggtggtcgtggtcgatgagtcctcgggggatcatgccaccgccgcacttgaggagcaacttaaggtgctgggtgatcgctgggcaaacatctgccggtggaccgaagatcggtgggtgctcttgcaagatattctgcttaagtggcagcgtctgactgaagaacagtgtcttttcagcgcatggcttagcgaaaaggaggatgcggtgaacaagatccacacgacgggatttaaggatcagaacgaaatgctgagctctctgcagaaactggcagtccttaaagcagatctcgagaagaagaagcaaagcatgggtaaactctattccctcaagcaagatctgctttccactctcaaaaacaagtcagtcactcaaaaaaccgaagcgtggctcgacaacttcgcaagatgttgggacaacctggtccaaaagctcgaaaagtccaccgcccaaatatcccaggccgtcaccactacccagccatcgctcactcagactactgtcatggaaaccgtcactacggtgactaccagagaacagatccttgtgaaacacgcccaggaagaacttccaccacctccaccacaaaagaagaggcaaataactgtcgacactcttgaacgcctgcaggagcttcaggaggcaaccgatgaactggatctgaagctgcggcaagcggaagtgattaagggatcctggcaacccgtgggtgaccttcttattgactccctgcaggaccacctcgaaaaggtcaaagcattgagaggggaaattgcacctctgaaggaaaatgtgtcgcatgtgaacgatctggcgcgtcaactcacgactcttggaatccagttgtcgccttacaatctgtcgacccttgaagatcttaacaccagatggaagctccttcaggtggccgtggaagatcgagtgagacaacttcatgaagcccacagggattttggcccagcatcgcaacactttctgtccactagcgtccaaggtccatgggaaagggcaatctccccgaacaaggtcccttactatatcaaccacgagactcaaactacttgttgggatcatcctaagatgacggagctgtaccagtcactggcggatctgaacaatgtgcggttttccgcatacagaaccgcaatgaagctgcgtagactgcaaaaggcactgtgtctggatctgctgtcgctctccgcagcctgtgatgcactcgatcagcataaccttaagcagaacgaccagcccatggatattctgcagatcataaactgtctcaccaccatctacgatagactggaacaggaacataacaatctggtgaatgtgcccctttgtgtggatatgtgcctgaactggctgctgaacgtgtacgataccgggaggaccggtcgcatcagggtgctgtcgttcaaaaccggaattatctccttgtgtaaggcccaccttgaggacaaatatcgttaccttttcaagcaagtggcttcatcaaccggattttgtgaccaacgtagactggggcttctgttgcatgattcaattcagattcctcgacagctgggtgaagtggcatcgttcggagggtcgaatattgagccgtctgtgagaagctgttttcagttcgccaacaataagccagaaattgaagcagcgctgtttttggattggatgcggcttgaaccccaatcaatggtgtggctgccagtgctccaccgggtggctgcagctgaaaccgcaaaacatcaagcaaagtgtaacatctgcaaagagtgcccaattatcggatttcggtaccgatcactgaagcactttaactatgatatttgccagtcgtgttttttctcaggcagagtcgcaaagggccacaagatgcactacccaatggtggagtactgtaccccaaccacttccggtgaagatgtcagagattttgccaaggtgctgaagaacaagtttcgaactaaacgttactttgctaagcatcctcgcatgggatacctgcccgtgcagaccgttctcgaaggcgacaatatggaaaccgacacgatg

SEQ ID NO: 251290 - DNA, 3591 bp, Artificial Sequence
  Description of Artificial Sequence: Synthetic coding sequence
atgctgtggtgggaagaggtagaggactgttatgagagggaagacgtccagaagaaaacttttacgaagtgggtgaacgcacagtttagtaagttcggcaaacagcacattgagaatctgttttctgatctgcaggatgggcgacggctcctagatctcctggagggactgactggtcaaaagctgcctaaggagaagggatccacgcgtgtccatgctttaaacaatgtgaataaggccttacgtgttctccagaataataatgtagatttggtaaacatcggaagcactgatatcgttgatgggaaccataagctgacgctgggcctgatttggaacatcattctgcactggcaggtgaagaatgtgatgaaaaacatcatggcgggattgcaacagacaaacagcgagaaaattttgttgagttgggtgagacaatcaaccagaaactacccccaggttaacgtgataaatttcaccacaagttggagtgatggattagcgctgaacgcattgattcacagccacaggccggatctgtttgattggaattccgtagtatgccagcagagcgcaactcagcgcctggagcatgcttttaatatcgcaaggtaccaactgggcattgagaaactgctcgacccagaggacgttgatacaacctaccccgacaagaagagcattctgatgtacataacgtccctgtttcaggtcctcccacaacaggtgtcaatcgaggctatccaggaggtcgaaatgctaccaagaccaccaaaagtgactaaagaggagcacttccagctccaccatcagatgcactactcccagcagatcacggtctctctggctcagggctacgagaggacatcctctccgaaacctaggtttaagagttatgcttacacacaggccgcctatgtgacaacgagcgatcccacaaggtccccctttcctagccagcacctggaagccccagaagacaaatcttttggcagttccctgatggagtcagaggtcaatctcgatcggtaccagactgcattggaggaggttttgtcctggctcctgagcgccgaggacactctccaggcccagggagaaataagcaatgatgtggaagttgtcaaggatcagttccatacccatgaggggtacatgatggacctgacagcacaccagggaagggtggggaacattctgcaactggggagcaaattgattggcaccggtaaattgtctgaggatgaggagacagaggtccaagagcagatgaatctactgaattcaagatgggagtgcctcagagtcgcatcaatggaaaaacagtcaaaccttcatagggtgctgatggacctccaaaatcagaagttgaaggaactgaacgactggctaactaaaaccgaggagcgtaccaggaaaatggaggaggaaccactgggccctgatctcgaagacctcaagcgccaggttcaacagcacaaggtccttcaggaagatctcgagcaagaacaggtgcgggtcaacagccttactcacatggtggtggtggtagatgagtcctcaggcgatcacgccaccgcagcgctggaagaacagctaaaggttctgggggaccgttgggccaacatttgccggtggactgaggatagatgggtcctgctgcaggatattcttctcaaatggcaacggctaacagaagagcagtgcctctttagtgcctggctctcggaaaaggaagacgccgttaataagattcacaccaccggatttaaggaccagaatgagatgctttcatctcttcagaaactggctgtgctaaaagccgatcttgaaaagaagaagcagtctatgggcaagttgtactcactgaaacaagatctcctctccaccctgaagaacaaatcagtaacccagaaaaccgaagcctggcttgacaacttcgccagatgttgggacaacctggtacagaagctggaaaagtctaccgcccagatatctcaggcagtcactactactcaacccagcctcacccagactacggtcatggaaactgtgaccactgtgaccactcgggagcagatcttggtgaaacatgcgcaggaagagctgccccctccaccaccccagaaaaagcgtcaaatcacagttgacacactcgagcggctgcaagaacttcaggaagcaacagacgagctggatctgaagctgcgccaagctgaggtgattaaaggatcatggcagcctgtgggagacctgcttatcgactctctgcaggatcatctggaaaaagttaaggcactgaggggtgagatcgcacctctcaaggagaatgtcagccatgtgaatgatctggcacgacagctcacaacacttggcatacagctttctccctacaatctctctactctggaggacttgaataccagatggaaacttttacaggtcgccgtggaagaccgggttagacagttgcacgaggctcaccgagacttcggccctgcgtctcagcattttctgtccactagcgtgcagggcccatgggaaagggccatttctcctaacaaagtcccatactatataaatcacgagacccagactacctgttgggaccaccccaagatgactgaactgtaccagagcctcgccgacctcaataacgtcagattctcagcatatcggactgccatgaagctccgtaggctacaaaaggcgctctgtctagatctgctgagtctgagtgcagcctgtgacgctttggatcagcacaaccttaagcagaacgaccagcctatggatatcctgcagatcatcaattgtttaacaacaatctacgatagactagaacaggagcataataatctcgtgaacgtgccactctgcgtcgacatgtgtctgaactggctgctgaacgtatacgacactggccgaaccggtagaatccgcgtgctgtcattcaaaaccggcatcatttctctttgcaaagcgcacttagaggacaagtaccggtacctgttcaaacaggtcgcttctagcaccgggttttgcgatcaaagaaggttaggcctcctcttgcacgattcaatccagattccaaggcagctcggtgaggtggcatccttcggaggctccaatattgagccgagtgtgagatcatgctttcagttcgccaataacaagcctgaaatcgaggctgcattgttcctcgactggatgcgtttggaaccccaatctatggtttggctgcccgtgctacacagggtagccgctgccgaaactgccaagcatcaggccaagtgcaacatctgcaaagaatgccctattatcggtttccggtacagaagccttaagcactttaattacgacatctgccaaagctgtttcttcagcggcagagtcgcaaaaggccacaaaatgcattaccctatggtggagtactgcacccctactaccagcggagaagatgttcgcgattttgcaaaagtgctgaagaacaaattcaggacgaagaggtatttcgcaaaacaccctcgcatgggatatctgcctgtccagactgtgcttgagggcgacaatatggagacggacacaatg

SEQ ID NO: 251291 - DNA, 3591 bp, Artificial Sequence
  Description of Artificial Sequence: Synthetic coding sequence
atgttgtggtgggaggaggtcgaagactgctacgaaagggaagacgttcaaaaaaagacttttactaaatgggtgaatgctcagttttccaagtttggaaaacagcacatcgagaacttgttctccgacctgcaggacggcaggcgcctcttggacctgttggaaggtttgacaggtcagaagctgcctaaagagaagggatccactagggtgcacgctcttaataacgtgaacaaagccctcagggtgcttcagaataataacgtggatttggtgaacatcggaagcaccgatattgtcgacggtaaccacaagctgacactgggactcatttggaatattatactccactggcaggtcaagaatgtgatgaagaatatcatggccggtttgcagcagaccaatagcgagaagattctcctgtcatgggtgcgccagtctactaggaactatccccaggtgaacgtcattaactttaccacctcttggtctgacggcctcgctctgaacgcacttatccattcccatagacccgatttgttcgactggaattctgttgtgtgccagcagtctgcaacccagaggcttgagcacgcttttaatatcgctcgttaccagctgggtatcgaaaagctgttggaccccgaagatgtcgataccacctaccccgataagaagtccatcttgatgtatatcaccagtctcttccaagtgcttccccagcaagtgtccattgaagctattcaagaagtggagatgctgcccaggccacctaaggtaactaaagaagagcatttccagcttcaccatcagatgcactatagccaacagattaccgtttctttggcccagggatacgagcgcaccagctctcccaagccaagattcaaatcctacgcctacacccaagctgcctacgtaactacctccgaccctacaagatctccatttccaagtcagcacctcgaagcccccgaggacaagagttttggaagttcactcatggaatccgaggtgaacctggacaggtaccaaactgctttggaggaggttctttcctggctgttgagcgcagaagacaccctccaggcccagggtgaaatttctaacgatgttgaagttgtcaaggaccagttccacacccatgagggctacatgatggatctcactgcccaccaaggcagggttggcaacattttgcaattgggcagtaagctgattggtactggcaagctgagtgaagatgaagaaaccgaggtgcaggagcagatgaatctcctcaactcacgctgggagtgcttgagagttgccagcatggagaagcaaagcaacctgcaccgcgttttgatggacctgcaaaaccagaagttgaaggagctcaacgactggctgaccaagactgaggagagaactagaaaaatggaagaagagccactgggccctgatcttgaggacctgaaaaggcaggtgcagcaacacaaagtactgcaggaagacctggagcaggagcaggtccgcgtcaatagccttacccacatggttgtggtcgtcgacgagagctcaggcgaccatgctactgctgccctcgaagaacagttgaaggtgcttggtgaccgctgggccaatatatgtaggtggaccgaagatcgctgggtactcctgcaggacattcttctcaagtggcagcgcctcaccgaagagcagtgcctttttagcgcatggctgagcgagaaggaggatgccgtcaacaaaattcatacaaccggatttaaggaccagaacgaaatgctctcttcactccaaaagcttgctgtcctgaaggccgatttggagaagaaaaaacagtctatgggtaagctgtattccctgaagcaggacttgctcagcaccctgaagaacaagagcgtgacacagaagaccgaggcttggctggataacttcgccagatgctgggataatctggtccagaagctggagaaatcaaccgcacagatctcacaggctgtaacaactacccagccaagcctgacccagaccacagtgatggagacagtgacaactgtcaccactagggagcagatccttgtgaagcacgcccaggaggaactgccccccccccctccacagaagaagcgccaaattaccgtggacactctcgagagattgcaagagctccaggaagcaaccgacgaattggaccttaaactccgtcaggcagaagtgattaaaggtagttggcaacctgtgggagatctgttgattgacagtctccaggaccacctggagaaggtgaaggccctgagaggtgaaatagctcctctcaaagagaatgtgtcacacgttaacgatttggccaggcagttgaccacactcggcatccagctcagcccctacaatttgtccactctggaagatctcaacactcgctggaagctgcttcaggtagcagttgaggaccgcgtaagacaacttcatgaggcacaccgcgacttcggacctgcctctcagcactttctctcaaccagtgtgcagggcccctgggaacgtgccatttcaccaaacaaagtcccctattacattaatcatgagacccaaaccacttgctgggaccatcccaagatgactgagctttaccaatccctggcagacctgaacaacgtgcgcttttccgcctacagaaccgcaatgaaactgaggaggcttcagaaggccctctgcctggatctcctgagcctgtccgccgcctgtgacgccctggaccaacacaacctcaaacaaaatgaccagcctatggatatacttcaaatcatcaattgtctcactaccatatacgatcgcctcgagcaagagcacaacaaccttgtgaatgtccctctgtgtgtggacatgtgcctgaattggctgctcaacgtctacgacaccggacgcacaggtcgtatccgcgtgttgagcttcaagactggtatcatctctctgtgcaaggcccatctcgaagataaatatcgttacctctttaagcaggttgctagtagcacaggtttctgtgaccagaggaggttgggactgctgctgcacgacagtatccagatccctaggcagttgggtgaggtcgcctcttttggaggctcaaacattgaaccaagtgtacgctcttgtttccagtttgcaaataacaaacccgaaattgaggccgcactgttcttggactggatgagactcgagccacaatccatggtgtggcttccagtcttgcacagagtggctgcagcagaaactgccaagcaccaggcaaagtgcaacatctgtaaggagtgccccatcattggttttcgctacaggtccctgaaacatttcaactacgacatctgccagtcatgttttttctccggtagagtcgcaaagggtcacaaaatgcattatcccatggtggagtattgcactcccacaacaagcggcgaagacgtccgcgacttcgcaaaagtgcttaagaacaagttccgcaccaagagatactttgcaaaacatcccagaatgggatatctgcccgtccaaactgtcctggagggagataatatggaaaccgatactatg

SEQ ID NO: 251292 - DNA, 3591 bp, Artificial Sequence
  Description of Artificial Sequence: Synthetic coding sequence
atgctttggtgggaagaagtggaggactgttacgaacgtgaggatgtgcaaaagaaaacgttcaccaagtgggtgaacgcacaattttccaagttcggtaagcaacatattgagaacttgttctccgaccttcaagatgggagacgattgctggatctccttgagggactcactggtcagaagctgccgaaagagaaaggtagcacccgcgtgcatgcactgaataatgtcaacaaggcgctgagagtgctgcaaaacaataatgtggatcttgtgaacatcggatcgaccgacatcgtggatggaaaccacaagctgaccctcggactgatctggaacattatcctccattggcaggtcaagaacgtgatgaagaacattatggccggccttcaacagaccaattccgaaaagattctcctgagctgggtgcgccaatcgaccaggaactaccctcaagtgaacgtgattaactttactacctcctggtcagacggtcttgcgctgaacgcactcatccattcgcaccggcctgaccttttcgattggaattccgtggtttgtcagcaatcagctactcagcggctcgaacatgcattcaacatcgcaagataccaactgggtattgagaaattgttggatccagaggacgtggataccacctacccggataagaagtccattctcatgtacattacttcgctctttcaggtgctccctcagcaagtcagcatagaagcaatccaagaagtggaaatgcttccccgtccgccaaaggtgacgaaggaagaacatttccaactccatcaccagatgcactattcacaacaaattaccgtgtcgctcgcacagggatacgaacgaacctcgagccctaagcctaggttcaagtcatacgcatacacgcaggcagcctacgtcacgactagcgatcccactaggtcgcctttccctagccagcacctggaggcgcctgaagataaatcgtttggcagttcactgatggaatcagaagtcaatctggatcgttaccaaaccgccctcgaagaagtgctgtcctggctcctgtcggcggaagatactctgcaagcgcaaggagaaatttctaacgacgtggaggtggtcaaggaccaattccacacccacgaaggatacatgatggacctgaccgcacatcaaggaagagtggggaatattctccaactcggatcaaaactcatcggcacgggaaagctcagcgaagatgaggaaactgaagtgcaagagcagatgaacctcctcaactctaggtgggaatgtctcagagtggcatctatggaaaaacagtccaatctccatagggtccttatggatcttcaaaaccaaaagctcaaggaacttaacgactggctcactaagaccgaggaacggacccgcaaaatggaagaggagcctttgggtcctgacctcgaagatcttaagcgacaggtgcaacagcataaagtccttcaagaagatctggaacaggaacaggtgagggtgaattcccttacccacatggttgtggtggtggacgaatcgagcggcgaccatgcaaccgctgcgctcgaagagcaactgaaggtcctgggcgatagatgggcaaacatttgtagatggaccgaagatcgatgggtgctgctgcaagacattctgttgaagtggcaacgccttactgaagaacagtgcctgttctcggcatggctgtccgaaaaggaagatgcggtgaacaagatacataccaccggatttaaggatcaaaatgaaatgctgtcaagccttcaaaaacttgccgtgctgaaggcagatctcgagaagaaaaaacaatcgatgggcaaactgtactcgctgaaacaggatctgctgtccaccttgaaaaacaagagcgtgacgcagaaaaccgaagcatggcttgacaatttcgcaagatgttgggataatctggtccaaaagttggaaaagtcaactgcacagatcagtcaagcagtcactaccacccagccctcacttactcagaccaccgtgatggaaaccgtaaccaccgttaccactagagagcagattctcgtcaagcatgcacaagaagaacttcctcctccacctcctcagaagaagcggcagattactgtggatacccttgagcgcctccaggaactccaagaagcaaccgacgaacttgacctgaagctccgccaagcagaagtgattaagggatcatggcagcctgtcggggacctgctgattgattcacttcaggaccatctcgaaaaggtgaaagcacttagaggggagattgcacctctgaaagaaaacgtgtctcatgtgaacgatttggcgcggcagctgactacccttggcattcaactctccccttacaacctgtccactctggaggatctgaacactcgatggaagctcctccaggtggccgtcgaagatagggttcggcaactccatgaagcacatcgggactttggtcccgcctcccaacactttctctcgacctcagtgcaaggaccctgggaaagggcaatctcacctaataaggtgccttattacattaatcacgagactcagaccacttgttgggatcatccaaaaatgaccgagctgtaccagtccctggcagaccttaacaacgtgcggttttccgcataccggactgcaatgaaacttcggcggcttcaaaaagcactgtgtctggatctcctgtcactttccgcagcttgtgacgctttggatcaacacaatttgaagcagaacgaccaaccaatggatattctgcagatcattaactgtcttactaccatttacgatagactggaacaggagcacaacaacctggtgaacgtcccgctttgcgtggatatgtgtctcaactggctcctgaatgtttacgatactggacgcacgggaagaattagagtgctctccttcaaaactggtatcatttcactttgtaaagcgcatttggaggacaagtatagatacctgttcaaacaggtggccagctccactggattttgtgaccaacgtcgactcggcctgctgcttcatgactccatccaaataccccgccaactgggtgaagtggcatcgtttggaggatcgaatatagaacctagcgtccgaagctgttttcagtttgccaacaacaagccggaaattgaagcagcattgtttcttgattggatgagacttgaaccacaatcaatggtctggttgccagtccttcatagagtggctgcggccgaaactgccaaacaccaggcaaagtgcaacatttgtaaagaatgccctatcataggctttaggtaccgatccttgaagcatttcaactacgatatatgccaatcgtgtttcttttctggacgagtcgccaaggggcacaaaatgcattaccctatggtggagtactgtacccctactacttcgggagaagatgttcgcgatttcgccaaggtactgaagaataagtttcggaccaagagatacttcgctaagcatccaaggatgggttacctccccgtgcaaaccgtccttgaaggagataacatggaaaccgataccatg

SEQ ID NO: 251293 - DNA, 3591 bp, Artificial Sequence
  Description of Artificial Sequence: Synthetic coding sequence
atgctctggtgggaagaggtcgaggattgctacgagagagaggatgtgcaaaaaaaaactttcactaaatgggtgaacgctcaatttagtaagttcggcaaacagcatatagagaacctgttttccgatctgcaggacggacgccgcctgcttgaccttttggaaggcctgaccggccaaaagcttcccaaggagaagggctccacgcgagtccacgcactgaacaatgtgaataaagctctccgggtgctgcagaataacaatgttgatctcgtgaatatcggctccacagatatcgtggatgggaaccacaagctgactctgggcctcatatggaacataatactgcactggcaggtgaagaatgtgatgaagaatatcatggccggactccagcagacaaatagcgagaagatcctgctcagctgggtaagacagtcaacacgaaactaccctcaagtgaatgtgatcaactttactacatcctggtcagacggactggcccttaatgctcttattcactctcaccggcctgacctttttgattggaattctgtcgtatgccaacagtccgcaacccagcgactggagcacgcattcaatattgctcggtaccagttgggaattgagaagttgttggacccagaagatgtggataccacctaccccgacaagaagagcattctcatgtatattacgtccctttttcaggtgctccctcagcaggtgtcaatagaggctatccaggaggtcgaaatgctgcctcggccccccaaggtcacaaaggaggagcactttcagttgcatcaccagatgcattacagtcagcagatcaccgtctcactggcgcagggctacgaaagaacatcttcacccaagcctcggttcaagtcttacgcctatactcaagccgcctatgtaacgacctctgatcccaccagaagtccctttccatcccagcacctggaagcccctgaagacaagtcctttggatcttctctgatggaatctgaagtcaaccttgaccgctaccaaacagctcttgaggaggttttgtcctggctgctgagcgctgaagacacgctgcaggcgcagggggagatatcaaatgacgtggaggtggtcaaagaccagttccacacccacgaaggttacatgatggacttgacggcacaccagggccgcgtcggtaacattctgcagctgggtagcaaactgattggaaccggaaagctgtcagaagacgaggaaacggaggtgcaggagcaaatgaatcttttgaactcccgctgggaatgtttgcgcgtcgccagcatggagaagcagtccaatttgcatcgcgtcctgatggacttgcagaatcagaaacttaaggagctcaatgactggctgaccaaaacagaagagaggacgaggaagatggaggaggaacccctgggccctgacctcgaagatctgaagcgccaggtgcagcagcataaagtgctgcaggaagatcttgagcaggagcaggtccgcgtcaactccttgacacatatggtggtcgtcgttgacgagtctagcggtgaccatgcgacagccgctctggaagagcagctgaaggtgctcggcgatagatgggccaatatctgccggtggacagaggataggtgggtgctgctgcaggacatcctgcttaaatggcagcggctcacagaggagcagtgtctgttcagcgcatggctgtcagagaaagaagatgccgtcaacaagattcacacgacaggctttaaagaccagaacgagatgttgtccagtctgcagaaacttgccgtgctgaaggcggatcttgaaaaaaagaagcagagcatggggaaactctactccctgaagcaggacctcctctctaccttgaagaataagtctgtgacccagaagactgaggcgtggctcgataattttgcaaggtgctgggataacctggtacagaaactggagaaaagcaccgcacaaattagccaagcagtgaccacaacccagccctctctcacacagaccacagtgatggaaacggtgaccactgtgaccacacgggagcagatcctggtgaagcacgctcaagaggagcttcctcctcccccccctcagaagaagcgacagataaccgtcgataccctcgagcggttgcaagaactgcaagaggcaacagacgaactggatctgaaactgcggcaggctgaggtcatcaagggaagttggcagcctgttggagatctccttattgatagcctgcaggaccacctggagaaggtgaaagccttgcgcggtgagattgcccccttgaaggagaatgtgtctcacgtcaacgatctcgctaggcaactcacgacactggggattcagctgagcccttacaatctgtcaacattggaggacctgaataccaggtggaaactgttgcaggtggcggtggaggatagagtcaggcagctgcatgaagcgcaccgcgacttcggaccagcatctcagcacttcctgagcacgagcgtgcagggaccatgggagcgagcaatctcccctaacaaagtaccctactacatcaatcacgaaacacaaaccacttgctgggaccatccgaaaatgaccgagctgtaccagtctttggccgatctcaataatgttagatttagcgcataccgcacggcaatgaagctgagacgactgcagaaagccctgtgtctggatctcctctccttgagcgccgcctgcgatgcactggaccagcacaacctgaaacagaatgaccagccaatggatatacttcaaataatcaactgcctcaccactatttatgaccggctggaacaggagcataataacctcgtgaacgtacccctttgtgtggacatgtgtttgaattggttgctgaatgtttatgacaccggaagaacaggccgcatcagggtcctctcatttaagacgggcatcatctccctctgcaaggctcacctggaagataagtaccgctatcttttcaaacaggtggcttcctccacggggttctgcgaccagcggcgcctgggactgctgttgcacgactccatccagatccctagacagctgggcgaggtcgcaagctttggtggatctaatattgagccttcagtcaggagctgcttccagtttgccaataataaaccagagattgaggctgcgctctttctggactggatgcgcctggagccacagagcatggtgtggctgccagtgcttcacagggtcgccgcagccgaaactgctaagcaccaggcgaaatgcaacatttgtaaggaatgcccaattataggcttcaggtaccgaagtctgaaacactttaactacgacatatgccagtcctgtttcttctctggccgggttgccaaaggccataagatgcactaccccatggttgagtactgcaccccgacgaccagtggcgaagacgttagggacttcgccaaagtccttaagaacaaatttcggactaagcgatacttcgccaagcaccccaggatgggttacctgccagtccagaccgtgttggagggtgacaatatggagactgacacaatg

SEQ ID NO: 251294 - DNA, 3591 bp, Artificial Sequence
  Description of Artificial Sequence: Synthetic coding sequence
atgctatggtgggaggaggtcgaggactgctacgagagggaagacgtgcaaaagaaaactttcaccaagtgggtgaacgcacaattttctaaattcggaaagcaacatattgagaacctgttcagcgacttgcaggacggcagacgcctgctggatctgttggagggcctcacaggccaaaaactgcccaaggaaaaaggcagtaccagagtccacgcacttaataacgttaataaagctctgagggtcctgcagaacaataacgtcgatctggtcaatatcggctctaccgatatcgtcgatggaaaccacaagctgaccttaggcttgatttggaacattattctgcactggcaggttaaaaatgtgatgaagaatatcatggcagggctgcaacagaccaactccgagaagatcctgctatcctgggtccgtcagtccaccaggaattatccacaagtgaatgttatcaacttcaccactagctggtccgatggacttgctctgaacgctctgattcattcccatagacccgatttgttcgattggaactcagtggtctgtcagcagtctgctacacagaggcttgagcacgctttcaatattgctaggtatcagctgggcattgagaaactcttggaccctgaagacgtggacacaacatatcccgataaaaagagcatacttatgtatatcaccagtttattccaggtgcttccacagcaggtttccattgaggctatccaggaagttgaaatgctaccgagaccacccaaagtcactaaggaggaacactttcagctgcatcaccaaatgcattattcccagcagataacagtgagccttgctcaagggtatgagagaacttcctcaccaaaacctagattcaagagctacgcatacacccaggcagcctacgttacaacatctgaccccaccagaagtccttttccttctcagcacttagaagcgcctgaagataagagcttcgggagcagcctcatggaatccgaggtgaatcttgataggtatcagaccgctttggaggaggtgctcagctggctgttgagcgccgaggacacgcttcaagcccagggagagatttccaacgatgtggaagtggtaaaagatcagttccatacccacgaaggctacatgatggatctgaccgcccatcagggccgggttggaaatatcctccaattagggagcaaattgatcggaactggaaaactcagcgaagacgaagaaactgaggtacaggaacaaatgaacctgttgaacagccgttgggaatgtctgagagtggcatcaatggagaaacagtcgaacctccatcgggttctcatggatcttcagaaccagaagcttaaggaactcaacgactggctgaccaaaaccgaagaacgaactaggaaaatggaagaagaaccgcttgggcctgatctagaagacttaaaaaggcaggtgcagcaacacaaagtgctccaggaggatcttgagcaggagcaagtgcgtgtgaactccctcacacacatggtggtggttgtggacgaatccagcggcgaccatgctaccgctgcgttggaggagcaactcaaagtcctgggcgaccgctgggcgaacatttgccggtggactgaggatcgctgggtgcttctgcaagatatccttctcaaatggcagcgcctgacagaagagcaatgtctgttttccgcttggttgagcgaaaaagaagacgcggttaacaaaattcacacgaccggattcaaggatcaaaacgagatgctgagcagcttgcagaaactggccgtgcttaaggctgacttagagaaaaagaaacagagcatgggcaaactttactcgcttaaacaagatctgctgtccacattgaaaaacaaatctgttacccaaaagactgaggcctggctggataactttgctcgctgctgggataacctcgtgcagaaactggaaaaaagcaccgctcaaatttcccaggccgtgaccactacgcagccaagcctcacacaaacaaccgtcatggagacagtcactactgtcacaactcgggagcaaatacttgtgaaacatgcccaggaggagcttcccccaccacccccccagaaaaagcggcaaattacagttgacacactggagcggttgcaagaactgcaggaagcaacagatgagctcgatttgaagctgcggcaggcagaagtgattaaaggatcctggcagcccgtgggcgatctcctgatcgactcactccaggatcacctggagaaagtgaaagctcttagaggcgagattgcacccctgaaagagaacgtgagccatgtcaacgatctggctcggcagcttacgaccctggggatccaactctccccttataacttgagtacgttggaggatctaaataccaggtggaagctcctgcaagttgctgttgaggatagagtgaggcagctccacgaagcacaccgagactttgggcctgcttcacagcacttcctctcaacttctgtgcagggtccatgggagagagctatcagccctaataaagtaccctactacattaatcatgaaacacagaccacatgctgggatcacccgaagatgacagagctttaccagtcgctagccgatttgaataatgtcaggttctctgcttaccggaccgctatgaagttaaggaggttgcagaaggctctctgcttggaccttctgtcattgtcagcagcgtgcgacgcactggatcagcacaatctgaaacagaacgaccaaccgatggacatcctgcaaatcattaactgcctgaccaccatctacgatagactggagcaggaacacaacaacctggtcaatgtgcctctgtgcgtggacatgtgcctcaactggttgttgaacgtgtacgacactggcaggacaggtagaatcagggtgctctctttcaaaacgggaattatcagcctttgtaaggcccacctggaggacaaataccggtacttgtttaagcaggtggccagctccactgggttctgcgatcagcgcagactcggtttactgcttcatgacagcatccaaatccctcgccaattgggtgaagtcgcatcttttggcggatccaacattgagcctagcgtgagatcgtgttttcaatttgcgaataacaaacccgaaatcgaagcagctcttttcctggattggatgcgcctggagcctcagtcaatggtgtggctgcctgtgctgcatagagtggccgcagctgaaacagcgaagcaccaagcgaaatgcaatatttgtaaagagtgtcctattattggattcaggtaccggtctctgaagcatttcaactacgatatatgccaaagctgctttttttcagggagggttgccaaaggacataagatgcactaccctatggtagagtattgcaccccaaccacctccggggaagatgttagagatttcgccaaggtgcttaagaacaagttcagaacaaagagatactttgccaaacaccctcgtatgggctatcttccagtacaaacggttctggagggagacaacatggagaccgataccatg

SEQ ID NO: 251295 - DNA, 3591 bp, Artificial Sequence
  Description of Artificial Sequence: Synthetic coding sequence
atgctttggtgggaagaagtcgaggactgctacgagagagaggatgtccaaaaaaagaccttcacaaaatgggtaaatgctcagttctctaagttcgggaagcagcacattgagaatctgttcagtgacctccaggatgggaggaggctgttggacctgctggaggggctcaccggccaaaagctgccaaaggaaaagggatctacccgggtgcacgctctcaacaacgttaataaggcgttgcgagtgctgcaaaataataacgttgatctcgtcaacatcggcagtaccgacatcgttgacggaaatcacaagctgaccctgggtctgatctggaacataatcctgcactggcaggtcaaaaacgtgatgaagaacatcatggcaggtctgcaacagaccaattcagagaagatactgctcagctgggtcaggcagagcacccggaactatccacaggtgaatgtcatcaactttacaacatcatggtccgacggtttggcactgaacgcacttatccacagtcacagacccgacctcttcgactggaattccgttgtctgccagcagagcgcgacccagaggctggagcacgcttttaacatcgcccgctaccagttgggcatcgagaagctgctcgatcctgaagatgtggataccacataccctgataaaaagtccattctcatgtacattactagtctcttccaggtactgcctcaacaggtgagtatcgaggccatccaggaagtcgagatgctgccccgcccgccgaaagtcacaaaagaggagcactttcagctgcaccaccagatgcactattcacagcagatcacagtgtccttggctcaggggtatgagcgcaccagttcacccaaaccaagatttaagtcttacgcttatacgcaagccgcctatgtgacaacctctgatcctacacgctctccgttccctagtcagcatctcgaagcgcccgaagataaatcttttggcagtagcctcatggagtcagaagtcaacctcgaccgctatcagaccgccctggaagaagtcctcagctggctcctgagcgcggaagataccctgcaggctcagggtgagatcagcaatgatgtagaggtggtgaaggatcaattccatactcacgaggggtacatgatggatctcactgcccaccagggtagagtgggaaatattctgcagttggggagcaaacttataggaactgggaagctttccgaagatgaagaaaccgaggttcaggagcagatgaatctgctgaactctagatgggagtgcttgagagttgcaagcatggaaaagcagagcaatctgcaccgggtgctgatggacctccagaatcaaaaattgaaagaactcaacgattggctcaccaaaacagaggagcgaaccagaaaaatggaggaagagcctctgggccctgacctcgaggacctcaaaagacaggtgcagcagcataaggtgctccaggaggacttggaacaggagcaggtgcgggtcaatagtcttactcatatggtggtggtcgtagacgagagctccggcgatcatgcaactgctgccctggaggagcagcttaaggttctgggcgaccggtgggccaacatctgtagatggacagaagaccggtgggtgctgctgcaggacatacttctgaagtggcagcgcctgacagaggagcagtgtctcttcagtgcctggctttccgaaaaagaggacgccgtgaataaaatccacacaaccggctttaaggatcaaaatgagatgcttagttcactgcagaagctggcagtgctgaaagccgatctggagaagaagaagcagtcaatggggaaactctactcactgaagcaggatctgctgtctacgctgaagaacaagtcagtcacccagaaaactgaagcatggctggataactttgccaggtgctgggataatctggtccaaaagctggagaagtccacagctcaaatctcacaagcagtaacaactacacagccttccctgacacaaacgactgtgatggagaccgtgaccacagtgacaacacgggagcagattctggtgaaacatgcgcaggaagagctccctcccccacccccacagaaaaagagacagatcacagtcgacactctggaaagactgcaagaactgcaagaggccacagatgaattggacctgaagttgcgccaggccgaagtaatcaaaggctcatggcaacctgtgggagaccttcttatcgacagtcttcaggatcacctggagaaggtcaaagctctccggggagaaatagcaccactgaaggagaatgtctcccacgtgaacgacctggcccgccaattgaccaccttgggtattcagctcagcccatacaacctctccacccttgaggacctcaacactcgctggaaactgctgcaggtggccgtagaagaccgcgtaagacagctgcacgaagcgcatagagacttcggcccagctagccagcatttcctgagcacttccgtacagggcccttgggagcgggccattagtccaaataaggtgccttactacatcaatcacgagacccagactacgtgctgggatcaccctaagatgactgagctttaccaatctctggcagatctcaataacgtccgcttctccgcgtatcgcaccgctatgaagctgcgccggctgcagaaggccctgtgtctggatctgctgagtttgtccgccgcttgcgacgcgttggaccagcacaatctcaagcagaacgaccagccaatggatatcctccaaatcatcaactgcctgaccacaatttacgaccgcctggagcaggaacacaataatctggttaatgtgcctctctgcgtggacatgtgcctgaactggctgctcaatgtgtatgacacgggtagaaccggccggataagggtcctgtccttcaaaacgggcattattagtttgtgcaaggcccatttggaggacaagtaccggtatctctttaaacaggtggcatctagcaccggcttttgtgatcagagaaggctcggactgctcctgcacgacagcatccagatcccacgccagctgggagaagttgccagcttcggtgggagtaatatcgagccaagcgttaggagttgctttcagtttgcgaacaacaagccagagatcgaagctgccctgttcctggactggatgaggctggaaccccagtctatggtttggcttcctgtgctgcaccgggtggccgcagcagagactgcaaaacatcaggctaagtgcaatatctgcaaggaatgtcctatcattgggtttaggtaccgatcactcaagcatttcaactacgacatttgtcagagttgctttttttctgggcgggtagcaaaggggcacaagatgcactacccaatggtggaatattgcacgcctaccacatccggcgaagatgtgagagacttcgctaaagttcttaaaaataagtttaggacaaaacggtacttcgccaagcacccccgaatgggttacctgcctgttcagaccgttctcgagggggataacatggaaactgacacaatg

SEQ ID NO: 251296 - DNA, 3591 bp, Artificial Sequence
  Description of Artificial Sequence: Synthetic coding sequence
atgctctggtgggaggaggtcgaggactgttacgaaagggaggacgttcagaagaaaactttcactaaatgggtgaacgcccaattcagcaagttcggcaaacagcatattgagaaccttttctccgatctccaagacggtaggagattgctcgacttgctcgaaggactgacaggccagaaactgcccaaggagaagggatcaaccagggtacatgctcttaataatgtgaacaaggcgctccgcgtgttgcagaacaacaatgtagacctggtcaacattggttccactgatatcgtagacggaaatcataagttgacactgggactcatttggaacataatcctgcactggcaggtcaagaatgtaatgaagaatatcatggctggcctccagcaaaccaatagcgaaaagattctcctgagctgggtaagacaaagtaccaggaactaccctcaagtaaacgtaattaatttcacgacaagctggtccgacggcctcgcgctcaacgctctgatccactcacacaggccagatctgtttgattggaactcagtggtctgtcagcagtccgccacccaacgcctggaacatgctttcaatatcgccaggtaccagctcggaatcgaaaagctgcttgaccccgaggatgtagatactacctaccccgacaaaaaatccattttgatgtacatcaccagcttgtttcaggtgctcccacagcaagtgtccatcgaggcaattcaggaagtcgaaatgctgccccgccccccaaaggtcacgaaggaggagcattttcaactccaccaccaaatgcactatagccagcagatcactgtaagccttgcacagggatatgagaggacgtctagcccaaagcccaggtttaagtcttatgcttatacccaggctgcatatgttactacaagcgatccaaccagatccccttttccctcccagcatctggaagcccctgaagacaagagtttcggcagcagcttgatggagtctgaagtaaatttggacagatatcagaccgctctggaagaggttctgagttggctcctgtccgctgaagataccttgcaggcccagggtgaaatctccaacgatgtggaggtcgttaaagaccagttccatacccatgaaggatacatgatggacctgaccgcccatcagggtagggtaggcaatatcttgcaactgggctccaagcttattggcaccggcaagctttcagaagatgaggagaccgaggtgcaagagcaaatgaaccttctgaactctagatgggagtgtctcagggtagcttccatggagaagcaaagcaatcttcacagagtcctgatggatctccagaatcaaaaattgaaggagctcaatgattggcttactaagactgaagagagaacgagaaagatggaggaggaacctctcggccccgatctcgaggatcttaagagacaagtccaacaacacaaggtactccaagaggacctcgaacaagagcaagtcagagtgaactcactcacgcacatggtggtagtcgtagacgaatcttctggtgaccacgccacggccgcgctggaagaacaacttaaagtacttggcgatcgctgggccaacatctgtagatggaccgaggataggtgggtactgctgcaggacatactcctgaaatggcaaagactcactgaggaacaatgtctcttttccgcttggctgtccgagaaagaggatgccgtgaataagatccacactactggattcaaagatcagaacgagatgctgtccagtctgcagaaactcgctgtgcttaaggctgacctggagaaaaagaaacagtccatgggcaagctgtacagccttaagcaagatctgctttctactctgaaaaacaagtcagtgacacaaaagacagaggcctggctcgataactttgcacgctgttgggacaatttggttcagaagcttgaaaaaagcactgcgcaaatcagtcaagctgtcaccacaacccagccatcactgacccagacaaccgttatggagacagtgactacagttaccacacgcgaacaaatattggtaaaacacgcccaggaggaattgccgccaccacctccccagaagaagcgccaaattaccgtcgacacactcgagaggctgcaggagctgcaggaggcgactgatgaattggatttgaaactgcgccaagcagaagtaatcaaaggttcttggcaacctgttggtgacctgcttattgattcactgcaggatcaccttgaaaaggttaaggccctcagaggcgaaatagcgccactgaaggagaacgtgagtcacgtgaacgaccttgccagacagttgacaacccttggaatccagttgtccccttataacctctcaacgcttgaggatctgaatacaaggtggaagctgctgcaagttgcggttgaagatagggttcgccaactgcacgaggctcatcgcgacttcggccctgcttcacagcacttcctgagcacatccgtacagggcccatgggaacgcgctatcagccccaacaaggtcccctattacataaaccacgagacacagactacttgctgggaccatcccaagatgacagaactgtaccagtccttggccgaccttaataacgtcaggttcagtgcgtacagaactgcgatgaaattgaggaggctccagaaagccttgtgtttggacttgctctcactctctgctgcttgcgacgccctcgaccagcacaacctgaagcaaaacgatcagcctatggacatcctccaaattattaactgcctgacaacgatctacgacagactggagcaagaacacaataacctcgtgaatgtgccattgtgtgtggacatgtgtctgaactggcttctgaatgtgtacgatactggaaggaccggccgcattagggtcctcagcttcaagactggaattatttctttgtgcaaggcacatctggaggataaatatagatacctgtttaaacaggtggcgagcagcacaggtttttgtgaccagaggcgccttggactgttgctgcacgattcaattcaaattccgaggcaactcggcgaggtcgcatctttcggaggttctaacatcgagccctcagtcaggtcctgtttccagttcgcgaataacaagcccgagatcgaagccgccctgtttctcgattggatgagattggaaccccagtccatggtttggcttcccgttctccatagagttgccgcggccgagactgccaagcaccaagccaagtgcaacatttgcaaggaatgtccgattatcggcttcaggtaccgcagtctgaagcactttaattatgacatctgccagtcctgttttttctctggcagggtggcgaagggccacaagatgcactacccaatggtagagtactgtactcctaccacctctggagaggacgtgcgcgacttcgccaaggtactcaaaaataaattccgcaccaagaggtattttgcaaagcatcccagaatgggctacttgcctgttcagactgtgctggaaggagacaacatggagaccgataccatg

SEQ ID NO: 251297 - DNA, 3591 bp, Artificial Sequence
  Description of Artificial Sequence: Synthetic coding sequence
atgctgtggtgggaggaggtggaagattgttacgaaagagaagatgtgcaaaagaaaaccttcaccaagtgggtgaacgcgcaattttccaagtttggaaagcagcatattgaaaacctgttctcggatcttcaggatggaagaagattgttggacctgctggaagggctcactgggcaaaaacttcccaaagagaagggaagcacgcgtgtgcatgcactcaacaatgtgaacaaggcgctccgcgtgctgcagaacaacaacgtcgatctggtcaacattggaagcactgatattgtggatgggaatcataagctcaccctcggactcatttggaacattattcttcactggcaagtgaagaatgtgatgaagaacataatggccggacttcagcaaacgaactccgaaaagattcttctttcgtgggtgcgacagtcaactagaaactaccctcaggtcaacgtgatcaatttcactacctcgtggagcgatggactggcactcaatgcactgattcattcgcatcggcccgacctgttcgattggaactcagtggtctgccaacaatcggcaactcagagacttgaacatgcgttcaatattgccagataccaactggggatagagaagctcctcgatcccgaagatgtcgataccacttaccctgataagaagtcgattcttatgtacattacgtcactgtttcaggtgcttccgcagcaagtgtcaattgaagcaattcaagaagtggagatgctccctagaccgccaaaagtgactaaggaagaacattttcaacttcatcatcagatgcattactcacaacagatcactgtctcccttgctcaaggatacgaaagaacctcatcacctaaacctcggttcaagtcctacgcctacacccaagctgcatacgtcactacgagcgaccctaccagatcgccttttccatcacaacatctcgaggcacctgaagataaatcgtttggtagctcactgatggaatcggaggtgaatcttgatcgataccagacggcactggaagaagtgctctcctggttgttgagcgcagaggacactctgcaggcacagggtgaaattagcaacgatgttgaggtggtgaaagatcaattccatacgcacgaaggatatatgatggatttgactgcgcatcaaggcagggttggaaacattctccagctgggatctaaacttattggaactggcaaactgtcggaagatgaagagactgaggtccaagaacaaatgaacctgcttaactcgcgctgggagtgtctgcgcgttgcaagcatggaaaagcaatcaaatttgcatcgggtgcttatggacctgcaaaatcaaaagctgaaggaactgaacgactggcttactaaaaccgaggagaggaccagaaaaatggaagaagaaccactcgggcccgacttggaggacttgaagcgtcaagtgcagcaacataaggtcctccaggaagatcttgagcaagaacaagtgagagtcaattctcttacccatatggtggtggtcgtcgatgagagctccggggatcacgcaactgccgccctggaggagcaactgaaggtgctgggagatagatgggccaatatctgtcggtggactgaggacagatgggtccttctccaggatatcctccttaagtggcaacgcctcaccgaagaacaatgcctgtttagcgcctggctgtctgagaaggaagatgcagtgaacaaaatacatactaccgggtttaaggaccaaaatgagatgctttcctcgcttcagaagttggccgtgcttaaggccgaccttgagaaaaagaagcagagcatgggaaaactttattccctgaagcaagatcttttgagcaccctgaaaaacaaatcagtgacgcaaaaaactgaagcatggcttgataactttgcgaggtgctgggataatcttgtgcagaagctggaaaagtcgactgcgcaaattagccaagcagtaactaccactcagccaagccttactcaaactaccgtcatggaaacggtcacgactgtgactacccgggaacaaatccttgtcaaacatgcacaggaagaactgcctcctccacctcctcaaaagaagcgccaaatcaccgtggataccctggagcgactccaagagcttcaggaagcaaccgacgagctggatctgaagctcagacaggcggaggtcatcaaggggtcgtggcagcctgtcggcgatctgctgatcgatagcctgcaggatcatcttgaaaaagtcaaggcccttagaggtgagatagcacctcttaaagagaacgtgtcccatgtgaacgatctcgcacgccaactcactacgctcggaattcaactttccccttacaacctttcaaccctggaagatctgaacactcgctggaagctgctgcaagtggcagtggaagatagggtgagacaacttcacgaagcccatcgagactttggacccgcatcccaacattttcttagcacttccgtccaaggaccatgggaacgtgctatttcgccgaacaaagtgccttactacattaaccatgaaacgcaaaccacctgttgggatcatccaaagatgaccgagctttaccagtcccttgccgatcttaacaacgtgaggttttcagcatacagaaccgcaatgaaactgagaagattgcagaaggcactgtgtctggatctcctgtcgctttcggcagcgtgtgatgccctggatcagcataatctgaaacagaacgaccaacccatggacattctccagattatcaattgccttactactatttacgaccgtttggaacaagaacacaataaccttgtgaacgtgcctctgtgtgttgacatgtgtctgaactggctcctgaacgtgtatgatactggacgcaccggcagaatacgtgtgctgagcttcaagactgggatcatttccctctgtaaggctcaccttgaggataagtaccgctacttgttcaaacaagtggcatcatcaaccggattttgtgatcagcggaggctgggactgttgttgcacgactcgatacagatcccacggcagcttggtgaagtggccagctttggcggcagcaatattgagccttcagtcaggtcgtgttttcaatttgcaaacaacaagccggaaattgaggctgcgctgttcctggattggatgagattggagcctcaatcaatggtgtggctgcccgtccttcatagggtcgctgccgcagaaaccgcgaagcaccaagcaaagtgtaacatttgcaaagaatgtccgatcattgggtttaggtatcgaagcctgaagcactttaactacgacatttgtcagtcgtgtttcttctccgggagggtggcaaaaggacataagatgcactatcctatggtcgagtactgtactcccactacgagcggtgaagatgtgagggattttgcgaaggtccttaagaacaaatttcgcaccaagcggtacttcgccaagcacccacgcatgggctacctgccagtgcaaactgtgcttgagggcgacaacatggaaaccgataccatg

SEQ ID NO: 251298 - DNA, 3591 bp, Artificial Sequence
  Description of Artificial Sequence: Synthetic coding sequence
atgctctggtgggaagaggtggaggactgctacgagcgggaggacgtgcagaagaagactttcaccaaatgggtaaacgcccaattttctaagttcgggaagcagcatatcgaaaacctcttctctgacctgcaggatgggcgcaggctgctggatttgctcgagggcctgacgggccagaagctgcccaaggaaaagggcagtaccagagtgcatgccttgaacaacgttaacaaagcactgagggtgctgcaaaacaacaatgtggatctggtgaacatagggtctacggacatcgtcgatgggaatcataagctgacccttggcctcatctggaacataatcctgcactggcaggttaaaaacgtgatgaaaaacatcatggcaggtctacaacagactaatagcgagaagatcctccttagctgggtgcgacagagcactcgaaactatccacaagttaatgtgatcaattttaccacctcttggagcgacggtttagcgctgaatgcattgattcactctcatcggcctgacctgttcgattggaattccgttgtctgccagcagagcgcgacgcagagactcgaacatgcctttaacattgcccggtatcagttgggaatcgagaaactcctggaccctgaagacgtagacaccacttacccggataaaaagagcatactgatgtacataactagcctcttccaagtcctgccccaacaggtgtctatcgaggcaattcaggaggtggaaatgctccctcgcccgcccaaggtgacaaaagaggagcacttccaactgcaccaccagatgcactacagccagcagattactgtgagcctggcccagggctatgaacgcactagttctcccaagccaaggtttaagtcgtatgcgtatacccaggcagcatacgtgactacatccgaccccactcggtcccctttcccatcccagcatctggaagcgccggaggacaaaagtttcgggtctagtctgatggaaagcgaagtcaacctcgacaggtaccagaccgcccttgaggaagtgctgagctggctcctgagcgccgaggatactctccaggcgcagggcgaaatcagcaatgacgtggaggtggtgaaggatcagttccacacgcacgaggggtacatgatggatctcactgcccaccagggaagggtcggcaacatcctgcagctgggttcaaagctcatcggaactggtaaactgagcgaggatgaggaaacggaggtgcaggagcaaatgaatttgctcaactcccgctgggagtgcctccgggtggcctccatggagaagcagtcgaaccttcacagagtgttaatggatctgcagaaccaaaagctgaaagaactgaacgactggctgaccaaaacagaggaacgcacgcgcaagatggaggaggagcctttgggccccgatctggaggatctaaaacgccaggtacagcagcacaaggtgctgcaagaggatttggaacaggaacaggtcagggtcaactccctcacacacatggttgtggtggttgatgaaagctccggggaccacgccacagccgcgctggaggagcagctcaaggtccttggagaccggtgggccaacatatgcagatggaccgaagaccgctgggtgctcctgcaagatatactgttgaagtggcagcggttgacagaagaacaatgtctcttttcggcatggctctctgaaaaggaagacgccgtgaacaagatccacacaacaggttttaaagatcagaatgaaatgctctcgagcctgcagaagctggcggtgctgaaagccgacctggaaaagaaaaagcagagtatgggaaaattgtattcactgaaacaagacctgctctcaacattgaagaacaagtccgtgacccagaagacagaagcctggctcgacaatttcgctcgctgttgggacaacctcgtgcagaaactggaaaagtctaccgctcagatcagccaagccgtaacaacaacgcagccatccctaacgcagactacagtcatggaaacagtcacaacagttacaacaagggagcagattctggtgaagcatgcgcaggaggagctgcctcccccccccccccaaaaaaaacgacagattaccgtggacaccttggagcgtctccaagaattgcaagaagcaaccgacgagctggacctgaaactgcggcaggcagaggtgataaaaggcagctggcagcctgtcggagatctgctgatagactctctgcaggaccacctagagaaggtcaaagcattgagaggagaaattgctcctctcaaagagaatgtttcccacgtcaatgacctcgctagacagctcactaccttaggcatccagctgtctccgtacaacctgtcgactctggaggacttgaacaccaggtggaaactgctgcaggtggcggttgaggacagggtgaggcagttacatgaggcccaccgggactttggtccggcttctcagcacttcttatccaccagcgtccaggggccttgggaacgcgccatcagcccaaataaagtcccttactatattaaccacgagacccagactacgtgttgggatcacccgaagatgacggagctgtaccagagcctggccgatctgaacaacgtccgcttttccgcctatcggaccgccatgaagctgcgtcggttgcagaaggccctgtgtctagatctcctgtcactgtcagccgcctgcgatgcactcgaccaacacaatctgaagcaaaacgaccagccaatggatattctccagatcatcaactgtctgaccactatttacgacagactagaacaagagcataataatcttgtgaatgtacccctgtgcgttgatatgtgcctcaactggctgctcaatgtgtacgatacaggcaggacaggcaggatcagggtgcttagtttcaagaccggaattatcagcctgtgcaaagctcaccttgaggataaatacagatatctgttcaaacaagtggcatcttcgacaggtttctgcgaccagaggcgcctcggcctactgctccacgactccattcagatcccccgccagctgggggaggtggcttcctttggtggatctaacatagagccctccgttcgtagctgctttcagttcgctaacaacaaacccgagatcgaggcggcgctgttccttgactggatgcgattggagcctcagagtatggtgtggctgccagtcctacacagagttgccgcagctgagaccgccaagcatcaagccaagtgcaatatctgtaaggaatgccccatcatcggattccgctaccgttccctcaaacacttcaattatgacatctgccaaagttgtttttttagcggccgggttgccaagggccacaagatgcactaccctatggtggaatattgcacccctaccaccagtggcgaggatgttcgcgacttcgccaaagtgttgaagaataaatttcgaactaaacgttattttgcgaaacacccgagaatgggctaccttcccgtgcagacagtgttggaaggtgacaatatggagacagataccatg

SEQ ID NO: 251299 - DNA, 3591 bp, Artificial Sequence
  Description of Artificial Sequence: Synthetic coding sequence
atgttgtggtgggaggaggtcgaagattgctatgagagggaggatgttcagaagaagactttcactaagtgggtcaatgcccagttcagtaagtttggaaagcaacatatcgaaaatctcttttcagatctgcaggatgggcgcagattacttgatctgctggagggcctgactggtcagaaactgcctaaagagaaaggaagtaccagagtccacgccctgaataacgtaaacaaagccctacgggtacttcaaaataacaatgtcgatttggttaatatcgggtccactgatattgtcgatggaaaccataaactgaccctgggtctaatatggaacatcattctacattggcaggttaagaacgtgatgaaaaacatcatggcgggcctgcagcagacaaactcggagaagatcctcttgagttgggtgcgacagtctactaggaattaccctcaggtgaatgttatcaattttaccacttcttggagcgatgggcttgcactcaatgctttaatccattcgcaccgtcccgatctgttcgattggaacagcgtggtgtgccagcagagtgcgacgcagaggctcgagcatgctttcaacatcgcccgataccagctcgggatcgaaaagttactcgaccctgaggacgttgatactacctatccggacaagaaatcaatcctcatgtatataacaagtctgtttcaggtactgcctcaacaggtgtctatcgaggctatacaggaggtggaaatgctaccgaggccaccgaaagtgactaaggaagaacattttcagctgcaccatcagatgcattactcgcaacagatcactgtgtctctcgcgcaggggtatgaacgcaccagcagtcctaagcctcgcttcaaatcctatgcatatacccaagctgcctatgtgacaacctcggatcctacacggtctccatttccatctcagcacctggaagcgcccgaggacaaatcattcggcagttctctgatggagagcgaagtgaacctggaccgctatcagactgccctcgaagaagtgctgtcatggctcctaagcgcagaggacactctgcaggcccagggggaaatatctaacgacgtggaagtggtgaaggaccagtttcatacccacgaaggatatatgatggacctgacggctcaccaggggagggtgggtaatatcctacagctgggatccaagctaatagggacagggaaactgtcagaagatgaggagaccgaagtccaagaacagatgaatctgctcaatagtcgatgggagtgtcttcgcgtggcctcaatggagaagcagtcaaatttacacagagttcttatggacttacaaaaccaaaaattgaaggagctcaatgactggctgacaaaaacagaggaaagaactaggaagatggaagaagagcccctggggcccgatctagaggaccttaagcgccaggtgcagcagcacaaagtcctccaggaggacctcgagcaagagcaagtcagagtgaactctctaactcacatggtcgtggtggtggatgagtcttcaggcgatcatgccacagcagcccttgaggaacagctcaaggtgctcggcgaccgttgggccaacatctgccgatggaccgaggaccggtgggttctactccaggacattctcttaaagtggcagcgactaacagaggaacagtgtctgttttctgcatggctgagtgagaaggaggacgctgtgaacaaaatccatacaaccggattcaaggatcagaatgaaatgctgagctctctgcagaaacttgcagtcctcaaggcagacttagagaagaagaagcagagtatgggaaagctttactctctgaagcaggacctgctgagcacactaaagaacaagtccgtaacccagaagacagaggcgtggctcgacaactttgctcgctgctgggacaatctggtccagaaactggagaagtcaaccgctcaaatctcacaggccgtgacaaccacccagccgtctctgacccagacaactgttatggagactgtgacaacagtgacgaccagggagcagatcctcgtcaaacacgcgcaagaggagcttccaccacccccaccgcagaagaagcgacagatcacggtcgacaccttagaaaggttacaggagctccaggaagcaacagacgaattggatctgaaactccggcaggcagaagtgattaagggcagctggcaacctgtgggcgaccttctgattgacagcctacaggaccacctggagaaggtaaaggccctgaggggtgaaattgcgccactgaaggaaaatgtcagccacgtcaacgatctcgcccgccagcttacaaccttaggcatccagctgtccccatataacttgagtaccctggaggacctgaacaccaggtggaagttattgcaggtcgctgtagaggatagagtcaggcaactgcacgaagcacaccgggactttggccccgccagccaacacttcctgtctacctcagttcagggtccgtgggagagagccatctccccaaataaggtaccttattatattaatcacgagacccagacaacctgttgggatcaccccaagatgaccgaactgtatcaatccctggccgatctgaacaacgttcgcttctccgcctaccgcactgcgatgaagttgcggcgtctgcaaaaagcactgtgtttggacttgctttcactgtccgccgcgtgtgatgccctggaccagcacaacctgaagcagaatgaccagcctatggacattttgcaaatcatcaactgtctgaccaccatctatgacagactcgagcaggagcataataacctggtgaacgtgcccctctgtgtggacatgtgcttgaattggcttctcaacgtctacgataccggccgaacgggtcggataagggtcctctctttcaaaacaggcataatctccctgtgtaaggcacacctagaggacaaatataggtatctgttcaagcaggtggcgtcttctacaggattttgcgatcagagacggctgggattgctcctgcacgatagcattcagatacctcggcagctcggcgaagtggcgtcattcggcggttcaaacatcgagccaagtgtgcggtcctgttttcaatttgccaataataagcctgagattgaagctgctttgtttctggactggatgcgccttgaaccacagtctatggtgtggctgccggttctgcacagggttgctgcagcagagaccgctaagcatcaagccaagtgcaacatttgtaaagaatgtcctattattggcttcaggtatagatcgctgaagcacttcaattatgacatttgtcagtcttgtttcttttccggtagagttgctaaagggcataagatgcactatcctatggtagaatactgtacgcccaccacttccggcgaagatgtccgtgatttcgcgaaggtcttgaagaataagttccgaaccaagaggtacttcgctaaacacccacggatgggctatttgcctgtccagacagtcctggagggggataatatggagacggacactatg

SEQ ID NO: 251300 - DNA, 3591 bp, Artificial Sequence
  Description of Artificial Sequence: Synthetic coding sequence
atgctgtggtgggaggaagtagaagattgctacgaacgcgaagatgtgcaaaagaaaacttttaccaaatgggtgaacgcccaattttcgaagttcggaaaacagcacatcgaaaatctcttctcggacctccaggatgggcgcagactgctggatctcctggagggactgactgggcagaagttgccgaaggaaaaggggagcaccagggtgcatgcgctcaacaacgtgaataaggctctcagggtcctgcaaaacaacaacgtcgacctggtcaacatcggatcaaccgatatcgtcgatggcaatcataaactgaccctgggacttatatggaacatcatcctgcactggcaagtgaagaatgtgatgaagaacatcatggcaggtttgcagcagactaattcggagaaaattctgctgagctgggtgagacagagcactagaaattacccacaagtcaacgtcattaactttactacgtcatggtcggacgggctcgccttgaacgcactgatccattcccacagaccagacctgttcgactggaatagcgttgtttgtcaacaatccgcgactcaaagactggagcacgccttcaacatcgcgcgctaccaacttggcatcgaaaagctgctggacccggaggatgtggacaccacctacccggacaaaaagtctatcctcatgtatattacgagcctcttccaagttttgccccagcaggtgagcatagaggcaatccaagaggtcgagatgctccctaggccacccaaagtcaccaaagaggagcacttccaactgcaccaccaaatgcattattcgcagcagatcaccgtttcactggcccaaggctacgagcgaacgagctccccaaagccgcgctttaagagctatgcctacacccaggccgcttacgtgaccacctcagacccgacccggtccccctttccatcccagcacctcgaagctccagaggataagagctttggttcaagcctgatggaatcagaggtgaacctcgaccgataccagactgccctggaggaggttctgtcctggcttctgtcagctgaagacaccttgcaagcacaaggagaaatcagcaacgacgtggaggtcgtgaaggaccagttccatactcacgaaggatatatgatggatctgactgcccatcaaggacgggtgggaaatatcctgcagcttggatccaaactgattggcactggaaaactgtcggaagacgaggaaactgaagttcaagagcagatgaatcttctcaattcgaggtgggaatgtctgcgcgtcgccagcatggaaaaacagtccaacctgcaccgcgtcttgatggacctgcagaatcaaaagctgaaagagcttaacgattggctgaccaagactgaggaacgcactaggaagatggaggaagaacctcttggacccgacctcgaggatctcaagcggcaggtgcagcagcataaggtcctgcaggaagacctggaacaagaacaggtccgcgtgaattcgttgacccacatggtggtcgtcgtggatgagtcctccggggaccatgcaaccgctgcccttgaggagcaactgaaagtccttggagacagatgggccaacatctgcaggtggactgaagatcgctgggtcctccttcaggacatcctcctcaagtggcagcgcctcactgaagagcagtgtctgttttcggcttggttgtcagagaaggaagacgccgtgaacaagatccacaccactggatttaaagaccagaacgaaatgctctcgtcgctgcagaagctggcggtgctgaaggcagatcttgaaaagaagaaacaatcgatggggaagttgtacagcctcaagcaggacctgctgtcaactctgaagaacaagtccgttactcagaaaaccgaggcgtggctggacaacttcgctcggtgctgggataacctggtgcagaagttggagaaatcgaccgctcaaatttcgcaggcggtgactaccactcaaccgtcgttgacccagaccaccgtgatggagactgtgaccaccgtcactactcgggaacagattttggttaagcacgcgcaagaggaactgcctccacctccgccgcagaagaaacgccaaataactgtcgataccttggagagactgcaagagctgcaggaagcaaccgatgagctggacctgaagttgagacaagccgaggtcatcaagggctcctggcaacctgtgggtgacctgctgatagactctctccaggaccacctcgaaaaggtgaaggccctgcgaggtgaaatcgcaccactcaaagagaatgtgtcccatgtcaacgatcttgccaggcagctgaccactttgggaatccagctgtccccgtacaacttgtccaccctggaggacctcaatacgcggtggaagctcctgcaagtggcggtcgaagatcgcgtgcgccaactccatgaagcacaccgggatttcggaccagcttctcagcactttctctcgacttccgtgcaaggtccgtgggaaagagccatttcaccaaacaaggtgccctactacatcaaccacgagactcagactacttgctgggatcaccctaagatgaccgagctgtaccagtcgctggcagacctcaacaatgtgcggttctccgcctaccggaccgcaatgaagctccggcgactccagaaggcactctgtctggacctcttgtcgctctctgcagcttgcgacgccctggaccagcataatctcaaacaaaacgaccaaccgatggacatcctgcagatcatcaactgcctcactaccatctacgatcgcttggaacaggagcacaataatctggtgaatgtgccgttgtgcgtggatatgtgcttgaactggctgctcaatgtgtacgataccggccgtacgggaaggatccgcgtcctgtcctttaagaccggcatcatcagcctctgcaaggctcacctggaggataagtatcggtacctgttcaagcaggtggcctcctcgaccggattttgcgatcagcggcggctgggactcctgctgcacgatagcatccaaattccgcggcagctcggagaagtagcctccttcggtgggtcgaatatcgagccgtccgtgcgaagctgttttcagttcgcaaacaacaagcctgaaatcgaggcagcactcttcctggactggatgcgcttggagccgcagtctatggtgtggctcccagtgttgcatcgggtggctgctgcagaaacggcgaagcatcaagctaaatgcaatatctgcaaggaatgcccgatcattggattccgctaccgctccctgaagcatttcaactacgatatctgccagagctgctttttcagtgggagagtggcgaagggacacaaaatgcattacccaatggtcgaatactgcacccctaccacctcaggtgaggatgtgagggatttcgcaaaggtccttaagaacaaattcagaaccaaacgctactttgccaagcacccgagaatgggctacctcccagtgcagacggtgctggaaggcgacaacatggaaaccgataccatg

SEQ ID NO: 251301 - DNA, 3591 bp, Artificial Sequence
  Description of Artificial Sequence: Synthetic coding sequence
atgctgtggtgggaggaggtggaggactgctacgagcgggaagatgttcagaaaaaaacttttacaaagtgggtgaacgcacagttctccaaatttgggaaacagcacattgaaaatctgttctccgacctgcaggacggcagaagactgctggacctactggaggggcttacagggcaaaagttacccaaggagaaggggagtactcgcgtgcacgcactaaataacgtcaataaggcccttcgagtgctccagaacaacaatgtggatctcgtgaatattggatctacggacatcgttgatggaaaccataaacttacgttaggtctgatttggaatatcatactgcattggcaagtgaaaaacgtcatgaaaaacattatggctggccttcagcagacaaacagcgagaagatattgttgtcttgggttagacagagtacacgcaattacccccaggtgaatgtgatcaacttcactacgagctggagcgatgggctagcccttaacgcgctaattcattcacataggcccgatctcttcgattggaattccgtggtgtgtcaacagtccgcaactcaacggttggagcacgcatttaacattgcaaggtaccagttaggcatagaaaagctgttagacccagaggatgtcgacaccacgtaccctgacaagaaaagtatattgatgtatattacttctctttttcaggtgctccctcagcaggtgtcgattgaggccatccaggaagtggagatgctgcctcgcccacctaaagtgacaaaagaggagcacttccagctgcatcatcagatgcattattctcagcagatcacagtcagccttgcgcaggggtacgagcgtactagcagcccaaagccccggtttaagtcctatgcctatacacaagctgcatacgtaacaacgtcagacccgaccagaagcccatttccatctcagcacttagaagctcccgaggacaaaagcttcggcagctccctgatggagagtgaggtgaatctggaccgctatcagactgcactggaggaggtgctctcttggctactctcagcagaggatacactgcaagcacagggcgagataagcaatgacgtggaggtcgtgaaagaccagttccacacacatgagggctacatgatggatctgacggcgcatcagggtagagtcggcaacattctacagctggggtcgaaattaatcggtaccggaaaactctcagaggatgaggagaccgaggtgcaagaacaaatgaatctgttaaactctaggtgggaatgtctgcgcgtggcctcaatggagaagcaaagtaacttgcacagggtcctcatggatttgcagaatcaaaagttaaaggagctgaacgactggctgaccaaaaccgaggagaggactcgtaagatggaggaagaaccgctggggcccgatttggaggacctgaaacggcaggttcagcagcacaaggttttgcaggaggacttagagcaggagcaagtacgggtgaactccctcacccatatggtggtggtggtagatgagtcaagcggcgatcacgccactgctgcactcgaagagcagttaaaggtgctcggggatcgttgggccaatatttgtcgatggacagaggataggtgggtgctgttgcaggacattctgctcaagtggcagcggttgaccgaagagcagtgtctgttttctgcgtggctgtcggagaaggaagatgccgttaataagatccataccactggcttcaaagaccagaacgagatgctgtcctccctacagaagctagccgtactgaaggctgatctggaaaagaaaaaacagagcatgggtaagctgtactccctgaagcaggacctgctgtcaactctcaaaaacaaatctgtgacccagaagactgaggcgtggctggacaactttgcccggtgctgggacaatctcgtccagaagcttgaaaagtccacggcccagatatctcaggcagtgacaaccacgcagccttccctgacgcagactacggtcatggagactgtcacaactgtgaccacccgggaacagattctcgtgaagcatgctcaggaggagctcccgcctcctcctccccagaagaagcggcagatcacagtggacaccctcgagcgtctgcaagagttgcaagaggcgacagacgaacttgatctgaagctgcgccaggccgaggttattaaaggcagctggcagccagtgggggacctgttgatcgattcgcttcaggatcaccttgaaaaggtaaaggccctgcgcggagagatagctccactgaaggaaaacgtgtcccacgtaaacgatctggcccgccaattgaccacattgggtatccagctgtctccctataatctctccacgcttgaggacttgaatacacgatggaaattgttgcaagtggccgtcgaggaccgagtgcgacagttgcacgaagcccacagggactttgggcccgcctcgcagcacttcttgagcacaagcgtgcaggggccatgggagcgagctatcagccccaacaaagtaccatactacattaatcacgagacccaaactacgtgttgggaccatcccaagatgacagaactgtatcaatctttggctgacctgaataacgtgagattcagcgcataccgcaccgccatgaaattgaggagactgcagaaggctctgtgcttggacttgctctccctgagtgccgcctgcgatgccctggaccagcataaccttaagcagaatgatcaacccatggacatattgcagatcatcaactgcctgacaaccatttatgatagattggagcaggaacacaacaacctggtaaatgtcccgttatgcgttgatatgtgcttgaactggctgctaaacgtctatgacaccgggagaactggacgcatccgtgtcttgtcatttaagactggcattatttccctctgcaaagcacacctggaggataagtatcgctatttgttcaagcaggtggcgagctcaaccgggttttgtgatcaacgcagactgggcctcctgttacatgattccatccaaattcctcgccagctcggcgaggtagcttcctttggcgggagcaacatagagccatccgtcaggtcctgcttccagttcgctaacaacaaacctgagatcgaggctgccctgtttttggattggatgcgattagaacctcagagtatggtttggcttcccgttcttcatcgcgtggcagcggcagagacagcgaagcatcaagctaagtgcaatatctgtaaagagtgtccaataatcggttttcggtatcggtctcttaaacactttaattacgacatctgtcagagttgcttctttagcggaagagtcgcaaagggacacaaaatgcactacccaatggttgaatattgtaccccgactacctccggcgaagatgttagagatttcgcgaaggtccttaagaacaagtttcgcacgaaaagatattttgccaagcacccgcggatgggttacctccctgtccagacagtactagaaggggacaatatggaaacggatacaatg

SEQ ID NO: 251302 - DNA, 3591 bp, Artificial Sequence
  Description of Artificial Sequence: Synthetic coding sequence
atgctctggtgggaagaagttgaagattgctatgaacgcgaagacgtacagaaaaagacatttacgaaatgggtcaatgcccaattcagtaagttcggaaaacaacacattgaaaatttgttttccgacctgcaggatggacgacgcttgctggatctgctggaaggtctgactgggcagaaattgccaaaagagaagggatcaacccgtgtccacgccctgaataacgtgaacaaggccctcagggtgctgcagaataacaatgtggacctggtgaacatcggaagcactgatattgtggatggcaaccacaagctgacattggggctgatatggaacattattcttcattggcaggtaaaaaatgtaatgaagaacattatggccggcctccaacaaacgaactctgagaagatcctgctctcttgggtcagacagtctactcgcaattatccccaagttaacgttattaattttacaacttcatggtctgatgggctcgctctgaatgcgcttattcattcccacagacccgacctgttcgattggaactccgttgtatgccagcagtctgcaacacagcggctagagcatgccttcaatattgctagataccagttgggaattgagaagctgctggaccccgaagacgtcgacaccacataccctgataagaaatctatcctcatgtacattacgtcactcttccaagttctaccacagcaggtgtccatcgaggcgattcaggaggtagagatgcttccacggcctcccaaggtgaccaaggaagagcactttcaactgcaccaccagatgcactattcgcagcagattacagtcagcctcgcccaggggtatgagcgcacatcaagtcccaagccacgtttcaaatcgtacgcttacacacaagctgcatacgtaacaacctctgatcctactaggagtcccttcccgtctcagcacctggaggctcctgaggataagtcatttggaagctccttgatggaatcagaagtgaacctggaccggtaccagaccgcactcgaagaggtgctcagctggctgctgagtgcagaagacacgctccaggcccagggggagatttcgaacgacgtagaggtggtaaaggatcagtttcacactcacgaaggatatatgatggatctgacagcacaccaaggccgggttggcaacatcctccagctcggcagcaagttaatagggacggggaagctcagcgaagacgaagagactgaggttcaggagcagatgaacttgttgaactcgagatgggagtgtctgcgggtcgcgagtatggagaaacaatctaatctacaccgggtgctgatggatttacagaaccagaagctcaaagaactgaatgattggttgaccaagacagaagaacgcacccggaaaatggaagaggaaccattaggcccagatctggaagaccttaagaggcaggttcagcaacacaaggtcttgcaggaggacctggaacaggagcaggtgcgtgtcaactcattgacccacatggtcgtggtggtagacgagtcttcaggagatcatgcgactgcagcactggaggagcagttgaaggtcttgggggatagatgggccaacatttgtaggtggactgaagacagatgggtcctcttacaagacatcttgctgaaatggcagagacttaccgaggaacagtgcctcttttctgcctggctgtctgagaaggaggacgcggtgaacaaaatccatacaaccggcttcaaagaccagaacgagatgctttctagcctgcagaagctggccgtgcttaaagccgacctggagaaaaaaaagcagagcatgggcaagctgtacagcttaaagcaggacttgctcagtactctgaaaaacaagagtgttacgcagaaaacggaagcgtggcttgacaattttgcccgctgctgggataatctcgttcagaagctggaaaagtctactgcccagattagtcaggcagtcaccaccactcagccttctctgacacaaacaaccgttatggaaacagtcaccacggtcacaactagggagcaaattttagttaagcacgcccaagaggaactgccacctccacccccccaaaagaagagacagatcactgttgataccctggagaggttacaggaactccaggaggcgacggacgaactcgatcttaagttacgacaggcagaggtcattaagggtagctggcagcccgtcggggatcttctcatagactctctccaggaccatctcgagaaagtgaaagccctaagaggggagatagctcctctcaaagagaatgtgtcccacgtgaacgacttggctaggcagctgacaaccctcggcatccagctctccccatacaacttgagtaccttagaggatcttaatacccggtggaagctgctgcaggtggcagtagaagatcgcgtgagacagctacacgaagcacaccgcgattttggacctgcctcacaacacttcctgagtacaagtgttcagggaccatgggagcgtgccattagtccaaataaggttccatactacattaaccatgaaactcagacaacttgttgggatcaccccaaaatgacagagctgtaccaatccctggctgatcttaacaatgtgagattctcggcttacaggacagccatgaagttgcggcgacttcagaaggcactgtgtctggatctgctgagcctctccgcggcttgcgatgccctcgatcagcacaatttgaagcagaacgatcagcccatggatattctgcagattatcaactgcctcaccactatctatgatcggctggagcaagaacataataacctggtgaacgtcccactgtgcgtggacatgtgcctgaactggttactgaatgtttacgacaccggccgaacaggaaggatacgggtcctgtcctttaaaacaggtattatatccctctgcaaggcccatctggaagacaaataccgatacttgtttaagcaggtagcaagttcaacagggttttgtgaccagagacggctgggactgctgcttcacgactcaatccagatcccgagacagctcggagaagtggctagtttcggagggtccaacattgaaccaagcgtccggtcatgtttccaatttgccaataataaaccggagatcgaagctgcactgttccttgattggatgcgactggaaccacaatccatggtgtggctcccagtgctgcaccgggtagccgccgctgaaacagcaaaacatcaggccaagtgcaatatctgcaaggagtgcccgattattggttttaggtaccgatccttgaaacactttaattacgacatctgccagagctgttttttctctgggagggtggctaagggtcacaagatgcactaccccatggtcgagtattgcacgcctactaccagtggtgaagatgtgagggatttcgcaaaagtcctgaagaataagttcaggaccaagcggtactttgctaaacaccccaggatggggtacctccccgttcagacggttctcgagggtgacaacatggagacggacactatg

SEQ ID NO: 251303 - DNA, 3591 bp, Artificial Sequence
  Description of Artificial Sequence: Synthetic coding sequence
atgctgtggtgggaggaagtggaagactgctacgaacgggaggatgtgcagaagaagaccttcacaaagtgggtgaatgcacagttttccaagttcgggaagcaacatattgagaacctgttttccgacctgcaggatggccgtcgtttactggacttgctggagggtctcacaggccagaagcttccaaaggagaagggctctacacgcgtgcacgcactgaacaacgtgaataaggcacttagagtcctccagaataacaacgtggacctcgtcaacattgggtcaaccgatatcgtggatgggaaccacaagctgacattgggacttatctggaacataatcctgcactggcaggtcaagaatgtcatgaaaaatattatggccgggctgcagcagacaaactccgagaagatccttctaagctgggtgagacagtctaccaggaactacccccaagtgaacgtgatcaatttcactactagctggagtgatggtctagccttgaatgctctcattcatagtcatcggccagatctgttcgactggaacagcgtggtgtgtcagcagagtgctacacagcggctcgaacatgcctttaacatcgccagatatcaattaggtatcgaaaagctgttggatccagaggatgtggacaccacttaccctgataaaaaatccatccttatgtatatcactagtctgttccaggttctgccacaacaggtttctatagaggcaatacaggaggtggagatgcttcctcgcccacccaaggtgacaaaagaggagcacttccagctccaccaccagatgcactactcccaacagatcacagtttctctagcacaggggtatgagaggacaagtagccccaagccaaggttcaagtcttacgcctatactcaggcagcctatgtgactactagtgatcctactcgatcacctttcccctctcaacaccttgaggcacctgaggacaagtcttttggttctagcctgatggagtctgaggtcaatctggatcgttaccagactgcactggaagaggtcctgagttggctcctcagcgctgaagatacccttcaggcccagggtgaaattagcaacgatgtggaagtggtgaaagaccagttccacactcatgaaggctacatgatggacctcactgcccaccagggcagggtgggcaatatactacaacttggcagtaaactaataggtaccggaaaactgtctgaggatgaagagaccgaggtgcaggaacagatgaacctgttgaacagcagatgggagtgtctcagagtggctagtatggaaaaacagtccaacctacaccgagtcctgatggatctgcaaaatcagaagctgaaggagctgaacgattggttaactaaaactgaggagcggacccgcaaaatggaggaggagcctctaggccctgatttagaggatctgaagagacaggtgcagcagcataaagtcctgcaggaagacctggaacaggagcaagtccgagtgaattccctgacacacatggtggtagtcgtcgacgagagctccggcgatcacgccacagccgccctggaggagcagctaaaggttctgggggacaggtgggctaatatctgtaggtggaccgaagaccggtgggtgttgcttcaggatatactactgaagtggcaaaggttaactgaggagcagtgcctgttcagtgcatggttatctgagaaggaggatgccgtgaacaaaattcacacaacagggtttaaagaccagaacgaaatgctaagcagcctgcagaagttggccgtgctgaaagctgacctagaaaaaaaaaagcagtcaatgggtaagctgtatagcctgaaacaggaccttctgagtacactaaagaacaagtctgtgactcagaagacagaggcatggctggacaatttcgcacgctgctgggacaacctggtgcagaaactagagaaaagcaccgcccaaatttctcaggccgtgacaaccacacagccatctcttacacaaaccacagtcatggagacagttacaaccgttacaacccgagagcagatactggttaaacacgcccaggaagagctcccacccccaccccctcagaagaagaggcaaataaccgttgataccctggaaaggttacaggaactgcaggaggctacagatgaactcgacctgaagctgcgtcaggcagaggtgatcaaaggcagttggcagccagtcggggatctgttgatagacagtttacaggatcacttagagaaagtcaaagccctaagaggggagatagcaccactgaaagagaacgtgagccatgtgaacgatctggcacggcagctgacaacccttggaattcagctgtctccctacaacctgtcaaccctcgaagacctgaacactcgctggaaactccttcaggtagctgtagaggaccgggttcgtcaactgcacgaagcacaccgcgatttcggcccagcttcccagcattttctctccacctctgtgcagggtccatgggagcgggcaatatcacctaataaggtgccatactacataaatcatgaaacccagaccacctgctgggatcatcccaaaatgacagagctataccagtccctggccgacctgaataacgttcgttttagtgcttaccggaccgcaatgaagctcaggcgtctgcagaaggccctgtgcctggatctgctttctctatctgccgcctgcgacgctctggatcagcataacctcaagcagaatgatcagcctatggacattctacagattataaactgccttaccactatatacgaccgtcttgagcaggagcacaacaatctggtcaacgtcccactgtgtgtggatatgtgtctaaactggctcctgaacgtgtatgacaccggtcgcaccggacgtatacgcgtgctgtcattcaagaccggtataataagcctctgtaaagcccacctggaggacaagtacagatatctcttcaagcaggttgctagctctaccggcttctgcgaccaacgcaggctggggctgctactgcacgactccatacagatcccacgtcagcttggagaggttgccagttttggcgggagcaacatagagccctccgtacggagttgttttcagttcgccaacaataagcctgagatcgaggcagcactgttcctggactggatgagacttgaaccccagtctatggtctggctccccgtgctgcatagggtggctgccgccgagacagcaaagcaccaggctaaatgtaacatttgtaaagagtgtcctataataggatttcgctataggagcctgaagcacttcaactacgatatctgccagtcttgctttttttctggccgtgtggctaaaggacacaaaatgcactaccctatggttgaatactgcacacccaccaccagtggcgaggacgttagggactttgctaaggtgctgaagaacaagtttcgaactaaaaggtattttgctaaacacccaaggatgggatatcttcccgtacagaccgtcttggaaggagacaacatggagaccgacacaatg

SEQ ID NO: 251304 - DNA, 3591 bp, Artificial Sequence
  Description of Artificial Sequence: Synthetic coding sequence
atgctctggtgggaggaggtcgaggactgctatgagcgtgaggatgtgcaaaagaaaacctttaccaagtgggtgaatgcacaattctcgaaatttggtaagcagcatattgaaaatctgttttcggacctccaagacggtagacgacttctcgacttactggagggcctgaccggtcagaagttgccgaaagagaaaggttcgacccgggtccacgccctaaataatgtaaataaggcgctgcgcgtcctgcagaacaacaatgtggacctggttaatatcggtagtactgacatcgtagacggtaatcacaagctcacactgggtcttatctggaacatcatcctccattggcaagtgaagaatgtgatgaaaaacataatggcgggtcttcagcaaaccaactccgaaaagattctgctgagctgggttcgccaatccactcgaaattaccctcaagttaacgtcattaacttcactaccagctggagcgatggtctggcattgaatgctttgatacattctcaccgcccagacctcttcgattggaacagcgtggtttgtcagcaaagtgccactcagcgcttggagcacgccttcaatattgcacgttatcaactgggtatcgagaagctcctggacccggaagatgttgacaccacttacccggacaagaagtccatattgatgtatattaccagcctgttccaagttttgccacagcaagttagcattgaggcgatccaggaggtggaaatgctgccacgcccaccgaaggtaacgaaggaggaacacttccaactgcaccaccagatgcattattcccagcaaatcacagtctccctggcgcaaggttacgagagaaccagcagcccaaagccccgcttcaaaagctatgcatacacgcaagcggcctacgtgaccaccagcgacccaacgcgctcaccgttcccatcccagcacctcgaagcaccggaggataaaagcttcggttcatccctcatggagagcgaggttaatctggaccgctatcaaacggcactggaagaggtcctgagctggctgctgagcgcggaggacaccctacaggcgcagggcgagatcagcaacgacgtcgaggtcgtcaaagatcagtttcatacacacgaggggtatatgatggacctgaccgcccaccaggggcgcgttggtaatatcctacaactcggaagcaaactgattgggaccggcaaactgagtgaggatgaggaaaccgaggtgcaagagcagatgaacctgctgaatagcagatgggaatgtctacgggtcgcgtccatggaaaaacagtcgaatctgcaccgggtcctcatggacctgcagaaccagaagctgaaggagctgaacgactggttgaccaagaccgaagagcgcacacgaaaaatggaggaagagccgctggggcctgatctggaggacctgaagcgccaggtccagcagcacaaagtgttgcaggaagatctggaacaagagcaagtgagggtgaatagcctgacccacatggtcgtcgtggtggacgaaagtagcggcgaccacgccaccgcggccctggaagagcaactgaaggtcctgggtgatcgctgggccaatatttgcaggtggaccgaagatcgatgggttctcctgcaggatattctgctgaaatggcagcgtctgaccgaggaacagtgcctgttttctgcttggctgtcagagaaggaagacgcagtgaacaagatacatactaccggttttaaggatcagaatgagatgttaagcagtcttcagaaactggcagtcctgaaggctgatttggagaagaagaaacaatctatgggcaaactgtactccctgaaacaagatttactgagcaccctgaagaataaatccgtcacacaaaaaaccgaagcgtggctggacaacttcgctaggtgttgggataacttggtgcagaagctggaaaagagcacggcccagattagccaggctgtgactaccactcagccttcattgacgcaaaccaccgttatggagaccgttaccaccgtcaccactcgcgaacagatcctggtaaaacatgctcaggaggagcttccaccaccacctccacagaagaagcgccagatcactgtggacactcttgagcggctgcaggagttgcaggaggccacggacgaactggatctgaagctgaggcaggccgaggtcattaagggtagctggcagccggtgggtgacctgctgattgacagtctgcaggaccacctggagaaagtcaaagccctgcgcggcgagatcgcaccactaaaggagaatgttagccacgtgaatgatttggctcgtcagcttactacgttggggattcagctgagcccttataatctcagcactttggaggacctaaacacaagatggaaactgctgcaggtcgcagtcgaggatcgcgttagacaactgcacgaagcgcatcgtgacttcgggccagcgtcacagcattttctgtctacttccgtgcaaggcccgtgggagagagccatctctccaaacaaggttccgtattacattaatcacgaaacccagacgacgtgttgggatcatccgaagatgaccgaactttaccagtcactggcggatctgaacaacgtgcgctttagcgcctaccgtactgccatgaagttgagacgcctgcagaaagcactttgtctggacctgctgagcctgtccgcagcttgtgatgcgctcgatcagcacaatctgaagcaaaacgaccaaccaatggatatcctgcaaatcattaattgtcttaccactatttacgaccgtctggaacaggaacacaataacctggttaatgtccctctatgtgttgacatgtgcctgaattggctgctgaatgtctacgacactggtcggactggccgtatccgagtgctgtcattcaagaccgggattatttctctatgtaaggcacacctggaagacaagtatcggtatctctttaagcaagttgctagcagcacgggtttctgcgatcaacgccggctgggtctgcttcttcacgattctattcagatcccgcgtcaactgggggaggtggctagcttcggcggcagcaacatagagccgagcgtgcggtcctgtttccagtttgcgaataataagccagagatcgaggctgcactcttcttggattggatgcgcttagagccgcagtccatggtgtggctgcctgttctgcatcgcgtggcagccgctgaaacggcgaaacaccaggccaaatgtaacatctgcaaggagtgtccaattatcggatttcgttaccgctcattgaagcattttaactacgacatctgtcaatcttgtttctttagcggtcgggtcgcaaagggtcataagatgcactatccaatggtggagtactgcactccaacgaccagcggagaagacgttagagattttgcaaaggtactgaagaataaatttcgcactaaacgctacttcgccaagcacccacggatggggtatttacccgttcagacggtcctggaaggcgataacatggagaccgatacgatg

SEQ ID NO: 251305 - DNA, 3591 bp, Artificial Sequence
  Description of Artificial Sequence: Synthetic coding sequence
atgctgtggtgggaagaggtggaggattgctatgaacgggaggacgtgcagaagaaaaccttcactaagtgggtcaacgcacaattctcgaagtttgggaaacagcatatagaaaaccttttctccgatcttcaagatggtcggagacttctggatttacttgaagggctcaccggacagaaacttcccaaggagaagggatccacaagagtccacgccttaaacaacgttaataaagctctgagggtgttacagaacaacaatgttgatttggtgaacatcggttccacagacatagtggatgggaatcataaactgacactgggtctgatttggaatataatactacattggcaggtgaagaacgtgatgaaaaatattatggcaggactccaacagacaaatagtgaaaagattctcctcagctgggtacgccagtccactagaaactatccccaggtcaacgtgatcaatttcaccacctcctggtccgatggactggccctaaacgcgctgattcactctcatcgaccggatttatttgattggaactcggtcgtttgtcagcagtcagccactcaaaggctcgagcacgcattcaatatagctcgctatcaactgggaatcgaaaaactcctcgacccagaggatgtagacaccacctacccagacaaaaagtccattctgatgtatattacaagtttgtttcaggtgctgccacagcaggtaagtatagaggcaatccaggaagtagagatgttgccacgccccccaaaggtcacgaaagaggagcacttccagttgcatcaccaaatgcactacagccaacagataactgtttcacttgcacaaggatatgagagaacctcttccccaaaacctcgctttaagtcctatgcgtacacacaagcagcttatgtcactaccagcgatcccacccgatctccttttccatcgcagcatctcgaagccccagaagacaagtctttcggatcgtcattaatggagtccgaagtgaatttggaccgttatcaaactgctctggaagaagttctgtcgtggctattgtcagctgaagatactctacaagctcagggggaaatctccaatgatgtggaggtggtcaaagaccagtttcacacccacgaaggctatatgatggatttgaccgctcaccagggccgggttggtaatatcctgcagctcgggtccaaattgattggcacagggaaactgtctgaagatgaggagacggaggttcaggaacagatgaacctcctgaacagtagatgggagtgcctcagggtagcatcaatggagaagcagagcaacctgcaccgtgtcctgatggatctgcagaaccagaagctgaaagagttgaatgattggttgaccaaaactgaagaaaggactcgcaagatggaagaagagccactggggccagatctcgaagacttaaagcggcaggtgcagcagcacaaagtgttgcaggaagatctggagcaggaacaagtccgtgtaaacagcttaacccacatggttgtcgtagttgacgagtcctccggtgaccacgctacagctgccctggaggaacagctgaaggtgttgggagatcggtgggcaaatatatgcaggtggacggaagatcgctgggtactgctccaggacattctcctgaagtggcagagattaactgaggaacagtgtctcttctcagcctggctgtcagaaaaagaggacgctgtgaataaaattcatactacaggctttaaagatcagaatgagatgctgtcgtccctgcagaagcttgccgtgctgaaggcggacttggagaagaagaaacaaagcatgggcaagttgtattccttgaagcaggacctgctgtctactttgaaaaataaatcagtgacgcagaaaactgaagcgtggctcgataacttcgctaggtgttgggacaatctggtgcagaaactcgaaaagtctactgcccagataagccaagctgtcactacgacacagccctctctgacccagacaaccgttatggaaaccgttaccacagtcactactcgagaacaaattctcgtgaagcatgcacaggaggagcttccgccgcccccaccccagaaaaagcgccagataaccgtagacaccttagaacgactgcaagaactgcaggaggcaacagatgaattggacctgaagctccgacaagccgaagtgatcaaaggcagctggcaacctgtgggcgatttacttatcgattctctgcaggatcatctggagaaggtgaaggccctccgcggcgagatcgctcctcttaaggaaaatgtaagccatgtgaatgatctggcccgccagcttacaactctgggtatccaactctctccttataatctatctaccctcgaggacttaaatactagatggaaacttctgcaagttgcggtggaagaccgagtgcgtcagttgcacgaagcacatagggattttggacccgcctcccagcacttcttgtccactagtgtgcaggggccgtgggagcgtgcaatcagtccgaataaagtgccctactacatcaaccacgagactcagacaacatgctgggaccaccccaagatgaccgaactataccagtcactggcagatttaaacaatgtcaggttttccgcatatcgaactgctatgaagctgagacgcctacagaaggccctgtgtctcgatttactaagtctcagcgcggcttgcgatgccctggaccagcacaacctaaaacagaacgatcagccaatggacatactacagattattaactgcttaaccaccatctacgacagactggaacaggagcataacaacttggtgaacgtgcccctgtgcgtggatatgtgcttgaactggctgctaaatgtgtacgacacagggagaaccggcagaatccgcgttttgtcattcaaaacaggtattatctccctttgtaaagcccacctagaggacaagtatcggtacctgttcaagcaagtggcatcttcaaccggcttttgcgaccagcggcgcctgggtctgctactgcacgattccatccagatccctagacaattgggcgaggtggcttcatttggcggatcaaatattgagccgagtgtgcggagctgtttccagttcgctaacaacaagcccgagatcgaggccgctctgttcttggattggatgagattggaaccccagtcaatggtgtggctaccagtactgcatcgggtcgccgccgcagagacagctaagcatcaggctaagtgcaatatctgcaaggaatgtccgattattgggtttcggtaccggtccctgaagcattttaattacgacatttgccagagctgctttttttcaggcagggtggccaaaggccacaaaatgcactatcccatggtggagtactgtacaccaacaaccagcggcgaagatgtccgcgacttcgccaaggtgctgaagaataaattcaggactaagcgctattttgccaaacacccccgaatgggatacctccctgttcaaacggtgcttgagggcgataatatggaaaccgataccatg

SEQ ID NO: 251306 - DNA, 3591 bp, Artificial Sequence
  Description of Artificial Sequence: Synthetic coding sequence
atgctttggtgggaagaagtcgaagattgttacgaacgtgaggatgtccaaaagaaaacttttactaagtgggtgaacgcgcagttttcgaaattcggcaagcaacatatcgaaaatctgttctcggaccttcaagacgggaggaggcttctggatctgcttgaaggactgaccggtcaaaaactgccaaaggaaaagggaagcacccgtgtgcatgcattgaacaacgtcaataaggctctgagagtcctccagaacaataatgtggatctggtgaatatcggaagcaccgacatcgtggacggaaaccataagttgactcttggactgatatggaacattatactgcattggcaagtcaagaacgtgatgaagaacatcatggctggcctgcagcaaaccaactcggaaaagatactgcttagctgggtgaggcaatcaacccgcaactaccctcaagtgaacgtgattaacttcactacctcatggtccgatggacttgcgcttaacgccctgattcactcacaccgtccagatctctttgattggaacagcgtggtgtgtcaacaatccgctactcagagattggagcatgctttcaatatcgcccggtaccagctgggaattgaaaagctgctcgatcctgaagatgtcgacaccacttacccggacaaaaagtccatactgatgtacattactagcctgttccaagtactgccccagcaagtctcgattgaagcaattcaggaagtcgagatgctgccccgcccacctaaagttacgaaagaggagcattttcaacttcaccaccagatgcattactctcaacaaatcacggtgagcctcgcacagggttacgagagaacttcaagcccgaagccccggtttaagtcgtacgcgtacactcaggcagcgtacgtgactacttccgatccgaccaggtccccattcccgagccaacatctcgaagcaccagaggacaaatcgttcggatcgtccctgatggaatccgaggtgaacttggatcggtaccaaacggcactggaggaagtgcttagctggctgctcagcgcggaagatactcttcaggcacaaggagaaatctccaacgacgtggaagtggtcaaagatcaatttcacacccacgaagggtacatgatggatcttaccgctcaccaaggccgggtgggaaacattttgcaattggggtcaaagctgattggaactggaaaactctccgaagatgaagagacggaagtccaagaacagatgaatctgctcaactcgcgctgggaatgtcttagagtggcatccatggagaagcagtccaacctgcaccgggtccttatggatcttcagaaccagaaattgaaggagctgaatgattggctcactaaaactgaagaacggacgcggaaaatggaggaagaacctctcgggccggatctggaagatctgaagcgacaagtccagcaacataaagtgttgcaagaggatctcgagcaagagcaggtgcgggtcaactccctgacccatatggtggtcgtcgttgatgaatcctcgggtgaccatgcaacggcagcactggaagagcagctcaaggtgttgggcgacaggtgggccaacatttgccggtggaccgaggaccgctgggttttgctgcaagatattcttttgaagtggcaacggcttacggaagaacagtgtctgttctcggcatggcttagcgagaaggaagatgcagtcaataagattcacactaccggctttaaggatcaaaatgaaatgctttcctctcttcaaaagctggcggtcctgaaggccgatctcgagaagaaaaaacaatcgatgggcaagctgtactcccttaaacaagaccttctgagcaccctgaagaataagtcggtgacccagaaaactgaagcctggcttgataactttgcaagatgttgggataacctggttcagaagctggagaaatccacggcacagatctcccaagcggtcacgactacccaaccatcccttactcagacgactgtgatggaaacggtaaccaccgtaactacccgggagcaaattctcgtgaagcatgcccaagaagaactccctcctcctccgccacaaaagaagaggcagatcaccgtggacaccctggaacggctgcaggaactccaagaggcaaccgacgaacttgacctgaaactgaggcaggccgaagtgatcaaaggatcgtggcagccagtgggtgatttgcttatagattcactgcaagaccaccttgagaaggtcaaggcactgcgtggggaaatagcaccactgaaagagaatgtgtcccatgtgaatgaccttgcgagacagctcactactcttgggattcagctctcaccatacaatctttcgaccttggaagatcttaatacgaggtggaagctcctccaagtggcagtggaagatcgcgtccgccaactgcatgaagcacatcgcgactttggcccagcttcgcaacactttctgtctacttccgtgcagggaccatgggaacgtgcaattagccctaacaaggtcccttactatatcaaccatgagactcagactacttgctgggatcatccaaaaatgacggagctgtaccagtccctggcagatctgaacaatgtgcgattttccgcctatcgcaccgccatgaagctgagaaggcttcaaaaggcactgtgtctggaccttctctcactctcggcagcgtgcgacgccctcgaccaacacaacctgaagcagaatgaccaaccaatggacattctccagattatcaactgccttaccaccatttacgatcgccttgaacaagaacacaacaacttggtgaacgtgcctctctgtgttgatatgtgcctcaactggcttctgaacgtgtacgataccggtcggactggaagaattcgtgtcctgtctttcaagaccgggatcattagtctttgtaaggcacatctggaagataagtacagatacctgttcaagcaagtggcaagctccacgggcttttgcgatcaacggcgacttgggctccttctccatgacagcattcagattcctagacagcttggtgaagtcgcttcgttcggaggtagcaacatagaacccagcgtgcggagctgctttcagttcgccaacaacaagcctgaaatcgaggcagcactttttctggattggatgcgccttgaacctcaatcgatggtgtggctcccagtgcttcatagagtcgcagccgcagaaaccgcaaaacatcaagccaagtgtaacatctgtaaagagtgccctattatcggtttcagatacagaagccttaaacatttcaattatgatatttgtcaatcatgctttttcagtggcagagtggcaaagggacataagatgcactaccctatggtagaatattgcaccccaactacctcgggtgaggacgtgcgggattttgcaaaggtgctgaaaaacaagtttagaaccaaaagatacttcgctaagcatccccggatggggtacctgcctgtccagaccgtgcttgaaggggataacatggaaactgacaccatg

SEQ ID NO: 251307 - DNA, 3591 bp, Artificial Sequence
  Description of Artificial Sequence: Synthetic coding sequence
atgttatggtgggaggaagtggaggattgttacgagcgggaagacgttcaaaaaaagacctttactaagtgggtgaatgcccaattttccaagtttgggaagcagcacatcgaaaatttattctcggacctccaggatggaaggcgcctgttagacctccttgagggtttgacagggcaaaagctgccaaaggaaaagggctctactagggtgcatgctctgaataatgttaataaggcactgcgcgtgcttcaaaacaacaatgttgatctggtaaatattgggtccacggatatcgttgatggtaaccataagttgacactcggtctgatatggaacataatcctgcactggcaagtgaagaacgttatgaagaacattatggctggattgcagcagaccaacagtgaaaaaattttgttgagctgggttaggcagagcaccaggaattacccgcaggtaaatgttatcaatttcaccactagctggtcagacggactcgcgttaaacgccctgattcatagtcatagaccagatctatttgattggaatagcgtggtctgccagcaatctgccacacaaaggttggaacacgctttcaacatcgcacgctatcagctcggtatcgaaaagttgctggaccctgaggacgtggatacaacctatccagacaagaaaagtattttaatgtacatcacatcactgttccaggtcctgccacagcaggttagtatagaggcgattcaagaggtggaaatgctcccccgaccaccaaaggttacaaaggaggagcatttccaactgcatcatcagatgcactattcacagcagatcacagtttcactagcccagggatacgagcgtacctcctctccaaagccgcggtttaaatcatacgcctatacacaggccgcctacgtgaccacttccgatccgacccgctctcctttcccctcccagcatctcgaagcaccagaggataagtcttttggttcctctctgatggaaagcgaggtcaatcttgataggtaccagaccgccttggaagaggtcttatcgtggctcctttcagccgaggatactctgcaggcccagggggaaatctccaatgacgtcgaggtagtgaaagaccagtttcacacccatgagggatacatgatggacctgactgcccatcaaggccgcgtgggtaacattctacaactcgggagcaagctgatcggcactgggaagctgtccgaggacgaggagaccgaggtacaggagcaaatgaacttattgaactcaagatgggaatgcttaagggtagcatccatggagaagcagagtaacctgcaccgggtgttgatggatctgcagaaccagaagttgaaagagcttaacgattggcttaccaaaactgaggaacggacacgcaaaatggaggaggaaccactcgggccagatctggaggatctcaagaggcaggtccagcagcataaggtcctccaggaagatctcgagcaggagcaggttcgcgtgaactctctcacccatatggtggtcgttgtcgatgagtcaagtggggaccacgccacggcggcattggaagagcagctcaaagtactaggggatcggtgggccaatatctgccgctggaccgaggaccgctgggtattgctgcaggacatcctcctcaagtggcagcgcttgaccgaggagcagtgtctattctcagcatggctgtccgagaaggaagatgccgtgaataagattcacaccacagggtttaaggatcaaaatgaaatgcttagctctttgcagaagttagctgtcctaaaagctgacctggagaaaaagaagcagtctatgggtaaattatattctttgaagcaggacttactctccacgttaaaaaacaagtctgtgacgcagaagacagaagcttggctggataacttcgcccgttgctgggataacctcgttcagaaactagagaaatcgactgctcagatcagccaagcagttacgactacgcagccttccctgacccagactacagtcatggagactgtgaccaccgtcaccaccagggaacaaattcttgtgaagcatgcacaggaagaattacccccgccgcccccccagaaaaaaaggcagattaccgtagacacattagaacgtctccaggaactgcaagaggctactgatgagttggacctaaagttaaggcaggcagaggtgataaagggcagttggcagccggtgggcgacctgctcattgattctctgcaggaccacctcgagaaggtcaaggctctccggggtgaaattgcgccactgaaagagaacgtatcccacgtgaacgacctggcgaggcagctgactactcttggcatccagctcagcccctataacctgtccacactcgaggatctgaatactagatggaaactgttgcaggtagccgtggaagatcgagtgcgtcagctacacgaagcccaccgggatttcggccccgcctctcagcacttcttatcaacctctgtgcaaggaccctgggagagagctatatcgcctaacaaggtgccttactacatcaatcatgaaacccagactacatgctgggatcatccgaagatgacagaattgtaccagtccttggccgacctgaacaatgtgaggtttagcgcctacagaaccgccatgaaactgaggcgcctgcagaaggctttgtgtctagatctgctttcactctctgccgcctgcgatgctctagaccagcataacctcaaacagaatgatcagcccatggacatcctgcagatcattaactgcctgacaacaatctacgatagactggaacaggaacacaataatctggtgaatgttcccctgtgtgtcgatatgtgtctgaactggcttcttaacgtgtatgataccggccggactggaagaatccgcgtgctgtccttcaaaactggcataatctctctgtgcaaagcacatctggaagacaaataccggtacttgttcaaacaggtggccagctccactggtttttgtgaccaacgccggctcggcctgctgttacacgacagtatccagattcctaggcagctcggcgaggtggccagttttggaggcagtaacattgagccatctgtcagaagctgcttccagtttgccaacaacaagcccgagattgaggcagcactcttcttagattggatgcgcctcgaaccccaaagcatggtctggctgcccgttctgcatagggtggcagctgcagaaaccgcaaagcaccaggccaaatgtaacatttgcaaggagtgccctattattggcttccggtatcggagtctgaaacacttcaattatgatatatgccaaagttgctttttctccggccgggttgcgaaaggacataaaatgcactacccaatggtcgaatactgcacccccactacatccggtgaagatgtgcgagacttcgccaaagtgctgaagaataagtttagaacaaaaaggtacttcgctaaacatcccaggatgggctacttgcccgtccagactgtgctcgagggcgacaatatggaaactgatacgatg

SEQ ID NO: 251308 - DNA, 3591 bp, Artificial Sequence
  Description of Artificial Sequence: Synthetic coding sequence
atgctgtggtgggaggaggtcgaggactgctacgaaagggaggacgtgcagaagaaaaccttcactaagtgggtgaacgcgcaattctccaagttcggtaaacaacacatcgaaaacttgttcagcgacctgcaggatggaaggcgcctccttgatctgcttgaaggactcactggacaaaagctcccaaaagaaaagggttccactcgcgttcatgccctgaacaacgtgaacaaagcgttgcgagtgttgcagaacaacaatgtggacctggtgaacattggatccaccgacatcgtagatggcaatcataagctgaccctgggactgatttggaatatcatcctgcactggcaggtgaagaacgtgatgaagaacataatggccggactgcagcaaactaattctgagaagattctgctgagctgggtccggcaatccaccagaaactacccacaggtcaatgttatcaacttcaccaccagctggtctgatggcctcgccctgaacgctcttatccactcacaccgcccagatctcttcgactggaactcagtggtctgccagcaatccgccacccagagacttgagcatgcattcaatatcgcccggtatcagctgggcatagaaaagctgttggacccggaggacgtggacactacgtacccagacaagaagtccattttgatgtacataacctccctgttccaggtgctccctcagcaagtgtccatcgaagcaatccaggaggttgagatgctgccgcgcccacctaaggttactaaagaagaacatttccaactgcatcatcagatgcattatagccaacagatcaccgtgagcctggcccaaggatacgaacggaccagcagtccaaagccgcgctttaagtcgtacgcttatactcaggccgcctacgtgactactagcgacccaactagatccccttttccatcccagcacctggaggccccagaggacaagagctttggttcatcgctgatggaatcggaagtgaacctggatcggtaccaaaccgccctggaggaggtgctctcatggctgctttccgccgaagatacgctgcaggctcagggagaaatctccaacgacgtggaagtagtgaaagaccagttccacactcatgaagggtacatgatggacctgactgcccatcaagggcgggtcgggaacatcctgcagctcggaagcaaacttatcgggactggaaagctgagcgaggacgaggagactgaggtgcaagaacagatgaacctcctgaactcccgatgggagtgcctgagggtggcctcaatggagaagcagtccaatctgcaccgcgtcctcatggatctgcaaaaccaaaagctgaaagaactgaatgattggctgaccaagacggaagagagaactaggaagatggaagaggagccgttgggacctgatctcgaagatctgaaacggcaagtgcagcagcacaaggtcctgcaggaagatttggaacaagaacaggtgcgcgtgaactcacttacccatatggtggtcgtggtcgacgagtcgtcgggggatcatgccactgccgcccttgaagaacaactgaaagtactcggcgaccgctgggctaatatctgcagatggaccgaggaccggtgggtgctcttgcaggacatcctgctgaagtggcaaagactgaccgaagagcaatgccttttttcggcctggctgtcagagaaggaagatgcggtgaacaagattcacactaccgggttcaaagaccaaaatgaaatgctctcctccttgcaaaaactggctgtcctgaaggcggacctggagaaaaagaaacaatcaatgggtaaactctactctctgaaacaagatctgttgtcgaccctgaaaaacaaaagcgtcacccaaaagacggaagcctggctcgataactttgctcggtgttgggataatctggtgcagaaactcgaaaagtccactgctcaaatttcacaagcggtgacgacgacccaaccgtcactgactcagactaccgtcatggaaaccgtcaccaccgtgaccacgcgggagcaaattctggtcaagcacgcgcaggaggaactcccgccaccacctccacagaagaagaggcagattacggttgatactctggagagactccaggagctccaggaagccaccgacgagctggaccttaagttgagacaagcggaggtgatcaaaggctcatggcagccagtgggagatctcctgattgactcgctccaggatcatctcgagaaggtgaaggcgctgcggggtgaaattgcaccgctcaaagagaacgtttcccacgtgaatgatctcgctagacaacttactaccctcggcatccaattgtcgccctacaacctctccactctcgaggatttgaacactcgctggaagctgctgcaggtcgcggtcgaagatcgggtgcggcagcttcacgaagcgcaccgtgacttcggaccagcaagccagcactttctctcgacttcggtgcagggaccgtgggaaagggcaatctcacctaacaaagtcccctactatatcaaccatgaaacgcagactacctgctgggaccatcctaagatgactgagttgtaccaatctctggccgacctgaataacgtgcggttttccgcctataggaccgctatgaagctgcggcggctgcagaaggcactgtgtctggacctgctgtcactgtcagcggcatgcgacgcgctcgaccaacacaacctcaagcaaaacgaccagccgatggatatcctgcagatcatcaactgcctgactaccatctacgaccgcctggagcaggaacacaataacttggtcaatgtgccgctgtgcgtggacatgtgcctcaattggctgctcaacgtgtacgacacgggcagaaccgggcggatcagagtgctttcgttcaagactggaatcatctccttgtgcaaggcgcaccttgaggacaagtacagatacctctttaagcaggttgctagcagcaccggattctgtgaccagaggcgtctcggccttctcttgcacgactcaatccagatcccgcgccagctgggagaggtcgccagcttcggaggaagcaatatcgaaccttcagtgaggtcgtgtttccaattcgcaaataacaagccggagatcgaagccgcacttttcctcgattggatgcggctggagccacagtctatggtctggctcccggtactgcaccgggtggctgcagccgaaaccgctaagcatcaggcgaagtgcaacatctgtaaagaatgcccgatcatcggattccgttaccggtcgcttaagcacttcaactacgacatttgccagtcctgcttcttctcagggcgggtggccaagggacacaagatgcactacccgatggtggaatactgcactcccactactagtggagaggacgtgcgcgacttcgctaaggtcctgaagaataagttccgcaccaagagatacttcgccaagcatccgcgcatgggttacttgccggtccagaccgtgctggaaggagacaatatggaaaccgataccatg

SEQ ID NO: 251309 - DNA, 3591 bp, Artificial Sequence
  Description of Artificial Sequence: Synthetic coding sequence
atgctgtggtgggaggaagtcgaggattgttatgagcgggaagacgtccagaaaaagacgtttacaaagtgggttaacgctcaattttccaagtttgggaaacagcacatcgagaatctgtttagtgacttgcaggacggccgtaggctcctggacttactggaggggctcaccggacagaagctgccaaaagaaaagggttctactagggtccacgcgctgaacaacgtgaataaggctcttagagtgctgcagaataataacgtggacctcgtgaatattgggagcaccgatatagttgacggaaaccataaattgacattgggacttatctggaacattatcctgcattggcaggttaagaacgtcatgaagaacatcatggcaggccttcagcagaccaactctgaaaagatcttgctgagttgggtgaggcagtcgactcgcaactatccgcaggttaatgtcattaacttcacaacctcttggtccgatgggttggcactgaatgcccttatccattcccatcggcccgatctctttgactggaatagcgtggtctgtcagcagagcgccacgcaacgcctggaacacgcattcaatatcgccagataccagctaggcatcgagaaactcctagatcctgaagacgtcgacaccacatatcccgacaagaaaagtatcttgatgtatatcacaagcctgtttcaggtgctgccccagcaggtgtctatcgaagccatccaggaagtggaaatgttaccgcggcccccaaaggtgaccaaggaagagcatttccagctgcaccatcaaatgcattactctcagcagattaccgtcagtctggcacagggctatgaaagaaccagctcaccaaaacctcgcttcaagagctatgcttatacccaggctgcctatgtgacaacctctgaccccacccggtctccctttccttcgcagcatctcgaagcaccagaggacaagtcgtttgggtcttctctcatggagagcgaagttaacctggacagatatcagaccgcactggaggaggttttatcttggctcttgtccgccgaagacaccctccaggctcaaggagaaatttccaacgacgtcgaagtggtgaaggaccagttccacacacatgaaggttacatgatggatcttacggcccatcagggtcgcgtgggaaatatcctgcagttggggagcaaactgattggcaccgggaaactcagtgaagatgaggagaccgaagttcaggagcaaatgaatcttctcaattccaggtgggaatgtctgagggtcgccagtatggaaaagcaatcaaatttgcaccgcgtgctcatggatttgcagaaccagaagctgaaagaattgaacgattggttaacaaagacagaggagcgaacccggaagatggaggaggagcccctcggcccagatttggaggacctgaaacgccaggtacagcagcacaaggtgctacaagaggacctggagcaggagcaagtcagagtcaattcccttacccatatggtagtcgttgtggatgagtctagtggggaccacgcaacagcagctctggaggaacagctgaaagtgctaggggacaggtgggccaatatttgtaggtggaccgaggaccggtgggtgctgctacaggatatactgctcaagtggcagcgattgaccgaggaacaatgcctattctccgcatggctttcagagaaagaggatgccgtcaacaagatccataccactgggtttaaagatcagaatgagatgctgtcatccctccaaaaactggccgttttaaaggcggatctggagaagaagaagcaaagtatgggaaaactgtattctctgaagcaggacttgctttccaccctcaaaaacaagtcagtgactcagaagacagaggcctggctcgataacttcgctcgttgctgggataacttggttcagaagcttgagaaatcaactgcacagattagtcaagcagtgaccactacccagcccagcttgactcagacgaccgtgatggagacagtaacaacggtaacaactcgtgaacagatattagtgaagcatgctcaggaggaattacctcctccacctcctcaaaaaaaaaggcaaatcactgtggacaccttggagaggttgcaggagctccaggaggcgacggatgagctagacctgaaactcagacaagcggaggtgattaagggtagctggcagcctgtgggcgacctgctgatcgactcacttcaggaccacctggagaaggtcaaggctctccggggcgaaatcgctcccctgaaagagaacgtctcgcatgtgaatgacctggcgcggcaactgacaacactcggcatccagttgtccccatacaacctgagcaccctggaggatctgaatactcgttggaagctactacaggtcgctgttgaggatagggtgaggcaacttcacgaggcccaccgcgacttcggccctgcttcccagcatttcctgtccacaagcgtccagggcccctgggaaagagccatttctcctaacaaagtaccttactatataaatcacgaaactcagaccacgtgttgggatcaccctaaaatgaccgaactgtaccaaagcttagccgacctgaataatgttcgattcagcgcttacagaacagctatgaagcttagaaggcttcagaaagctctgtgtctcgatctgctctctctgtcagcggcgtgcgacgctctggaccagcataaccttaagcagaacgatcagcctatggatattcttcagatcatcaactgcctgacgacaatctatgacagactcgagcaggagcacaataacctggtgaatgtgcctctctgtgtcgacatgtgtttgaactggctgctgaacgtgtacgacaccggacgaacagggcgcatacgcgtcctctccttcaagacaggcatcatcagcctgtgcaaggcacacctcgaggataagtatagatatctgtttaagcaggtcgcttctagtactggtttttgtgatcagagaaggctaggccttctgcttcacgatagtatccaaatccctaggcagctaggagaagtggcgtcctttggcggaagtaatattgagccctcagtgcgctcttgcttccaatttgccaataacaaaccagaaatagaagctgcactattcctggattggatgagactcgaaccacagtccatggtgtggctgccggtgctgcatagggtagcagctgctgagacggccaaacaccaggcaaagtgtaacatttgtaaagaatgtccaataatagggttccggtatcgctctcttaagcactttaactatgatatatgtcagtcctgcttcttctccggaagagtggccaaagggcataagatgcattaccctatggtcgagtactgtacacctaccacctccggggaggatgtgcgggactttgctaaggtcctgaagaacaaatttagaaccaagagatactttgctaagcaccctaggatggggtatctcccagtccagacagtgctggagggcgataatatggaaactgatacaatg

SEQ ID NO: 251310 - DNA, 3591 bp, Artificial Sequence
  Description of Artificial Sequence: Synthetic coding sequence
atgttgtggtgggaagaggtggaagattgctacgaaagagaagatgtgcaaaagaaaacctttactaagtgggtgaacgcgcagttctccaaattcggaaagcagcacattgagaacctcttcagcgacctccaggacggccggcgcttgttggacctccttgagggactgactggccagaaactgccaaaagaaaaggggtcgacccgggtgcacgcgctgaataatgtgaataaggcgctccgggtgttgcagaacaataatgtggacctcgtcaatatcggcagcaccgacatcgtggacggaaatcataagttgacccttggactcatctggaacataatcctccattggcaggtgaaaaacgtcatgaaaaacatcatggcggggctgcaacagactaatagcgaaaagatcttgctgtcctgggtgcggcaaagcaccaggaactacccacaggtgaatgtgattaacttcacgacctcatggtcagacgggctcgcccttaacgccctcatccacagccaccgccctgacttgttcgactggaactccgtcgtgtgtcagcaatcagccacccaacggctcgagcacgcgtttaacattgcccggtaccaactgggaattgagaagttgctcgacccggaggacgtggatacgacctacccggataagaagtccatactgatgtatatcacgtcactgttccaggtgctgccgcaacaagtgtcgatcgaagccattcaagaagtggaaatgctcccgcgccctcctaaggtcaccaaagaggaacacttccaactccatcaccaaatgcactactcacagcagatcaccgtctcgctggcgcagggatacgaacgcacctcatcgccaaagccaaggttcaagagctacgcgtacacccaggccgcttacgtgactacttccgacccaactcggtcccccttcccatcacaacacttggaggccccggaagataagtcgtttggctcttcgctcatggaatcagaggtgaacctggaccgctaccagaccgccctggaggaggtcctgtcctggctcttgtccgccgaggataccctgcaagcacagggtgaaatatccaacgatgtggaagtggtgaaagaccagtttcatactcacgaaggttacatgatggacctcaccgcacaccagggacgcgtggggaacatcctgcagctcggatccaaactgatcggaaccggcaagctctcggaggacgaagaaactgaagttcaggagcaaatgaatctcctcaacagccggtgggaatgcctcagggtcgcatccatggaaaagcagtctaatttgcacagagtcttgatggatctccagaaccagaagctcaaagaactgaatgattggcttaccaagacggaggaaagaactcggaagatggaggaagaacccctgggacctgatctggaggacctcaaacgccaagtgcagcagcataaggtgctccaggaggatcttgaacaagaacaggtgcgggtgaattcactgacccatatggtcgtggtcgttgacgagtcgtcgggtgaccatgccactgcagctctggaagagcagctcaaggtgctcggcgatcggtgggctaacatttgtagatggactgaggaccggtgggtgcttctgcaggacattctgctgaaatggcaaagactcactgaggaacaatgcttgttctcagcctggctgtccgaaaaggaagatgccgtgaacaagatccatacgactgggttcaaggaccagaatgagatgctctcctcgcttcaaaagctcgcagtgcttaaggccgatctggagaagaaaaagcagtcgatgggaaagctgtattctctgaagcaagacctgcttagcaccctcaagaacaagtccgttacccagaaaaccgaagcctggctggacaatttcgctcggtgctgggacaatcttgtgcagaaactggaaaagagcactgcgcagatttcgcaggccgtgactaccacgcaaccgtcgttgactcagaccactgtcatggaaacggttactactgtgaccacgcgcgaacagatcctggtgaagcacgcccaagaggagctgcctcctccgccacctcagaagaagcggcaaatcaccgtcgacactctcgagcggctccaggaattgcaggaggctaccgacgagctggatcttaagttgcgccaagcagaagtgattaagggatcctggcaaccggtcggagatctcctgatcgacagcctgcaggatcacctggagaaagtgaaggctctccggggagaaatcgcgcccttgaaggaaaacgtgtcgcacgtgaacgacctcgctcgccagctcactaccctgggcattcagctgtcaccctacaacctttccactttggaagatctcaacacccgctggaagctgttgcaggtcgccgtggaagatcgggtgcggcaactccacgaagcgcatagagatttcggtccagcgtcccaacacttcctctccacctcggtccagggaccatgggaacgggcgatctcccctaacaaggtgccgtactacatcaatcacgaaacccagactacctgctgggatcaccccaagatgaccgagctttaccagagccttgcagacctgaacaatgtcaggttctcggcctatcgcaccgcaatgaaactcaggaggctgcagaaggcgctgtgtctggatctgctgtcattgtcggcagcctgcgacgcactggaccagcacaatctcaagcagaacgaccagccaatggacatcctgcaaatcatcaactgcttgactactatctacgaccgcctggaacaggagcacaataatctggtgaacgtcccattgtgcgtcgacatgtgtcttaactggctgctgaatgtctacgacaccgggcgcaccggaaggatccgggttctgtcctttaagaccggtatcatctccctgtgcaaagcccatcttgaggacaaataccgctacctgttcaagcaggtggccagctcgactggattctgcgaccaacgccggctggggctgctgctccatgactccatccagatcccgcgccagctcggagaagtagcctcattcggtggatcaaatatcgaaccgtcggtgcggagctgctttcagttcgccaacaacaaaccagaaatcgaggcggctctgttcctggactggatgagactcgagccacagtccatggtgtggctgccggtgttgcaccgggtggccgccgctgagactgcgaagcatcaggccaaatgcaatatctgcaaggaatgcccgatcattgggtttcggtatcgctctctcaagcatttcaactacgacatttgtcagtcttgcttcttctcgggacgcgtcgctaaaggccacaaaatgcactaccctatggtggaatactgcaccccaacgacgtcgggtgaagatgtgcgcgattttgccaaggtgttgaaaaacaagtttcgcaccaagagatactttgccaaacatcctagaatgggctacctcccagtgcaaactgtgctcgaaggtgataacatggagactgataccatg

SEQ ID NO: 251311 - DNA, 3591 bp, Artificial Sequence
  Description of Artificial Sequence: Synthetic coding sequence
atgctgtggtgggaggaagtggaggactgttacgaacgcgaggacgtgcagaaaaagactttcactaagtgggtgaatgcacagttctccaagtttggaaaacaacacatagagaaccttttttcagatctgcaggatggcagacgcctcctggatcttcttgaaggactgacggggcagaagctgcctaaggagaaggggagcactcgagtccatgcactgaacaacgtcaacaaagcactccgcgtgctccaaaacaataatgtggatctggtcaacattggatccactgatatcgtggacggtaatcataaacttaccctcgggctgatttggaacattatactccactggcaggtgaagaatgtgatgaagaacatcatggcaggacttcagcagactaactccgaaaagatccttttgtcctgggtgagacagtccactagaaattacccgcaggtgaacgtgataaacttcactacgtcatggtccgatggactcgccctgaatgctctgatacactcacatagacctgacctgtttgattggaattccgtggtttgtcaacaaagcgccactcaaagactggaacatgcatttaacatagctcgctaccaactgggaatcgagaagttgcttgatccagaagatgtggatacgacctacccggataagaagtcaattcttatgtatatcacctcgctttttcaagtccttcctcagcaagtttccattgaggcaattcaagaagtggaaatgcttcccagaccccccaaagtgactaaagaggaacacttccaacttcaccatcaaatgcactactctcaacaaattaccgtcagcctggcacaaggatacgaaaggacttcatcgccaaagcccaggtttaagtcatacgcatacacccaggcagcatacgtcactacctcagatcctactcgttcgccattcccgtcccagcaccttgaagcccccgaagataaatccttcggaagctccttgatggaatcggaagtcaatctcgatcgctaccagaccgcattggaggaagtgctctcgtggcttctgtcggcagaggacactctgcaagcacaaggcgagatttcgaatgatgtcgaagtcgtgaaggaccaatttcacactcacgagggctacatgatggacctgaccgcacaccaagggagggttggtaatatccttcaactgggatcgaaactcatcggaactggtaagctcagcgaagatgaagaaactgaagtgcaggaacaaatgaaccttctgaattcgagatgggaatgcctcagagtcgccagcatggagaagcagtccaaccttcatagagtgctcatggacttgcaaaatcaaaagctgaaggagctgaacgattggctgacgaaaaccgaggagcgcacgagaaaaatggaagaagaacctctcggaccagatcttgaagatctcaaaaggcaagtgcaacagcataaagtgctccaggaggacctcgaacaggaacaggtgagggttaattcgctcacccatatggtagtggttgtggacgaatcctccggagatcatgctacggctgcccttgaggaacagcttaaggttctcggagatagatgggctaacatttgtcgctggactgaagatcgatgggtgctccttcaggacattctccttaagtggcaaagacttactgaagaacaatgcctgttctctgcctggctctcggaaaaagaggatgccgtgaacaagattcatacgaccggttttaaggaccagaacgaaatgctttcgagcttgcagaagctcgcggtgctgaaagcagacttggaaaagaagaagcagagcatgggaaagctgtactcactcaaacaagatctgctgagcacgctcaaaaacaagtcagtcactcaaaaaaccgaggcatggcttgataactttgcacgatgttgggacaacctcgtccaaaagctggagaagtcgactgcccaaattagccaagcagtgaccaccactcaaccttccttgacccagaccactgtgatggaaaccgtgactactgtgactactagagagcaaatcctggtcaagcatgcacaggaagaactcccacctccccctcctcagaaaaagcgccaaatcaccgtggatacgctggaaaggttgcaggaactgcaagaagcgaccgatgagcttgatctcaagctgcgacaggccgaagtgatcaaaggatcctggcagccagtgggagatcttcttattgactcccttcaggaccatcttgagaaggtcaaggcactcagaggtgaaatcgctccacttaaagagaacgttagccatgtcaatgatctcgcaagacagctcaccactctgggtatccagctttcgccctacaatctgtcgaccctggaagatcttaacacccgctggaaacttctccaggtggcggtcgaagatcgcgtcagacagctccatgaggcacatcgtgactttggccccgcgtcgcagcactttctgtcaacgagcgtgcaaggtccctgggaaagagcgatcagccctaacaaagtcccttactacattaatcatgaaactcaaaccacctgttgggatcaccctaaaatgaccgaactttatcagtcgctcgctgatctgaacaacgtgcggttttcagcgtaccgaaccgcaatgaaactgcgacgattgcaaaaagcgctttgtctggatctgctgtcacttagcgccgcgtgtgatgcccttgaccaacataacctgaagcaaaatgatcagcctatggacatattgcaaatcattaactgtctgaccaccatatacgatcgactggaacaggagcacaataacctcgtgaacgtgccgctgtgcgtggacatgtgtctcaactggcttctgaatgtttacgacactggccgcaccggacggatacgggtccttagctttaagaccggaattatctcgctctgtaaggcacaccttgaggacaagtaccgctatctctttaagcaggtcgcctcgtcgactggattttgcgaccagcgcagattgggactgctgcttcatgactcaatacagatcccgcgccagctgggagaagtcgcgtccttcgggggaagcaacattgaaccttcggtcagatcctgttttcagttcgcaaataacaaaccggagatcgaggccgcactgtttttggattggatgcggctcgagccacaatccatggtatggctgccagtgctccatcgcgtggctgcagcagagactgccaagcaccaagcaaagtgcaacatatgcaaagagtgtccgattataggttttagatacaggtcccttaagcactttaactatgatatttgccaaagctgcttcttttcaggcagagtcgctaagggccacaaaatgcattaccctatggtcgagtactgtactcccaccacgtccggggaagatgtgcgcgacttcgcaaaagtgctgaagaataagtttagaactaaaaggtatttcgccaagcacccacgaatgggctacctccctgtccagactgtgctggaaggtgacaacatggaaactgacaccatg

SEQ ID NO: 251312 - DNA, 3591 bp, Artificial Sequence
  Description of Artificial Sequence: Synthetic coding sequence
atgctttggtgggaagaagtggaagattgttacgaaagagaagatgtgcagaaaaagaccttcaccaagtgggtgaatgcgcaattctccaagtttggcaagcagcacattgagaaccttttctcagaccttcaagatgggcggcggcttcttgatctcctcgaaggccttactgggcaaaagctgccaaaggagaagggctcaacccgggtgcacgcgttgaacaacgtcaataaggcactgagggtcctgcaaaacaacaatgtcgatctggtcaacattggaagcactgacattgtggatggaaaccataagctgactttgggactcatctggaacattattctgcattggcaagtcaagaacgtgatgaagaacatcatggcgggacttcagcagactaacagcgaaaagatcctgctttcctgggtgagacaatcaactcggaattaccctcaagtcaatgtgatcaactttactacctcctggtcagatggactcgcacttaatgcacttatccattcccatcgccctgatctttttgattggaatagcgtcgtctgtcaacagagcgccacccaacgccttgagcacgcatttaacattgcaagataccagctcgggattgaaaaacttctggacccagaagatgtggacaccacctacccagacaagaaatcgatcctgatgtacataacgtctcttttccaagtgctgccccagcaggtgtccatcgaagcaattcaagaagtggaaatgctcccaaggccaccaaaggttaccaaggaagaacattttcagctgcaccaccagatgcactattcacaacagatcactgtgtcactcgcacagggctacgaaagaacctcgtcccctaaacccaggtttaagtcctatgcatacacccaggcagcctacgtgaccacttcggatccaaccagatcgccgttcccctcgcagcatcttgaagcgccagaagataagagctttgggtcctcgcttatggaatccgaagtcaatctcgatagataccaaacggcactggaggaagtgctctcctggctgctgtcggccgaagataccctgcaagcgcagggggaaatatccaacgatgtcgaagtggtgaaggatcagtttcacacccatgagggctacatgatggatctgaccgcccaccaaggcagagtcgggaatattcttcagctcggatcgaaacttattgggaccggaaagttgtcggaagatgaggagactgaggtgcaagaacagatgaatctgctgaactcccgctgggaatgtctgcgtgtggcctcgatggaaaagcagtccaacttgcatagggtgctgatggacctgcagaaccagaagctgaaagaacttaacgactggctgaccaagactgaagaacgcactagaaagatggaagaagaaccgctgggtcccgatctggaggatcttaaacgccaggtgcaacaacataaggtgcttcaggaagatctggaacaggaacaagtgagagtgaactcgcttactcatatggtggtcgtcgtggacgaatcgtcgggagatcatgccaccgcagccctcgaagagcaactgaaggtgctgggagacagatgggcaaacatttgcagatggacggaagatcggtgggtgctgcttcaggatatcttgctcaagtggcaaaggcttactgaagaacagtgcctgttctcagcctggctctcggagaaggaggatgcagtgaacaagattcataccaccggatttaaggatcaaaacgaaatgctgtcctcgcttcaaaagctggcagtgctgaaggcagatctggaaaagaaaaaacaaagcatgggcaagctctactcactgaagcaagatctgctgagcactctcaagaacaagagtgtgactcagaaaaccgaggcctggctggataacttcgccagatgttgggataacctggttcaaaaacttgaaaagtccactgcgcagatatcccaagccgtcacgactactcagccctcgcttacgcaaactaccgtgatggaaactgtgactaccgtcactacccgagaacagattcttgtgaaacatgcacaagaggaactcccgcctcctcccccacagaagaagaggcaaattaccgtggataccctggaacggctccaagagctccaagaagcaactgatgaactcgatctgaaactccgtcaagccgaagtcatcaagggtagctggcagccagtgggagatctgctgattgactccctccaggatcatcttgaaaaagtgaaggccctgagaggagaaattgcgccgctcaaggaaaatgtgagccacgtgaatgatctggcacggcagcttaccactctggggatccaactttcgccatacaatctctccacccttgaggacctgaacacgcgatggaagttgctccaagtggcagtcgaggatcgagtgaggcaactgcatgaggcgcacagggattttggacctgcaagccaacatttcctctcgacctcggtgcaaggaccctgggagagagcgatttctccaaataaggtgccatactacatcaaccacgaaactcaaaccacttgctgggatcatcccaagatgaccgagctttaccagagccttgcggaccttaacaacgtacgcttttcggcttaccgcactgctatgaaactgcgtcggcttcaaaaagcactctgtctggatctcctttccctttcggcagcatgtgacgccctggaccagcataatctcaagcagaatgatcaacctatggatattctccagattatcaattgtctcaccaccatttatgatagacttgaacaagaacataacaatctggtgaatgtccccctttgtgtggatatgtgtctgaactggcttcttaatgtgtacgacaccggccggaccggaaggatcagagtcctgtcgtttaagaccggaatcatttcactttgcaaagcccacctggaagataagtaccgttatttgttcaaacaggtcgcgtcgtctacgggattttgtgaccagcggaggctgggacttctgcttcacgattccattcagatacctcggcaactgggagaggtcgcatcattcggcggatcgaacatcgaacccagcgtgcggagctgcttccagtttgccaacaataagccagagatcgaagcagccctgttcttggactggatgagactggaaccacaaagtatggtgtggttgcctgtgttgcatcgcgtggcagccgcagaaaccgcaaagcatcaagcgaaatgcaatatctgtaaagaatgtccgattattgggttccgctacagatcgctgaaacactttaactacgacatatgccagtcgtgcttcttttcgggccgcgtggcaaagggccacaagatgcattaccctatggtggaatactgtactccgacgacctcaggtgaggacgtgcgcgattttgcaaaggtgcttaagaacaaattcagaactaaaagatactttgccaagcaccccagaatgggttacctccctgtccaaaccgtgcttgaaggtgataacatggaaaccgacactatg

SEQ ID NO: 251313 - DNA, 3591 bp, Artificial Sequence
  Description of Artificial Sequence: Synthetic coding sequence
atgctatggtgggaagaggtggaggactgctacgagagggaagacgtccagaaaaaaacatttacaaagtgggttaatgcacagtttagcaagttcggcaaacaacacatcgagaatcttttctcggatctgcaggacggaagaaggcttttggacctccttgaggggctgactggacaaaagctcccaaaggagaagggatcaaccagggttcacgctttgaacaacgtcaacaaagccctgcgcgtgttgcaaaacaataacgttgatctggtgaacatcggctctacagatattgtggatggtaaccacaagctcacactgggccttatttggaacatcatactgcactggcaggtaaaaaacgtcatgaaaaatattatggctggacttcaacaaacgaactccgagaaaatcctgctgagttgggttagacagtctacccgcaactatccacaggtgaacgtgataaacttcacaacctcttggagcgatgggctggccctcaacgccctgattcactcccaccgcccagacttgtttgactggaacagcgtcgtgtgccaacagtcagccacacagcgtctggagcacgcttttaacatcgcacgataccaattaggaatcgaaaaactgttggaccctgaagatgtggacacaacctatcccgataagaaaagtatcttaatgtatataaccagcctgtttcaagttctgccccagcaggtgagcattgaagcaatccaggaggtagagatgctccctcgcccgccaaaggtcacaaaagaagaacactttcagctgcaccaccagatgcactattctcagcaaatcacagtgtccctcgcccagggctacgaacggacgagctctccgaaaccaaggttcaagagctatgcctatacccaagctgcctatgtgacaaccagtgacccaactagatcaccatttccctcacaacacctcgaggccccagaagataagtcttttggtagttccttaatggaaagcgaagtgaatctggataggtatcagacagcacttgaagaggtgttgagctggctccttagcgcggaagataccctccaagcgcaaggcgagatcagcaacgatgtcgaagttgtaaaagaccagtttcatactcacgagggttacatgatggacctgaccgcccaccaaggaagagtcggaaacatccttcagcttggcagtaagctgatcggcactggcaagctgagcgaagatgaggaaactgaggtgcaggaacagatgaaccttctgaacagcagatgggagtgcctgagggttgcaagtatggagaaacaatctaacctgcaccgagtcctgatggaccttcaaaaccagaaactgaaagaattgaacgattggctgacaaaaaccgaggaaaggacacgaaagatggaagaggaaccactggggccagatctagaggatctcaagaggcaagtccaacaacacaaggtcctgcaggaagacctcgaacaagagcaggtccgggtgaactccttgacacatatggtggttgtcgtcgatgaaagcagcggagaccatgctacagccgcacttgaagagcaacttaaggtactgggggatcgatgggctaacatttgtcgttggacggaggataggtgggtgctcctgcaggatatcctgctcaaatggcagaggctgactgaagaacagtgcttattttctgcttggctgtctgaaaaagaagacgcagtcaataaaatccacacaaccggatttaaagatcagaatgagatgctctctagtctgcagaaactggccgtgttgaaggctgaccttgagaagaaaaaacagtccatgggaaaactgtactctctgaagcaagatcttcttagtactctcaaaaacaagagtgtgacccagaaaacagaggcttggctggataacttcgcacgctgctgggacaacctggtccagaaactggagaagtccactgcgcaaatctcacaggcggtgacaaccactcagcctagcctcacccaaaccaccgtcatggaaaccgtgacgaccgttacaacccgtgagcagatcctggtgaaacatgcgcaggaagagctgcccccaccacctccacagaagaaaagacaaatcaccgtcgatactctggagcggctccaggaactccaagaggctaccgacgagctagatctcaagctgaggcaggccgaagtcataaagggaagttggcagcctgtgggggatctgcttatagattctttacaggatcatttggagaaagttaaagcactgaggggagagattgcccctctgaaagagaatgtgagccatgtgaacgatctggcacgccaacttaccactctcgggatccaactgagcccatacaacctgagcaccttggaggatctgaatacgcgatggaagctgctgcaagtggccgtggaagatagggtgagacagctgcacgaggcccaccgtgattttggcccagcctctcaacacttcctgtctactagtgtgcagggtccttgggaacgcgcaatcagccccaataaggtgccatactacatcaaccacgagacgcagactacctgctgggaccatcctaagatgacagaactctatcaaagcctagcagatctgaataacgtgcgcttttccgcttatagaaccgccatgaaactcagaaggctgcagaaggcactgtgtcttgacctgctgtcactctctgctgcttgtgacgctcttgatcagcataacctgaaacaaaacgatcaaccaatggatatactccagatcattaactgtttgacaactatttacgacagactggagcaggagcacaacaaccttgtgaacgtgcctctttgcgtggatatgtgtctcaactggctgcttaacgtttacgataccggccggactggaagaattagagtcctgtcattcaaaactggcatcatctccctctgcaaggcccatcttgaggacaagtacaggtatctgtttaaacaagtcgcctcaagcacagggttttgcgatcaacggcgcttggggcttctactgcatgatagcatccaaattccaagacagctgggcgaagtggctagtttcggcgggagcaacatcgagcctagcgtgcgttcgtgtttccaattcgctaacaacaaacctgagatagaggctgctctttttctggattggatgcggttagaacctcaaagcatggtttggctgccagtgcttcatagggtggctgccgctgagaccgccaagcaccaggcgaaatgcaatatttgcaaagaatgtcctataatcggatttcgttataggagccttaaacatttcaattacgacatctgtcaatcttgctttttcagcggaagagtggcaaagggacacaagatgcattatccaatggtcgaatactgcactcctacaaccagcggagaagatgtgcgtgatttcgctaaagttctcaagaacaaattccgcactaaaaggtacttcgcgaaacatccgcgcatgggctacctccccgtgcagactgtcttggagggcgataacatggagaccgatacgatg

SEQ ID NO: 251314 - DNA, 3591 bp, Artificial Sequence
  Description of Artificial Sequence: Synthetic coding sequence
atgctgtggtgggaggaggtcgaagattgttacgagcgcgaggacgtgcagaaaaagacttttactaagtgggtcaacgcacagttctctaagtttggaaagcaacatattgaaaacctgttctccgatttgcaagacggacggcggctgctcgacctccttgagggattgactggacaaaagttgccgaaggaaaagggatcaactcgggtccatgcgttgaacaacgtgaacaaagccttgagggtactgcagaacaacaatgtggaccttgtgaacattggttcgactgatatcgtggatggcaatcataaacttaccctgggactgatctggaacataattctgcattggcaagtgaagaatgtgatgaagaatatcatggctggactgcagcagaccaactccgaaaagattctcctgagctgggtgagacaatcgacccggaactaccctcaagtcaatgtgatcaacttcaccactagctggtccgacggtctggccctgaatgctctgatccattcccaccggcctgatttgttcgattggaactcggtggtgtgccaacagagcgccactcagcgactggaacacgcatttaacatcgccaggtaccagctgggtatcgagaagctgctggacccggaggacgtggatactacctacccagacaaaaagtcgatcctcatgtacattacttcgctctttcaagtcctgccacagcaggtgtcgatcgaagccatccaagaagtggagatgttgccgcgcccgccgaaggtgacgaaggaggagcactttcagctgcaccatcagatgcattattcgcagcaaattaccgtctcactggcccagggatacgaacggacctcgagccctaagccgaggttcaagtcgtacgcatacacccaggcggcgtacgtgactacttccgacccaaccagatccccgtttccatcccaacatttggaagccccagaagataagtcgttcggctcttcattgatggagagcgaggtcaacctggaccgctaccaaacggctctggaggaagtgctctcgtggctcctctcagcagaagataccctgcaggcgcagggcgagatctcaaatgacgtcgaagtggtgaaggaccagttccacactcatgaaggatacatgatggacctcactgcccatcaggggcgcgtgggcaacatcttgcagctgggatcgaagctcatcggaactggaaaacttagcgaggacgaggaaactgaggttcaggagcaaatgaatctcttgaactcgcgctgggagtgcctccgggtcgctagcatggagaaacaatcgaacttgcatcgggtgttgatggacctccagaaccagaagctcaaggaactgaacgactggctcaccaagaccgaagagagaacgagaaagatggaagaagaacccctgggaccagacctggaagatcttaagcgccaagtgcagcaacacaaggtgctgcaggaagatctggagcaagaacaggtgcgcgtgaactcgctgactcacatggtggtggtggtcgacgagtcgagcggagatcatgctactgccgccctcgaagagcagctgaaggtcctcggggaccgctgggccaatatctgcagatggacggaggatagatgggtgctcctgcaagacatcctccttaaatggcagagactgaccgaagagcagtgccttttcagcgcttggctgtcggaaaaggaggatgcggtcaataagatccacactactggattcaaagatcagaatgaaatgttgagctcgctgcagaagctcgccgtgctcaaggcggacctggagaaaaagaagcagtccatgggaaaactgtactctctgaagcaggatctgctttcgacgcttaagaataagtccgtgacgcaaaagacggaggcatggctggataacttcgcacgatgttgggacaacttggtgcagaaactggaaaaatccactgctcagatctcccaggcggtgactaccacccaaccgtcgctgactcagaccaccgtgatggaaaccgtgacgaccgtgaccactcgggagcaaatcctggtcaagcatgcacaagaagagcttccgcctcctcctccgcaaaagaagagacaaatcactgtcgatactctggagcgcctgcaggagctccaggaagcgaccgacgaacttgacttgaagctcagacaagcagaggtgattaagggatcctggcagcccgttggagatctgctgatcgattcacttcaggaccatctggagaaggtgaaggcccttcggggagagatcgccccgctgaaggaaaatgtgtcccacgtcaacgacctcgcgcgccagctgaccactttgggcatccagctgagcccctacaatctgtcaaccttggaggacctgaatactcgctggaaactcctccaggtggccgttgaagatcgcgtgcgacaactgcacgaggcgcaccgggatttcggacctgcctcgcaacacttcctctcgacctcggtgcaagggccgtgggagcgcgctatcagcccgaacaaagtgccatactacatcaatcacgaaactcagaccacgtgttgggatcacccgaagatgactgagctgtaccagtcgctggccgatctgaataacgtccggttttccgcttaccgcaccgccatgaagttgcgccgcctccagaaggccctgtgcctcgatctgctctccctcagcgcggcgtgcgatgcgctggaccaacacaacctgaagcagaatgatcagcctatggacatcctccagatcatcaattgtctgacgactatctacgaccgcctggaacaggaacacaacaatctggtgaatgtaccactgtgtgtcgatatgtgcctgaactggctccttaatgtgtatgacactggacggaccggcagaattagagtgctgtcgttcaagaccggcattatctccctctgtaaggctcatctggaggacaaatatcgctacctgtttaagcaggtggcctcgtccacgggattctgcgaccagcgcaggctgggactcttgctgcatgattcaatccaaattccgcgccagctgggagaagtcgcctcattcggaggctcgaacatcgagccgtcagtccggtcctgtttccagttcgctaacaataagccagagatcgaagctgcgctgtttctcgattggatgcgcctcgagccgcaaagcatggtctggctcccggtcctgcaccgcgtggctgccgctgagactgcaaagcatcaggccaagtgcaacatctgcaaagagtgccctatcatcgggttccggtaccggtccttgaagcatttcaactacgatatctgccaatcctgttttttctccggcagggtggcaaaggggcacaaaatgcactacccgatggtcgagtactgtactccaaccacctccggtgaagatgtgagagactttgccaaggtgctgaagaacaagttcagaaccaagcgctactttgccaagcatccaagaatgggatacctgccggtgcagactgtgctcgaaggggacaatatggagacggacacgatg

SEQ ID NO: 251315 - DNA, 3591 bp, Artificial Sequence
  Description of Artificial Sequence: Synthetic coding sequence
atgctttggtgggaggaggtagaggattgttacgagcgggaggacgtccaaaagaagacttttaccaagtgggttaatgcgcaattcagcaagtttggcaagcagcacatcgagaacctgttctccgatctccaggatggcaggagactcctggacctgctggagggcctcacaggtcaaaagctccctaaagaaaaaggttccacccgcgtccatgccctgaacaacgtgaacaaggccttgcgtgtcttacagaataataacgttgacctagttaacatcggttccactgacatcgttgatggtaatcacaagctcaccctcggactgatctggaacatcattctgcattggcaggtgaagaacgtcatgaaaaacattatggctggactacaacagaccaactcggagaaaatccttctgagctgggtccgccagtcaactcggaactacccccaggtcaacgtcatcaatttcaccaccagctggtcggatggcctggcactgaacgccctgatccattcccaccgcccggacctgtttgattggaacagtgtggtttgccaacagtctgccacccagagactggagcacgcattcaacatcgcgcgctaccagctcggtatagagaagctcctcgaccccgaagacgtggacaccacctatcccgacaagaagtccatcttaatgtatatcaccagtttgttccaggttctgcctcaacaggtttcgatcgaggccatccaggaagtcgaaatgcttcctcgccccccaaaggtgaccaaggaggaacacttccagctgcatcaccagatgcattactcccaacagatcactgtctccctcgctcaaggttacgagcggacctcctcgcctaagcctcgcttcaagtcctacgcctacacccaggcagcgtacgtgactacctccgaccccacccgcagccccttcccatctcagcacctcgaagcccccgaagacaagagcttcggctccagcctgatggaatccgaggtgaatctcgatcggtaccagacggcgctcgaggaggtgttgtcgtggctgttatccgcggaggataccctacaggcccagggagagatttctaacgatgtcgaggttgttaaggatcagttccacacgcacgagggctatatgatggacctcactgcccaccagggccgtgtgggcaacattctgcagctgggctcgaagcttatcggcactggaaagttgagcgaggacgaggaaacagaagttcaggagcagatgaacctgctgaacagccgttgggagtgtttaagagtggccagcatggaaaagcagtctaatttacaccgtgttctgatggacttacagaaccaaaagctcaaagagctgaacgactggcttactaaaaccgaggaacgaacgcgcaagatggaggaggagcccctgggtcctgacctcgaggacctgaagagacaagtccaacagcacaaggtcttgcaagaggacctcgagcaggagcaggttcgggtcaactcgctgacccatatggtcgtggtcgtggatgagagctccggagaccacgccactgcagccctggaggagcagcttaaggtgttgggcgaccgctgggccaacatctgtcgctggaccgaggaccgttgggtgttgctacaggacatccttcttaagtggcagcgcctgacggaagagcagtgcctcttctcggcttggttgtccgagaaggaggatgcggttaataagatccataccaccggtttcaaggatcagaatgagatgctcagttctctccagaagcttgccgttttgaaggctgatctggaaaagaagaagcagtccatgggtaagttgtatagtcttaaacaggaccttcttagtacgctgaagaacaagagcgtcactcaaaagactgaagcctggctcgataatttcgcacgctgttgggacaacctggtccagaaactggagaagagcaccgcccagatctctcaggccgtcaccaccacccagccgtccctcacccagacgaccgtgatggagacagtcacgaccgtcaccacccgcgagcagattttggttaagcacgcccaagaggagttaccaccccctcctccccagaagaaacgccagatcacagttgatactcttgagcgcctccaggagctccaggaggccaccgacgagctagacttgaagctccgtcaggcagaggtgattaagggctcttggcaaccagtcggcgatctcctgatagactctctccaggaccacctggagaaggtgaaagctctgcgtggtgaaattgcaccgctgaaggagaatgtctcccacgtcaacgatctggctcgacaattgaccaccctaggtatccagttgagcccgtacaacttgtccacccttgaggacctgaacactcgctggaagttactccaggtcgccgttgaggaccgcgtccggcagctgcacgaggctcaccgcgacttcggccccgcctcgcagcacttcctttcgaccagcgtccagggcccctgggaacgtgccataagccccaacaaggtgccctactacattaaccacgagacgcagaccacgtgctgggaccatcctaagatgaccgaactataccagtcgctcgcggacctgaacaatgtccgattctccgcatatcgtaccgccatgaaactccgtcgtctgcagaaggccctgtgtttagacttgttgtctttgtcagccgcttgcgatgccctggaccaacataacttgaagcagaacgatcagcctatggacatccttcagattatcaattgtctgaccaccatctacgaccggctcgagcaggagcataacaacctggtgaacgttcccctgtgcgtcgacatgtgtctgaattggctgttgaatgtctacgacacgggccgcaccggtcgtatccgtgttctctccttcaagactgggattatttcgctgtgcaaggcacacctggaggacaagtaccgctacttgttcaagcaggtcgcatcctcgaccggcttttgcgaccagcgtcggctgggcctccttttgcacgacagtattcaaatcccccgccagctcggtgaggtggcgtcgttcgggggttctaacatcgagcctagtgtgcgtagttgtttccagttcgcaaacaacaagcccgagatcgaggccgcgctgttcttggactggatgcggcttgagcctcagagtatggtttggctgccggtactgcatcgtgtcgctgctgccgagaccgccaagcatcaagcgaaatgcaacatttgcaaggagtgcccgatcattggatttcgatacagatcgcttaagcatttcaactatgacatctgtcagtcttgttttttctcgggccgcgtcgctaagggccacaagatgcactaccctatggtggaatactgtaccccaaccactagcggtgaggatgtacgcgatttcgcgaaggtcctcaagaacaagtttcggactaagcgctacttcgctaagcatccgagaatgggctacctccccgtccagacggtgcttgagggtgacaacatggagaccgatactatg

SEQ ID NO: 251316 - DNA, 3591 bp, Artificial Sequence
  Description of Artificial Sequence: Synthetic coding sequence
atgctctggtgggaagaggtggaagactgctacgaaagggaggacgtgcagaagaaaactttcactaagtgggtcaatgcgcagttctctaaatttggaaaacagcatattgaaaacctattttccgatctccaggacgggcgtagacttttggacctgctggaggggttaaccggtcagaaattgcctaaggagaagggttccactagggtgcacgccttgaacaatgtcaacaaggctttgagagtcctgcaaaataacaatgtggacctggttaacatcggttcaactgacatcgtggatggcaatcataagctgacgcttgggctgatctggaacatcattctgcactggcaagtaaagaatgtgatgaagaacatcatggccggcctgcagcagactaactccgagaagatactgctgtcgtgggtgaggcaaagcacaagaaattatccccaggtgaatgtaataaactttaccaccagttggtccgacggtctggccctcaacgccctgatacactcccatcgacccgatctgtttgactggaattctgtggtgtgccagcagagcgccacccagcgactggagcacgcctttaacatcgcccgttaccagctgggtatagaaaagctcctggatccagaggatgttgatacgacataccccgacaagaaatctattctgatgtacatcacttctcttttccaggtgctgccccagcaagtatctatcgaagccattcaagaagtggagatgctcccccgacctcctaaagtgaccaaagaggagcattttcagctccatcatcagatgcattatagccagcaaattaccgtctccctggcgcaagggtacgagagaacaagctcccccaagccaagattcaagagctacgcttacacccaggcagcctatgtgaccacctcggatcctacacgcagtccgtttcccagccaacacctggaggcaccagaggataagtcctttgggtctagccttatggaatccgaggttaatcttgacaggtatcagacagccttggaggaagttttgagctggctgctgtccgcggaggacacattgcaggctcagggtgaaatcagcaacgacgtcgaagtggtaaaggaccagttccatacccatgaagggtatatgatggatcttacagcacatcaaggcagagtggggaacattctgcagctgggatctaagctgattggaactggtaagctgtccgaagatgaggaaactgaagtgcaggagcaaatgaatcttctgaactccaggtgggaatgcctaagggttgcttccatggagaagcagtccaaccttcacagggtcttgatggatctccagaatcagaaactgaaagaactgaacgattggctgaccaaaacggaagagaggaccagaaaaatggaagaggagccccttggccctgatctggaggatttgaagcgacaggttcaacagcacaaggttctacaggaagatctggagcaggaacaggtgcgtgtcaattctcttacacacatggtcgtggtggtagacgagtccagtggcgaccatgccacggccgcattggaagagcagttgaaggtattgggcgaccgctgggcaaatatttgccgttggactgaagatcgttgggttctgctgcaggatattcttctgaagtggcagagactgaccgaagagcagtgcctcttctcggcctggctgtccgagaaggaggatgctgtgaacaagatccatactaccgggtttaaagatcagaacgaaatgctttctagcctccagaaactggcggtcctcaaagccgatctggaaaagaaaaaacagtccatgggcaaattgtactctctcaaacaggacttgctcagcaccctaaaaaacaaatctgtgactcaaaagaccgaagcctggctggacaacttcgctcgatgctgggacaatctcgtgcagaaattggagaagtccaccgcacaaatcagtcaggccgtaaccactacacagcccagcctgacccagacaacagtgatggaaaccgtgacaactgtgactacccgagaacagattctagtaaagcatgcacaagaggaactaccacctccccccccccaaaagaagcgacaaattacagtggatactcttgagaggctacaggaactgcaggaggctacagacgagttggacttgaagctgagacaggccgaagttatcaaggggtcctggcagcctgttggcgacctgttgatcgactccttgcaggatcaccttgagaaggtgaaggccttgaggggagagattgctccgctgaaggagaatgtgagccacgttaatgatctggcccggcagctgactacgctgggaatccaactgtccccttataatctgagcacgctggaagatctgaacactagatggaaattgctccaggtcgccgttgaagaccgggtacgacaattacacgaggcacacagagacttcgggccggcctctcaacacttcctctccactagtgtgcagggcccctgggaacgcgcaatctcccccaacaaggtaccctattatatcaaccacgaaacacagacaacttgctgggatcaccccaaaatgacagagctctatcagagtctcgcagatctcaacaatgtgcgattctccgcctatcggacggccatgaagcttagaaggctacaaaaggcactgtgcctggatctgctgtcactgagcgcagcttgcgacgcgttggaccagcataatctgaagcagaacgaccagccaatggacattctgcaaatcattaactgtctgacaacaatctacgacagacttgagcaagaacataataacttggtcaatgtccctctgtgcgtggacatgtgtctgaactggttgctgaacgtttacgatacaggtcgaacagggcgcattagagtcctgtccttcaaaactgggataatcagcctttgcaaggcccacctcgaggacaagtataggtacttgtttaagcaagtcgccagctcaactgggttctgtgaccagagacgcctaggccttctgcttcacgattccatccagatacccagacagttaggagaggtagcctcattcggtggatctaacatcgaaccttctgtgagaagctgtttccagtttgcaaataacaagcccgagatagaggctgctctttttctggactggatgcgattggaaccccaatctatggtctggctgcccgtgctgcatagggtggccgccgccgagaccgctaagcaccaggctaagtgcaacatatgcaaggagtgcccaattataggttttcggtatagatcattgaaacacttcaactacgatatctgtcagtcctgttttttcagcggccgggtcgccaaaggccataaaatgcattatccaatggtggaatactgcacacccactaccagtggggaggacgtgagagatttcgctaaggtcctgaagaataagtttagaacgaagcgatatttcgcgaagcacccaagaatgggttacctcccagtgcagaccgtgttagaaggagacaatatggagacagatactatg

SEQ ID NO: 251317 - DNA, 3591 bp, Artificial Sequence
  Description of Artificial Sequence: Synthetic coding sequence
atgttgtggtgggaagaagttgaggattgttacgaaagagaagacgtacaaaagaagacttttaccaaatgggtgaacgcgcaattttcaaagttcggcaaacagcatatcgagaacttgttcagtgatcttcaggatggtcgtaggctgctagatctcttggaagggttaaccgggcagaaattgcctaaggaaaaaggttcaactcgtgttcatgcgcttaataacgtcaacaaggcgcttagggtgctacagaataacaatgtggatcttgtgaacatcggaagcacagatattgttgacggtaaccataagctcaccctaggactcatttggaacatcattcttcattggcaagtcaagaatgttatgaagaatattatggccggtctacaacagactaactcagaaaagattttactatcatgggtacgccagtcaactagaaattacccacaggttaatgtgataaatttcacgacttcatggagcgatggtcttgctcttaatgcgctaattcactctcatcgacctgacctattcgactggaattctgtcgtgtgtcaacagtctgcgacccagaggcttgagcatgcatttaacatcgcaagatatcaattgggaattgaaaagttgctcgaccccgaggatgtggatacaacatatcctgacaagaagtctatccttatgtacatcacatcccttttccaagttctgcctcaacaggttagcattgaggcaattcaggaggtagagatgctacctcgtccaccaaaggtcacgaaagaggaacattttcagctccaccaccagatgcattattcacaacagattaccgtgtcacttgctcaaggatatgaaaggacctctagcccaaagcctagatttaagtcttatgcttacacacaggctgcttatgttactacttcagatcctactagaagtccgttcccgagccagcatctcgaggctccagaagataagagcttcggtagctcgttgatggagtcagaggttaatcttgatagatatcaaacagctcttgaagaagtgctttcatggttattatccgccgaggatacactgcaggctcagggagagatatctaatgatgtggaggttgttaaggaccaatttcatacacatgaggggtacatgatggatctgactgcacatcaaggtagagttggcaacatattgcaattgggtagtaagttaatcggaacaggcaagctctcggaagatgaggaaaccgaagtacaagagcaaatgaatctacttaacagccgttgggagtgtttgagggtcgcttctatggagaaacagtcaaatctccatagagttctgatggatttgcaaaatcaaaaattgaaggaactgaatgattggcttacaaagactgaagagaggactcggaaaatggaagaggaacctctcggacctgacctcgaagatctcaagagacaagtccaacagcacaaggtccttcaggaagatctcgaacaagaacaggttagagttaacagtttgacacacatggtggttgttgttgacgaatcctcgggagaccacgctaccgcagctttagaggaacagttgaaagtactcggggatcgatgggcaaacatttgccgatggaccgaagatcggtgggttctactccaagatattcttctaaaatggcaacgactcactgaggagcagtgcctcttttcagcatggttgtccgagaaggaggacgctgttaacaaaattcatacaaccggatttaaggatcaaaacgaaatgttaagttccctccaaaagctagcagtgttgaaggccgatcttgagaaaaaaaaacaatctatgggaaagctttattcgttgaagcaggatttactttcaactttaaagaataagtctgttactcaaaagactgaggcttggctcgacaacttcgcgcggtgttgggataacctcgtccagaagttggaaaaatctacagcacaaatctcccaggctgttaccactactcaaccatcgctcactcagacaacggttatggagactgtaactactgtaacgacaagggaacaaattcttgtgaaacatgcccaggaggaattacctcctccaccaccacaaaagaagcgacaaatcactgttgatactcttgaaagattgcaggaattacaagaggcaacggatgaactcgatctcaaattgcgacaagctgaggtcattaaaggtagctggcaaccagttggagatcttctaattgactctttacaggaccatcttgagaaggttaaggctcttagaggtgaaatcgctcctctcaaggagaatgtcagtcatgtcaacgatcttgctaggcaacttaccacgctgggcatccagctgtctccgtacaatctcagcacattggaggatttgaatacccgctggaaactgcttcaagtggctgttgaggacagggtcagacaattgcatgaggctcatcgcgattttggacctgcatctcaacatttcctgtctacatcagtacaaggtccatgggaacgtgctatcagtcctaataaggttccttattacattaatcatgaaacacagacaacttgctgggatcacccaaaaatgactgagctgtaccaaagcttagccgatctgaataacgtgagattcagcgcttatcggacggcaatgaagctcagaagactgcagaaagcattgtgccttgaccttcttagcctctccgcagcttgcgatgcccttgatcagcataatcttaagcagaacgaccaaccgatggacatacttcagataatcaattgtctaacaactatttatgatcgattggagcaggaacataataacttggttaacgtacctctgtgtgttgatatgtgtctcaattggttactgaacgtgtacgacactggaagaacagggagaatacgtgttctgtcattcaaaactgggatcatcagtctttgtaaagcacacctggaggacaaatacaggtacctttttaagcaagtcgcttcctcaacaggattttgcgatcaaaggaggcttgggcttctgcttcatgacagcattcaaattccaagacaacttggtgaagtagcctcatttggaggttcgaatattgagccatcagtcaggtcatgcttccagttcgccaacaacaagcctgaaattgaagccgctttgttcctagattggatgcggttggagcctcaatctatggtttggttgcctgttttacatagggtagctgcggcagagactgctaaacatcaggctaagtgtaacatctgtaaggaatgtcctattattgggtttcgatatcgtagcctgaaacacttcaattatgatatctgccaatcatgttttttctccggtagggtggctaaaggtcacaaaatgcattacccaatggttgaatattgtactccgaccaccagcggtgaagacgttagagactttgctaaggtcttgaaaaataagtttcgaacaaagcgttatttcgcgaaacacccaaggatgggctatctcccagttcaaaccgtgctggaaggagacaatatggagacagatactatg

SEQ ID NO: 251318 - DNA, 3591 bp, Artificial Sequence
  Description of Artificial Sequence: Synthetic coding sequence
atgctctggtgggaggaagtcgaggattgttatgaacgcgaagatgtccaaaagaaaacctttaccaaatgggtgaatgcacagttttcgaagttcggaaagcaacatatagaaaatcttttctccgatttgcaagatggcaggcgacttctcgaccttctggaaggtcttaccggccagaagctccccaaggaaaaaggatccactagggtccatgcacttaacaacgtgaacaaggcacttcgcgtgctccagaacaataacgtggatctggtgaatatcggcagcaccgacattgtggacggtaaccataagttgacgctgggacttatctggaacattatcctgcattggcaggtgaaaaacgtgatgaaaaacatcatggccggacttcagcaaacgaactcggagaagattctcctgtcatgggtccggcagtcgaccaggaactaccctcaagtgaacgtcattaactttactaccagctggagcgatggcctggccctgaacgcactgatccatagccatcgcccagatctttttgactggaactcggtggtgtgtcagcaatcggcaactcaacggctcgagcacgcgtttaacattgcacggtaccaactgggaatagaaaaactcctggaccccgaggatgtggatactacctacccagataagaaatccatcttgatgtacattacttctctgttccaagtgctcccacaacaagtgagcatcgaagcaatccaagaggtggaaatgcttccaagacccccaaaagtgaccaaggaagagcatttccaacttcatcatcagatgcattattctcaacaaattaccgtctccctcgcccagggatacgaacgtacttcgagcccaaaaccgcgcttcaagtcatacgcctacactcaagcagcatacgtgacgacctcggatcctactcgttcaccattcccttcgcaacatctggaagccccggaagataagtcctttggctcgtccctgatggaatcagaggttaacttggataggtaccagactgcgctcgaagaagtgctgtcctggctcctcagcgcagaagatacccttcaagcccagggggaaatcagcaacgacgtggaagtggtcaaggatcaatttcatacccacgaaggctacatgatggatctgaccgcgcaccaaggaagggtggggaatattcttcaacttggatccaaactgattggaacgggcaagctgagcgaggacgaggagactgaagtgcaggagcagatgaaccttttgaacagccgctgggagtgtttgagagtggcatcgatggaaaagcaaagcaacctccacagagtcctcatggacttgcagaaccaaaagctgaaggagcttaacgattggctgaccaagaccgaagaaaggaccagaaagatggaagaagaaccactcgggcctgatcttgaggatcttaagcgtcaagtgcagcaacataaagtgctccaagaggacctggaacaagaacaggtccgagttaattccctgacccatatggtcgtggtcgtcgatgaatcgtccggtgatcatgcaaccgcggccctcgaagagcaactcaaagtgctgggcgaccgttgggcaaacatctgccgatggaccgaagatagatgggtccttctccaagatatcctgcttaaatggcaacggctgaccgaggagcagtgtctgttttccgcatggctgtcggaaaaggaagatgccgtcaacaagattcacactactggattcaaggatcagaacgagatgctgtcatctctgcagaagctggcagtgctgaaggcagatctggagaagaagaagcaaagcatggggaagctctacagcctgaagcaagatctgctgtcaactctcaagaacaagtccgtcacccaaaagaccgaagcctggctggacaattttgctcgttgttgggacaacttggtccaaaaactggaaaaatctaccgcacagatctcacaagcggtgaccaccacgcaaccatcacttactcaaaccaccgttatggagactgtgaccacggtgactaccagagaacagattcttgtgaagcacgctcaggaggaactccctccacccccaccgcaaaagaagcgccagataactgtggatactcttgagcgactgcaggagcttcaggaagccaccgatgagcttgatctgaaacttaggcaagcagaagtcattaaaggttcctggcaacctgtcggtgaccttttgatagactctcttcaagaccatctggagaaggtcaaggcgttgagaggggagattgcgcctctgaaggaaaacgtgtcccacgtcaatgacctcgctagacaactgactaccctcggcattcagctcagcccgtacaacctctccacccttgaagatctgaacaccaggtggaaactgctccaggtggcagtggaagatcgcgtgagacaactgcacgaagcacatagagacttcggacctgcatcgcaacatttcctttccacgtccgtgcagggcccttgggagagagcaatttcacctaataaggtgccctactacattaaccatgaaactcaaacgacctgttgggatcatccaaagatgactgaactgtaccaatccctggccgatctgaacaatgtgagattttcagcataccgtactgccatgaagctccggcgattgcagaaggccctctgcctcgacctgctgtcattgtccgcagcatgtgacgcactggatcaacataatctgaagcagaatgatcagcctatggatattctgcagattatcaactgtctgaccaccatatacgataggctggagcaggagcataacaatcttgttaacgtgcctctgtgtgtggatatgtgccttaactggctcctgaacgtgtacgatacgggaaggactggaaggattcgggtgctttcgttcaagaccggtatcatttcgctttgtaaagcgcatctcgaagataagtatcggtacctgtttaagcaggtcgcaagctccactggattttgtgatcaacgccggctgggtctgcttttgcacgattccatccaaattcctcgacaactcggggaagtcgcatcgttcggagggtcaaatatcgaaccttcagtccgatcgtgttttcagtttgcaaacaacaagcccgaaatcgaagcggcgctttttctcgactggatgcggctcgaacctcagtcgatggtctggcttccagtgcttcatcgcgtcgcggcagctgagacggcaaagcatcaggcaaagtgtaacatttgcaaggaatgtccgataattggattcaggtacagatcccttaagcacttcaattacgacatttgtcagtcctgttttttcagcggcagagtggcaaagggtcataagatgcattatccaatggtggaatactgcaccccgaccacgtcaggcgaagatgtgagagattttgcaaaagtgctgaaaaacaagtttcgcaccaagcgctattttgccaagcaccctagaatgggatacctgcctgtgcaaaccgttctggaaggagacaacatggaaactgacacgatg

SEQ ID NO: 251319 - DNA, 3591 bp, Artificial Sequence
  Description of Artificial Sequence: Synthetic coding sequence
atgctttggtgggaagaagtggaggactgttacgaaagggaagatgtccagaaaaagacctttaccaagtgggtgaacgcacaattttccaagtttgggaagcagcatattgaaaacctgtttagcgatctgcaggatggcaggcggcttctcgatctcctcgaaggccttactgggcaaaaacttccaaaggagaaaggttccacccgagtgcatgctctgaataatgtcaacaaagcactgagagtgctgcagaacaacaacgtcgacctggtgaatatcggatcgactgacattgtggatggtaaccacaaactgaccctcggattgatctggaatatcattctccattggcaagtcaagaatgtcatgaagaacattatggcaggactccaacaaaccaactcggaaaagattcttctgagctgggtgcggcaaagcaccagaaactacccgcaggtgaatgtgattaacttcacgacctcctggtcggatggtcttgcactcaacgcgcttattcattcgcacagacctgatctgttcgattggaactccgtcgtgtgtcagcagtcagcaacccagaggctggaacacgcctttaacatcgcacgctaccagctcggaatcgagaaacttttggatcccgaagatgtggataccacctaccctgacaagaagtcaattctgatgtacattaccagcctttttcaagtccttcctcaacaggtgtccatagaggcaattcaggaagtcgaaatgcttcctaggcctcccaaggtgactaaagaagaacattttcaactgcatcaccaaatgcattactctcaacaaataaccgtctcccttgcccaaggatacgagcgtacttcatcccctaagcctaggtttaagtcgtacgcttacacccaggcggcatacgtgacgacgtcagatccaacgagatcaccattcccatcgcagcatctggaagcacctgaagataagtcctttggttcgtcacttatggagtcagaagtgaaccttgatcgttaccaaaccgcgcttgaggaggtcctgtcgtggctgctctcggcagaggataccctgcaagcacagggagaaatttccaacgacgttgaggtggtgaaggatcaatttcatactcatgagggatacatgatggatctgaccgcacatcaaggccgtgtgggcaacatcttgcaactgggtagcaaacttattggaaccggaaagctgagcgaagatgaggaaacggaggtgcaggagcaaatgaatctgctgaactcccgctgggaatgcctgagagtggcaagcatggaaaagcaatccaatcttcacagagtgctcatggatctgcaaaaccagaaactgaaggagctgaatgattggcttaccaagaccgaggaacgtacccggaagatggaagaggagccactggggcctgatcttgaagatttgaaacgtcaagtgcaacaacacaaggtccttcaagaggacctggagcaagaacaagtacgcgtaaactcgcttacccacatggtggtcgtggtcgatgagagcagcggcgatcatgcaaccgccgcgctcgaagagcagctgaaagtgcttggtgaccgctgggcaaatatctgtcgctggactgaagatcgttgggtgcttttgcaggatatactgctcaagtggcagagactgactgaagaacagtgtctgttctcagcatggctctcggaaaaggaggatgcagtcaacaagattcacactactgggttcaaggaccaaaatgaaatgttgtccagccttcaaaagctcgcagtcctcaaggctgacctggaaaagaagaagcagtcaatggggaaactgtactcccttaaacaagatcttctctcaaccctgaagaataagtcagtcactcaaaagacggaggcgtggctggacaactttgccaggtgttgggataatcttgtccagaaactggaaaagagcactgcacagatctcgcaagcagtgaccaccacccagccgtcgcttactcaaaccactgtcatggaaaccgtcaccactgtgacgactagagaacagatcctcgtgaagcatgcacaggaagaactgccaccaccacctccacagaaaaaacggcagataaccgtggatactcttgaacgtctccaagaacttcaagaagcaaccgatgagctcgatctcaagctccgccaggcagaggtgattaaggggtcctggcaacccgtgggagacttgcttattgacagccttcaagaccatctcgaaaaggtcaaggcgctgagaggtgaaatcgcacctttgaaggagaatgtgtcacatgtgaatgatctggcgcggcagctcaccaccctgggcattcagctttccccctacaaccttagcacgctggaagatcttaacacgagatggaagctcctccaggtggcagtggaggatagagtgaggcaactccacgaggcacatcgggattttggccccgcatcgcaacacttcctgtcgacctccgtgcagggaccatgggaacgggcaatttcgcctaacaaagtcccttattacattaaccatgaaacccaaactacctgctgggatcatccaaagatgaccgaactctaccaatcacttgcagatttgaacaatgtgcggttttccgcgtaccggaccgcaatgaagctccgaaggcttcagaaggcgctctgtctggatcttctgtccctgtctgcggcatgtgacgcccttgatcaacataatcttaagcaaaatgatcaacctatggatattctccagatcataaactgtctgaccactatttacgatcgtctcgaacaagaacataacaatcttgtgaatgtgccactgtgcgtcgatatgtgtttgaactggctccttaatgtgtacgatactggacgcactggtagaatcagagtgctgagctttaagactgggatcatctcactctgtaaagcacacctcgaggacaaataccgctacctgttcaagcaagtggcgtcgtccacgggcttttgtgatcagagaaggcttggcctgctgcttcacgattcgatccaaatccctcgacaactcggcgaagtggccagctttggcggttcaaacattgaaccatcggtgcggtcctgcttccaattcgcaaataacaagccggaaatcgaagcagccctgtttctggattggatgcggctggagcctcagtcgatggtgtggcttcccgtactccatagagtcgcagcagcagagactgccaagcatcaggccaagtgtaacatatgtaaggagtgtccgatcattggttttcgctacaggtcgctcaaacacttcaattacgatatttgccaaagctgctttttcagcggccgcgtggcgaaagggcacaagatgcattatcccatggtggaatactgcactcctactacttccggggaagatgtcagagatttcgcaaaggtcttgaagaacaaatttcggaccaaacgctattttgcaaaacacccgaggatgggttaccttcctgtgcagactgtccttgaaggggacaatatggagactgataccatg

SEQ ID NO: 251320 - DNA, 3591 bp, Artificial Sequence
  Description of Artificial Sequence: Synthetic coding sequence
atgctctggtgggaagaagtcgaggattgctatgagcgagaagatgtacagaaaaaaacatttactaaatgggttaacgcacagttttctaaattcggaaaacagcacatcgaaaacctgttcagtgatctgcaagacggacgacggctgctagacctcttagagggactcacagggcagaaacttccaaaggaaaaggggtccacaagggtccatgcccttaataacgtaaacaaggcactccgcgtcttgcagaacaacaacgtcgacctcgtgaacatcgggtccacagatatagtcgatgggaatcacaaactgactctcgggttgatctggaacataatattgcattggcaggtgaaaaacgttatgaaaaatataatggcaggacttcagcagacaaatagtgagaaaatccttctctcctgggtccggcagtctactaggaactatccacaggtgaacgtgataaattttactacatcatggtccgatgggctcgcccttaatgccctcatccattctcacaggcctgatctgtttgattggaactccgtagtctgccaacagtcggccactcagcggttagaacacgcctttaacatagcccggtatcagctggggatagaaaaactccttgatcccgaagatgtcgatacaacataccccgataaaaaatccatcttaatgtacatcacatcactatttcaagtgcttccccagcaggtctctatcgaggccatccaggaagttgaaatgcttccacgaccacctaaagtgacgaaggaggaacacttccagctacatcaccagatgcactactcacagcagataactgtgtccttagcccaggggtatgaaaggactagttctcccaaacctcggtttaagagttatgcctatacacaggcagcttatgttacaacttcggatcctactaggtctcccttcccctctcagcatttagaagccccagaagataaatccttcggatctagtctaatggagagtgaagtaaatctcgaccggtaccagacagctctagaagaagtcctctcttggctactgagtgcagaagacacactccaggcccagggagagataagtaacgatgttgaagtggtcaaagatcagttccatacacacgaaggatacatgatggatctgactgctcaccagggaagggtagggaatatactccagcttgggtctaagctcatagggactggaaaactgtccgaggatgaagaaacagaagtacaagaacagatgaacctcttaaactctcggtgggaatgtctccgagtagcttctatggaaaaacagagtaaccttcatagagtccttatggatctacagaatcagaaactcaaagaattaaatgattggctcactaaaacagaagaacgaacacggaaaatggaagaagagcctcttggaccggatttagaagacctgaaaagacaggtacaacagcacaaggtcctgcaggaggacttggaacaggaacaggtgagagtgaactccctcacacatatggtcgtagtcgtggatgaatcttccggagatcacgccactgcagcactggaagaacagctcaaggtccttggagataggtgggcaaacatctgtcgctggactgaagatcggtgggtgctgctgcaggacatactgctgaagtggcagcgcttgacagaagaacagtgcctcttttcggcatggttatccgaaaaagaagatgcagtgaacaaaatacatactacagggttcaaagatcagaatgaaatgctgtcttcccttcagaaactcgcagtgctcaaagccgatctggaaaaaaaaaaacagtccatggggaaattatactcactcaaacaggatctcctgagtacactcaagaacaaaagtgtgacacaaaaaactgaagcctggctcgacaacttcgcaaggtgctgggacaatcttgtgcagaaactggaaaagagtactgcacagatctctcaggccgtcacaacaactcagcccagtttaacacagacaactgtaatggaaacggtaacaactgttacaacacgagaacagatactggtgaaacatgctcaggaagaactccccccaccaccaccacagaagaaaagacagatcactgtagatactctggaaagactgcaggaactccaggaagcgactgacgaacttgatctcaaattaagacaggcagaagtgataaagggatcttggcagcccgtaggggaccttctgattgacagtctccaagatcacctcgaaaaggtcaaagctttacggggagagatagcaccattgaaagaaaatgtttcacacgttaatgatctagctcgccagctcacaacactgggaatacagctttccccttataatttatctactctcgaagatcttaacacacgatggaaactgctacaggttgccgttgaagatcgagtccggcagcttcacgaggcccaccgggattttgggccagcttcacagcatttcctttccacgtccgtgcagggaccctgggaacgagcaatctccccaaataaagtgccatattatatcaaccacgagacacagactacatgctgggatcatcccaagatgacagaactctatcagagtcttgctgatctgaacaacgtgaggttctctgcctatcggacagctatgaaactccggaggctacagaaagcactatgcctggatctgttatctctgtctgccgcatgtgatgcacttgatcagcacaaccttaaacagaatgatcagccaatggatatcctgcagatcataaactgtctcactactatttacgatcgactagaacaggaacacaacaacctcgttaacgtgcccctgtgcgttgatatgtgcctgaattggctcttgaacgtgtatgatacagggcgcactggaaggatccgggtgttatcattcaaaacaggaataatatccctctgcaaagctcatctggaagataagtaccggtatctgttcaaacaggtggctagttctacagggttttgtgatcagcgccgtctggggctgcttttacatgactcaatacagataccccggcagttgggggaagtggcatcgttcggagggtctaacatcgaacccagtgtcaggtcttgtttccagtttgctaataacaagccagagatcgaagcagctttgtttttagactggatgagattggaacctcagagtatggtctggctccccgtcctccaccgagtggccgcggcggaaacagctaaacaccaggccaagtgcaacatttgcaaggaatgtcccatcataggatttcgctacagatctctgaaacactttaattatgatatatgccaatcgtgttttttttcaggaagagtggcaaaggggcataaaatgcattaccccatggtagaatattgcacacctactactagtggggaagatgttagagattttgccaaagttctcaaaaacaaattccggacaaaacgctatttcgccaaacaccccagaatgggatacctcccagtgcagactgtgttagaaggagataacatggaaacagacacaatg

SEQ ID NO: 251321 - DNA, 3591 bp, Artificial Sequence
  Description of Artificial Sequence: Synthetic coding sequence
atgttgtggtgggaagaggtcgaggactgttatgaaagggaagatgttcagaaaaagacgttcaccaagtgggtgaacgcccaattctcaaagttcgggaaacaacatatcgagaacctgttctccgaccttcaagacggacgaaggctcctggaccttctggagggactcacgggccagaaattgcctaaggaaaagggcagcaccagggtgcatgccctgaataacgtgaacaaggctctgcgggtgctgcagaacaacaatgtggacctcgtcaatatcggatcaactgatatcgtggatggaaatcacaagctgacgctgggcctgatttggaacatcatcctgcactggcaagtgaagaacgtgatgaagaatatcatggccggcctgcagcaaactaattccgaaaagatcctgctttcctgggtacggcaatcgacccgcaactacccgcaggtgaatgtcatcaacttcaccacctcctggtcggatgggctggcccttaacgcactgatccattcacaccggccggacctgttcgactggaactccgtcgtgtgtcagcagtcggccactcaaaggctcgaacacgcgtttaacatagcgaggtaccagctcggcatcgaaaagctgctcgacccggaggacgtggacactacctacccggacaagaaatccatcctgatgtacattacctccctgtttcaggtgttgccgcaacaagtctcgatcgaagcgatccaagaggtggagatgcttccgcgccctcccaaagtgactaaagaagaacatttccagctgcaccaccaaatgcattactcacaacaaattactgtgtctctggcccaggggtacgagcgcacttcgtcccctaagccgagattcaaaagctacgcatacacgcaggctgcgtacgtcaccacgtccgacccaacccggagcccgttcccatcccaacacctggaggcgccagaagataaatcatttgggagctcactcatggaatcggaagtgaatctggacaggtaccagaccgcgttggaggaggtgctgagctggctcctctcggcagaagatacgcttcaagcccagggagaaatttcaaacgatgtggaagttgtgaaggatcaattccatacccacgagggatacatgatggaccttactgcgcaccagggacgagtgggtaatatcctccagttggggtcgaagctcatcggtaccggaaaactttccgaggacgaggaaaccgaggtgcaggagcaaatgaacctcctgaactcccggtgggaatgcctgcgcgtggcctccatggagaagcagagcaatttgcaccgggttctgatggacctccagaatcagaagctgaaggaactgaatgactggttgaccaaaacggaggaacgcacccggaaaatggaagaagagccgcttggaccggatttggaggaccttaagcggcaagtgcagcaacacaaagttctgcaggaggacctcgagcaagaacaagtgcgggtgaactccttgacgcatatggtcgtcgtggtggatgagtcctcaggcgatcatgccactgctgctttggaagaacagttgaaagtgctgggcgataggtgggcgaacatttgtcggtggactgaggaccgctgggtcctgctccaagatatcctcctcaaatggcagaggctcaccgaggagcaatgcctgttttctgcctggctctcggagaaagaggacgctgtgaacaaaatccataccactgggttcaaggaccagaacgagatgctgagctcacttcagaagctggccgtgctcaaggcggatttggagaagaagaagcaatccatgggaaagctgtacagcctgaaacaggatctcttgtcaactttgaaaaacaagagcgtgacccagaaaactgaggcgtggctggataacttcgcgcggtgctgggacaatcttgtccagaaactggaaaagtcaactgctcagatctcccaggccgtgacgactactcagcctagcctgacccagactactgtgatggaaaccgtgactactgtcaccaccagggagcagatcctggtcaagcacgcccaggaagaacttccgcctcctccgccccagaaaaagagacaaattaccgtggataccctggagcggctgcaggaactgcaagaagccaccgacgaactcgacctcaagctgagacaagctgaggtgatcaaggggagctggcagccagtgggggacctgctgatcgactcgctgcaggaccacttggagaaggtgaaggcactgcgaggcgagatagcccccctcaaggagaatgtctcacatgtgaatgacctggcccgccaactcaccaccctgggaatccagctgagcccgtacaatctgtccactctggaagatctgaacaccagatggaagctcttgcaagtcgccgtggaggaccgggttcggcagctgcatgaggcacaccgcgattttggacccgctagccaacactttctctcgacctcggtgcagggaccgtgggaacgcgccatcagcccaaataaggtgccgtactatatcaaccacgaaactcagaccacttgctgggatcatccaaagatgaccgagttgtaccagagcctggcggacttgaataacgtgcgcttcagcgcataccgcaccgcgatgaagttgagacggctgcagaaagccctctgtctggacctcctgtccctctccgcggcctgcgatgccctggaccaacataatcttaaacagaacgatcagccaatggacattctccagatcatcaactgcctgaccaccatctacgacagactcgagcaggagcacaacaacctggtgaacgttccgctttgcgtagacatgtgcctcaactggctgctgaatgtgtacgataccggccgcactggacgcattagggtcctgtcgttcaaaacgggaatcatctccctgtgcaaagcccaccttgaggacaaataccgctatctgtttaagcaggtggcttcctccaccggcttctgcgatcagagacggttgggactgctgctccacgattcgatccaaatccctcgccagcttggagaagtggccagcttcggaggatccaacatcgagccgtctgttcggtcctgcttccaattcgccaacaacaagcccgagattgaggccgcactctttctcgattggatgcggctcgaaccccagtccatggtatggcttccagttttgcaccgcgttgctgccgcagagactgcgaagcaccaagccaagtgcaacatttgcaaggaatgtcctattatcggttttagatacagatccctcaaacatttcaattacgacatctgccaaagctgctttttctcgggtcgggtggcaaagggacacaagatgcattacccaatggtcgaatactgtaccccgacgacttcaggagaggacgtgagggactttgctaaagtgctgaagaataagttcaggactaagcgctactttgccaagcacccccgcatggggtacctcccagtccagacggtcctcgaaggagacaatatggagactgacactatg

SEQ ID NO: 251322 - DNA, 3591 bp, Artificial Sequence
  Description of Artificial Sequence: Synthetic coding sequence
atgttatggtgggaggaagtggaagattgctatgaaagggaagacgtccagaaaaaaacattcacaaaatgggtaaacgcacaattctcaaaattcggaaagcagcatatagaaaacctctttagtgatctgcaggatgggagaaggctgctggatctgctcgaagggctaacgggacagaaactgcctaaagagaaagggtctactagggttcacgccctaaacaacgtaaacaaggctttacgcgtgctacagaataataatgttgatctagtgaacataggatcgacagatattgtagatgggaatcataaactcacactgggactgatctggaacataatactacactggcaggttaaaaacgtcatgaaaaacataatggctgggcttcagcagactaactcggaaaaaatcctcctctcctgggtgaggcagtctacaagaaattatccacaggtcaatgtgatcaactttacgacatcttggtctgacggactggcgctcaatgctcttatacactctcatcgccccgatctgtttgattggaattcagtggtgtgccagcagtcggctacacaacgacttgaacatgcctttaatatagcacggtatcagctggggattgaaaaactacttgatcctgaagatgtggatacaacttatcccgataagaaaagtattcttatgtatatcacttccttgtttcaggtgctccctcagcaggtttcaattgaagcaatccaggaagtggaaatgctgccccgcccacctaaagtgactaaagaagagcacttccagctgcaccaccagatgcactactctcagcagatcacagtgtccctggctcagggatatgaaaggacatcatcgcccaaaccacgctttaagtcctatgcttatactcaggccgcttacgtcacgacatcggatcccacacgatcccctttccctagtcagcatcttgaagcccccgaagataaatctttcgggtcttctttgatggaatccgaagtaaatctcgatagatatcagacagctctggaggaagtcctatcatggctcctgagtgcggaagatactcttcaggctcagggggaaatatccaatgatgtagaagtcgtcaaagatcagtttcatactcatgaagggtacatgatggacctcacagcccaccagggacgggtcggaaacattctgcagctgggatctaaactgattgggactggaaaactctctgaagacgaagaaactgaagtgcaggagcagatgaatttgctcaatagtaggtgggagtgtctgagggtggcaagtatggagaaacagagtaatcttcacagggttttaatggatctacaaaatcagaaactaaaagaactaaacgattggctgactaaaacagaagaaagaactcggaaaatggaggaggagcccctggggcctgatctcgaagatttaaaaagacaggtccagcagcataaagtcctgcaggaagatctggagcaggaacaggtacgcgttaacagtctcactcacatggtggttgtggtcgatgaatcatctggggatcatgcaactgctgctttggaagaacagttaaaagtgctcggagatcgatgggccaacatttgcaggtggactgaagacaggtgggtacttctgcaggatattcttctgaaatggcaacggctgacagaggaacaatgcctttttagtgcgtggctctccgaaaaagaagatgctgtgaacaagattcatacaactggatttaaagatcagaacgaaatgctctcatcacttcagaaattggcagtcctcaaagccgatcttgagaaaaaaaaacaatccatgggaaaattgtattctcttaaacaggatcttttgtctactctcaaaaacaaatccgtgactcagaaaactgaggcatggctcgataacttcgcccgctgttgggataatctggtccagaagctagaaaagtccacagcccagattagtcaggcagttactactacacagccatctctgacacagacaactgtgatggaaacagtcactacagtgacaacacgggaacagattctcgtaaaacatgcccaggaagaacttcctcccccacctccccagaaaaaacgacagatcactgtagatactctggaacgcctacaggaactccaggaagccacagatgaacttgacctcaaacttcggcaggcagaagtgataaaagggtcttggcagcctgtgggagatttgctgatcgactctctccaggatcacctcgaaaaagtaaaagcacttcggggggagatagctcctctaaaagagaatgtatcacacgtgaatgatcttgcacggcagctcactactcttggaatacagctatccccatataaccttagtactttagaggatctcaatacacgatggaagctgctgcaggtggcggtagaagatagagtgcggcaactccacgaagcccatagggactttggacccgcatctcaacactttctgtcaacaagtgtgcaggggccttgggaacgcgccatttccccaaacaaagtgccttattatatcaaccacgaaacacagactacttgttgggatcacccaaagatgacagagctctatcagtcccttgccgatcttaataacgtcaggttctctgcttataggacagccatgaaactccgccgcttacagaaagccctttgtctcgatcttctgtcactgagtgcagcatgtgatgctttggaccagcacaatctcaaacagaatgaccagcctatggacatcctccagatcattaactgtcttactacaatttacgatcggctagaacaggaacataacaatctcgtaaatgttcccctgtgcgtggatatgtgcttaaactggctgctcaatgtatacgacacagggaggacaggacgaatccgggtcctcagtttcaagactggaatcatatctttatgtaaagcacatctggaagataagtaccggtatcttttcaaacaggtcgcgagttctacagggttctgcgatcagagaaggctcgggcttctgctgcacgacagtattcagatccctagacagcttggggaagtcgcatccttcggaggatctaacatcgaaccctctgttaggtcctgcttccagttcgcaaataataaacccgaaatagaagctgctctcttcctcgattggatgcggctcgaaccccagagtatggtgtggctgcccgtgcttcaccgagtggccgcagcagaaactgccaaacaccaagctaaatgtaatatctgcaaagaatgcccaatcataggattccggtatcggtcccttaagcactttaactatgatatttgtcaatcatgcttcttcagtggacgggtagctaaaggacacaagatgcactatccaatggtcgaatattgcacgcccacaacttcaggagaagatgtgagggatttcgccaaagtccttaaaaacaaattccggacaaaacgatattttgcgaaacatccaagaatggggtacctgccagtgcagacagtgctggaaggagataatatggaaacagatacaatg

SEQ ID NO: 251323 - DNA, 3591 bp, Artificial Sequence
  Description of Artificial Sequence: Synthetic coding sequence
atgctgtggtgggaagaggtggaggactgctacgagcgagaggacgtgcaaaagaaaaccttcaccaaatgggtgaacgctcagttcagcaagtttggaaagcaacacattgagaatcttttctccgacctgcaggacggccggcgcttgctcgatttgctggagggactgactggacagaaactgcctaaagaaaagggctcgaccagggttcatgcgctgaacaacgtgaacaaagccctgcgcgtactgcaaaacaacaatgtggacttggtgaatatcggttcaaccgatatcgtggacggaaatcacaagctgacgctcgggttgatctggaacatcatcttgcactggcaggtcaagaacgtgatgaaaaacatcatggctggcctgcagcaaactaactccgaaaagatcctgctgtcctgggtgcggcagtcgactcgaaactaccctcaggtgaatgtcatcaacttcaccacctcctggtcagatggactcgcactgaacgccctcatccactcgcataggcctgatctcttcgactggaactcagtcgtctgccaacaatcagccacccaacggctggaacacgcttttaacatcgctagataccagctggggatcgaaaagctgctggacccggaggacgtggacaccacctacccagacaagaagtccatcctgatgtacattacctcgttgtttcaagtgctgccgcagcaagtgtcgatcgaggcgattcaggaagtggaaatgctgccacggccgccgaaggtcaccaaggaggagcattttcagttgcatcaccagatgcactactcacagcaaatcacggtcagcctcgcccaaggttacgaacggacctcgagcccaaagccaagatttaagtcgtacgcttacacccaggcggcatacgtgactacttcggaccctactaggagcccgttcccttcgcaacacctggaagcaccggaggacaagtcattcggaagctcactgatggaatcggaagtgaacctggaccgctaccagacggcgttggaagaggtcttgtcatggctcctgtcggccgaagatacgctccaagctcagggagagatctccaatgatgtcgaggtggttaaggaccagttccatactcatgagggctacatgatggatctcaccgcccaccagggccgagtgggtaatatcctgcaactcggatctaaattgatcggtactgggaagctctcagaggatgaagaaactgaagtgcaagaacagatgaacctgctgaattccaggtgggaatgcctgcgcgtggcctcgatggaaaaacagtccaacctgcatcgggtgctgatggatctgcaaaatcaaaagctgaaggagcttaatgattggctgaccaaaactgaagagcggacccgcaagatggaagaagagcctctcggaccagatcttgaggacctcaaacgacaggtgcagcagcacaaggtgctccaggaggatcttgaacaagagcaagttagggtgaactccctgacccacatggtggtagttgtggacgaatcctcaggggaccacgctacggcagcgctggaagagcagctgaaggttttgggagataggtgggcgaacatttgccggtggaccgaagatcgctgggtattgttgcaagacatcctcctcaagtggcaaagactgactgaggagcaatgtctcttctcggcgtggctgtccgaaaaggaggatgcggtcaacaagatccacaccaccggattcaaggatcaaaacgagatgctctcctcgttgcaaaaactggccgtgcttaaggccgatctggagaagaaaaaacaatctatgggaaagttgtactccctgaagcaggacctgctctcgaccctcaagaacaagtcagtcacgcagaaaactgaagcatggctggacaacttcgcaagatgctgggataacctcgtccagaaattggaaaagtccactgcacaaatctcgcaggctgtcaccacgacgcagcccagcctgacccagaccaccgttatggagactgtcacgactgtgaccactcgggagcagatcctggtgaaacatgctcaggaggaactgcctccgccacccccacaaaagaaaagacagatcaccgtggacacccttgagcggctccaggagctccaggaggccactgatgaactcgatttgaaactcagacaggcggaggtgataaagggttcgtggcagccggtgggcgacctcctcatcgatagcctgcaggaccacctggagaaagtgaaggcccttcggggcgaaatcgctcccctcaaggaaaatgtgagccacgtgaatgacctggctaggcaactgaccaccctcggtattcagctgtccccttacaacttgtcgacgctggaggacctgaacacccgctggaaactcctccaagtggcggtggaggaccgcgtccggcagctccacgaagcacatcgcgacttcggtccggctagccaacacttcttgtcgactagcgtgcagggaccgtgggagcgggccatcagccccaacaaggttccgtattacattaatcacgagactcagaccacttgttgggaccacccgaaaatgacggaactctaccagtccctggcggacctgaataacgtcaggttctccgcgtaccgcactgctatgaagctgcgcagactgcagaaggccctctgccttgacttgctgagcctcagcgcagcatgcgacgccctggatcagcataatctgaagcagaatgaccagccgatggacattcttcagatcatcaattgcctgactactatctatgacagattggaacaggaacataacaacttggtgaatgtgccgctctgtgtcgacatgtgtctcaactggctgctcaacgtctacgatactggacggaccggccgcatccgcgtgctgtcatttaagactgggatcatctcactgtgtaaagcccaccttgaggacaagtacagatacctgttcaagcaggtagcgtccagtaccgggttctgcgaccagcgcaggctgggactgcttcttcacgattcaatccagattcctcgccagctgggcgaagtggcatcgtttggcggctccaacatcgaaccgtccgtccgcagctgctttcagttcgcgaacaacaaacctgaaatcgaagctgcccttttccttgactggatgcgactggaaccgcaatccatggtctggttgccggtccttcatcgggttgccgctgcagaaactgcgaagcatcaggccaaatgcaacatctgcaaggagtgcccaatcattggattcaggtatcgctcacttaagcatttcaattatgatatttgccaatcctgctttttctcgggccgcgttgccaagggccacaagatgcattacccaatggtggagtactgtactccgactaccagcggtgaagatgtgcgcgacttcgcaaaagtcctcaaaaacaagttcagaacgaagcgttacttcgctaagcacccccggatgggataccttccagttcaaaccgtgttggaaggcgacaatatggagacggataccatg

SEQ ID NO: 251324 - DNA, 3591 bp, Artificial Sequence
  Description of Artificial Sequence: Synthetic coding sequence
atgctgtggtgggaggaggtggaggattgctacgagagggaggatgtacaaaaaaagacttttactaagtgggtgaacgctcagttctctaagttcggcaaacagcacatagaaaatttgttcagcgatctccaggacggacgccgtctgttggacctgcttgagggcctgacgggccagaaattacccaaagagaaaggatccacacgcgttcatgcactcaacaatgtcaataaggcactccgggtgttgcagaataataacgtggacttggtgaacatcggtagcaccgatatagtcgatgggaaccacaaacttaccttaggactaatatggaatatcattttgcattggcaggtgaaaaatgttatgaagaatattatggcgggcctgcagcagaccaatagcgagaaaattctcctctcgtgggtgcggcagagtacccggaactatcctcaggttaatgtgatcaattttacaacgtcttggtctgatgggttagccctcaacgctctgatacactcccaccggcctgatctgtttgactggaacagtgtagtttgccaacagagtgctacgcagcgtttggagcatgccttcaacattgcccgctaccagctaggaattgaaaaacttctggatcccgaagatgtggatacaacgtacccagataagaagtctattcttatgtatattactagtctgttccaagttctcccccagcaagtgagcatagaggccatccaggaagttgagatgttgccacgcccacccaaagtgacaaaggaggagcacttccagctacatcatcagatgcattacagtcaacaaatcacagtctcactggctcaagggtatgaacgcacgtcctcacccaaaccccgatttaaaagctatgcatatacacaggctgcctatgttaccacttccgaccctacacgcagtcctttccccagccagcaccttgaggcgcctgaggataagtcattcggctcttctctgatggagtcagaggtgaatctggaccgttaccagacagcacttgaggaagtactatcctggttactatccgcggaagacacactgcaggctcagggtgaaatcagtaacgacgtcgaggtagttaaggaccagtttcatactcacgaagggtacatgatggacctaaccgctcaccagggtcgcgtggggaacatccttcagctgggttctaaacttataggcaccggaaaactctcagaggacgaggagaccgaggtgcaagagcagatgaacctgcttaattcccgttgggaatgcctcagggtggccagcatggaaaagcagagcaacctgcatagagttctgatggatctccagaaccagaaactcaaggagctgaacgactggctgaccaagaccgaagagcgcacccgtaaaatggaagaggagccacttggacctgatcttgaggatttgaaaagacaagtccaacaacacaaggttttacaggaggatctcgaacaggagcaggtgcgtgtgaattcactcactcatatggtggttgtggttgatgagagtagtggcgatcacgcaacagcagctcttgaggaacagctcaaagtgctgggcgaccggtgggccaacatctgtcgatggaccgaggatcgctgggtcttgctgcaggatattctcttgaagtggcagcgccttacagaggagcagtgtctgttctctgcctggctctcagaaaaagaagacgctgtaaataagatccataccacgggcttcaaggaccaaaatgagatgttgtcctctctccagaagctagccgttttaaaggcggatctggagaagaagaagcagtctatgggaaaactttacagcctcaagcaggatctgctgtctaccctgaaaaacaagtctgtcacccagaagactgaagcttggctggacaattttgctcgctgctgggacaacctggttcagaaactggagaaatcgactgctcagatcagtcaagctgtaactactacacaaccatctctgacgcagacaacagtgatggaaaccgttacaacagttacaacacgcgagcaaatcttggtcaagcacgcgcaggaagaactgcctccacctccacctcagaaaaaacgacagattaccgtcgatacacttgaacggctacaagagctgcaggaagcgactgacgaattggacctgaagctgagacaggcagaagtgataaagggcagctggcagcccgtaggagacctgttgatcgatagcctgcaggaccacctggagaaggtgaaggctctccgcggcgagattgctcccctaaaagaaaatgtgagccacgtcaacgacctggcaaggcaactgacgactctcggcattcagctgtccccctataacctctccacgctagaggatctgaacacaaggtggaaacttcttcaggtggccgtggaggatcgcgttagacaactgcatgaagcacacagagatttcggccccgcttcgcagcacttcctgagtaccagcgtgcagggaccatgggaacgggccattagccccaataaagtcccttattatatcaatcatgagacccagaccacgtgttgggaccacccaaaaatgacggaactgtatcagtcactggctgacctcaataatgtcaggttcagcgcctataggaccgccatgaagctgcggagactccagaaagcattatgtctggatttgctgagcctgtcagctgcttgtgacgcgctcgatcaacataaccttaagcaaaatgaccagcctatggatatcctgcagataatcaattgcttaacgactatttacgatcgccttgagcaggaacataacaatctggtcaatgtgccgctgtgtgttgatatgtgcctcaactggctcctgaacgtttacgacacaggccggactggacggataagagtactgtcttttaagactggaatcataagcttgtgcaaagcccacctcgaagataaataccggtatctcttcaaacaggtagcctcgtctacaggtttttgtgatcagcgccggctggggctgctgctgcatgattccatccagattccacggcaactgggggaggttgccagcttcggggggtccaacatcgagcccagcgtgcgttcctgtttccagtttgccaataataaaccggaaatcgaagcagctttgtttctggactggatgcgtcttgagcctcagagtatggtgtggcttcctgtcctgcatagggtcgccgcagcagaaacggcaaagcaccaggccaaatgcaacatttgtaaggagtgccccatcatcgggttcaggtaccgctccctcaaacattttaactacgatatttgccaatcttgcttcttcagcggaagggttgccaaaggccataaaatgcactatccaatggttgaatactgcacgcctaccacctcgggcgaggacgtgcgagatttcgccaaggtgctcaaaaacaagttccgcacgaaacggtattttgcaaagcatcctaggatgggttacctccccgtacagaccgtcctagagggagataacatggaaacggacacgatg

SEQ ID NO: 251325 - DNA, 3591 bp, Artificial Sequence
  Description of Artificial Sequence: Synthetic coding sequence
atgttgtggtgggaagaggtggaagattgttacgaaagagaagatgtgcaaaagaaaacttttactaagtgggtgaacgcacaattctcgaagtttgggaaacagcatattgagaaccttttctcagatctgcaggatgggcgcagacttctcgatctgctcgagggcctgaccggacagaaattgccgaaggaaaagggatcgactcgggtccatgcgctgaataacgtgaacaaggccctgcgagtgttgcagaataacaacgttgacctcgttaacatcggatcgactgatatcgtggacggaaatcacaaactgactctgggattgatctggaatatcatcctgcactggcaagtgaagaacgtgatgaagaatatcatggctgggctgcagcaaactaattccgagaaaatcctcctgtcctgggtccggcagtcgaccagaaactatcctcaggtgaatgtgatcaacttcactacttcatggtccgacggcctggctctcaacgccctcattcattcacatcgaccggacctgtttgactggaactcagtggtgtgccagcaatcagcgacccagagacttgaacacgccttcaacatcgcacgctaccaactgggaattgaaaaacttctggacccggaagatgtggacactacctacccggataagaagagcatccttatgtacatcacgtcgctgtttcaggtcttgccgcaacaggtgtccatcgaggccatccaggaagtcgagatgctgccgcgcccgccgaaggtgaccaaggaagagcacttccagctgcaccatcagatgcattactcccaacagatcaccgtatcactggcacagggctatgaacggacctcgtccccaaagccgaggttcaagagctacgcctacactcaggccgcttacgtgactacctcggatccgacgaggtcgccgttcccgtcccagcatctggaagcaccggaggacaagagcttcggatcgtccctgatggaatcagaggtgaatttggaccgctaccagaccgccctggaggaggtgctgtcctggctgctttccgcggaggacaccctgcaagctcagggcgagatttcaaatgacgtcgaagtggtcaaagatcagttccacacccacgaaggatatatgatggacctgactgcacatcagggaagggtggggaacatccttcagcttggaagcaagctgatcgggaccggcaagctgtccgaggacgaagaaactgaagtgcaggaacagatgaacttgctgaatagccggtgggagtgcctccgggtggccagcatggagaagcagtccaacttgcaccgggtcctgatggatctccaaaaccagaagctgaaggagctgaacgactggctgaccaagacggaggagcggacccgcaagatggaggaggaaccgctgggaccagacctggaggacctcaaacggcaggtgcagcagcacaaagtgttgcaagaggacctggaacaggagcaggtgagagtgaacagcctcacccatatggtcgtggtcgtggacgaatcgtcgggcgatcatgccactgccgccctggaagaacagcttaaggtcctcggagatcgctgggctaatatctgtcgctggaccgaagatcgatgggtccttctccaagacattttgttgaagtggcaaagactgaccgaagaacagtgcctgttctccgcgtggctgtcggaaaaggaggacgctgtgaacaagatccataccactgggtttaaagaccagaacgagatgctgtcctcgttgcagaagctggccgtcctgaaggctgatctggagaagaaaaagcaatccatgggtaaactgtactccctgaagcaggatctgttgtccactctcaaaaacaaatccgtgacccagaaaactgaggcctggctcgacaatttcgcccggtgttgggataatctcgtgcagaagctcgagaaatccaccgctcagatttcccaggcggtcaccacgacccagcctagcctgacccagaccactgtcatggaaaccgttactactgtgaccaccagagaacagatcctcgtgaaacatgcgcaggaagagctgccgccaccaccccctcaaaagaagcggcagattaccgtcgacaccctggaacgcctgcaggagttgcaggaagcgacggacgagcttgacctgaagctccgacaggcagaggtgataaagggctcctggcagcctgtgggcgatttgctgatcgactccctccaggatcacctggaaaaggtgaaggccctccggggagagatcgcgcctctgaaagaaaacgtgtctcacgtcaacgacctcgctcggcaactgaccaccctggggatccagctgtcaccctacaacctgagcactctcgaggatctgaatacccggtggaagctcctccaagtggcggtggaggatcgggtgcgccaactccacgaagcacaccgggacttcggaccggcctcccaacactttctgagcacctcggtacagggaccatgggaacgggcgatctcaccaaataaggtgccttactacatcaatcacgagactcaaactacctgttgggaccatcctaagatgactgaattgtaccagtccctggccgacctcaacaacgtgcggtttagcgcctacaggaccgcgatgaagttgcgcagactgcaaaaggcgctctgcctcgacctgctgtcgctctcggcagcctgcgatgcccttgaccaacacaacctgaaacagaatgaccaacctatggacatcctgcaaatcattaactgcctcaccactatctacgatcggctggaacaggaacacaataatcttgtcaacgtaccactgtgcgtggacatgtgcctgaactggctccttaacgtctacgacactggacgaaccggaaggatccgggtgctgtcgttcaagactggtatcatctcgttgtgcaaggcgcacctcgaagataagtaccggtacctgttcaagcaggtggcctcgagcaccggtttttgcgatcaaaggcgtctgggacttcttctgcacgactcgatccagatcccgcgccagctgggggaagttgcctccttcggaggatccaacatcgagccttccgtccgctcctgtttccagttcgccaacaacaagccggaaatcgaagcggcactgttcctggactggatgcgcctcgagcctcagtcgatggtgtggttgcccgtcctgcacagagtggcggccgccgagacggcgaagcaccaggctaagtgcaacatctgcaaggaatgcccaatcatcggttttcgctaccggtcgctgaagcacttcaattacgatatctgtcagtcctgtttcttctcaggaagggttgcgaagggccataagatgcattacccgatggtggagtactgcacccccaccacctcgggcgaggacgtgagagacttcgccaaggtgctgaagaacaagttccggaccaagagatacttcgcgaaacatccacggatgggatacctgccggtgcagactgtgctcgagggcgacaatatggaaaccgacactatg

SEQ ID NO: 251326 - DNA, 3591 bp, Artificial Sequence
  Description of Artificial Sequence: Synthetic coding sequence
atgctgtggtgggaagaggtcgaggactgctacgaacgggaggatgtccagaagaaaacttttactaaatgggtgaatgcacaattttccaagtttggtaagcagcacattgagaatcttttctccgatctgcaagatggccggcgccttctggatctgcttgaaggtctgacggggcaaaagctgccaaaggagaaggggtcgactcgagtgcatgcgctcaataacgtgaataaggccctgcgcgtgctgcaaaacaacaatgtggacctggtgaacattggaagcactgatattgtggatggtaatcataaactgacgttggggttgatttggaacattattctccactggcaagtgaagaacgtcatgaagaacatcatggccggcttgcaacagacgaattccgagaagatccttcttagctgggtccggcaatccacgagaaactacccacaagttaacgtgattaactttactacgtcgtggagcgatggcctcgcactcaatgcactgattcattcccatcgacctgatctctttgactggaactcggtggtgtgccaacagagcgcaactcaaagattggaacacgccttcaatattgcgagataccaactgggtatcgaaaagctccttgaccctgaagatgtggatactacttacccggacaagaaatcgattctgatgtacataaccagcctttttcaggtgcttccccagcaggtatctattgaggcaatccaagaagtggaaatgcttccacgtccacccaaagtgactaaggaagaacactttcaacttcaccatcaaatgcattacagccagcagattactgtaagcctggcacagggctacgagcgcacctcatcgccgaagcctagatttaagtcctacgcgtacactcaggcagcgtacgtcaccacgtcagacccaactaggtccccttttccttcacagcatctggaggcaccagaggataagagctttgggtcctcattgatggaatccgaagtcaacctcgatcgataccagaccgcacttgaagaggtgctgtcgtggctgctgtcggcggaagatactctccaggcacaaggtgaaatcagcaatgatgtcgaggtggtgaaagaccagtttcacactcatgaaggatacatgatggatcttactgcacatcaaggacgcgtcgggaatattctgcaactgggtagcaagctcattggtaccggaaaacttagcgaggacgaagaaactgaagtgcaagaacagatgaacttgcttaattcgcgctgggagtgtctccgtgtggcctccatggaaaagcaatctaacctgcacagggtgcttatggatctgcaaaatcagaagttgaaagaactgaacgactggctcaccaaaaccgaggaaagaacccgcaagatggaagaagaaccactgggaccagaccttgaggatctgaagcggcaagtgcaacaacacaaggtccttcaagaagatttggaacaagaacaagtgcgcgtgaactcccttactcacatggtggtggtcgtcgatgagagttccggtgaccatgcaactgcagcactggaagagcaacttaaggtgctcggcgacaggtgggcgaacatatgccggtggaccgaggatcggtgggtgctgctccaggacattcttctcaagtggcagagactgaccgaagagcaatgtctttttagcgcatggctgagcgaaaaagaagatgcagtgaacaagattcataccactggtttcaaggatcagaatgagatgctgtccagccttcaaaagttggccgttcttaaggctgacctcgagaaaaagaaacagtcaatgggcaaactttatagtcttaaacaagatcttctctccactcttaagaataagagcgtgactcaaaagactgaggcgtggctcgataactttgcaagatgttgggacaatcttgttcaaaaacttgaaaagtccaccgcgcagatcagccaagccgttactaccactcaaccctcgcttacccagactacggttatggaaacggtgaccacggtcactactagggaacagattcttgtgaagcatgcacaagaagagctccctcccccaccgcctcaaaagaaacgccagattactgtggataccctggaacgtttgcaagaactgcaggaggcaaccgatgagctcgatcttaagctgcggcaagcggaggtcatcaagggctcctggcaacctgtgggagatctgctcatcgatagccttcaggatcatcttgaaaaggtcaaggccctgaggggcgagatcgcaccactgaaggagaacgtctcgcacgtgaacgaccttgcacgccagctgacgacccttggaattcagctgtcgccttacaatctgtcaactcttgaagatctgaatactagatggaagctcctgcaagtggctgtggaagatcgagtgagacagcttcatgaggcacatagagattttggccctgcaagccagcacttcctttccacttccgtgcaggggccatgggagagagcgatcagcccaaacaaggtgccgtactacatcaatcatgagactcaaaccacttgttgggaccatccaaagatgacggagctttatcagtcgctcgcagatcttaacaacgttagattttcggcatacagaaccgctatgaaacttcgccgcctccagaaagccctttgcctcgatcttctgtcgttgtcggcagcatgcgatgccctcgaccagcacaaccttaagcaaaacgaccaacccatggacattctgcaaatcatcaactgtcttaccaccatatacgatcggttggagcaagagcataacaacttggtcaacgtccccctctgcgtggatatgtgtcttaactggcttctgaatgtgtacgacaccggtcgcaccggaaggatcagagtcctctcctttaagactggtatcatttccctgtgcaaggcacatctcgaggacaaatatcgctacttgtttaagcaagtggcatccagcaccggtttctgcgatcaacgcagactgggtctgcttctgcacgactcgattcagatccctaggcagctgggcgaagtggcctcatttggtggatccaacatagaaccttcggtgcgttcgtgtttccagttcgcaaacaacaagccagaaattgaggccgcactcttcctggactggatgagactggaacctcaatcaatggtgtggctccccgtccttcacagagtcgcagcagcagaaactgcaaagcatcaagcaaagtgcaacatctgtaaagaatgtccaattatcggatttagataccgctccctcaaacatttcaactacgatatttgtcaatcgtgctttttctcgggaagagtggcaaagggtcataagatgcattatcctatggtcgaatactgtacgcctaccacttcgggcgaggatgtgcgagattttgcgaaagtgctgaaaaacaagttcagaactaagagatactttgccaagcaccccagaatggggtatctgccggtgcaaaccgtgcttgagggagataacatggaaaccgatactatg

SEQ ID NO: 251327 - DNA, 3591 bp, Artificial Sequence
  Description of Artificial Sequence: Synthetic coding sequence
atgctttggtgggaggaagtggaggattgctacgaacgggaagatgtccagaagaaaacgtttaccaagtgggttaacgcccagttctccaagtttggaaagcagcacatcgaaaacctcttctcggacctccaagatggacgcaggctgctggacctcctggaaggactgactggacagaagctgccgaaagaaaagggatcgactcgggtccatgctctgaacaacgtcaataaggcgttgcgcgtgctgcagaataacaatgttgatttggtcaacataggatcaaccgacatagttgacgggaaccacaaactcaccctcggcctgatctggaacatcattctccattggcaggtgaagaatgtcatgaagaatatcatggcagggttgcaacaaaccaactcggagaagatcctgctgtcatgggtcaggcaatccacccgaaactacccgcaggtgaatgtgatcaacttcactaccagctggtcagacggactcgctctgaacgctctgatccactcccatagaccagacttgttcgactggaattccgtggtgtgccagcagtctgccacgcagcggttggaacacgctttcaatatcgcacgctaccaactgggaatcgaaaaactgctggacccggaggacgtggacaccacctaccctgacaaaaagtctatcctcatgtacatcacttccctgtttcaagtgctgccgcaacaggtgagcatcgaggccattcaagaggtggaaatgttgccgcgtccgccaaaggtcacgaaggaggagcacttccagctgcatcatcaaatgcactactcacagcagattaccgtgtccctcgcccaaggctacgagcgcacctcctcaccgaaaccacggttcaaatcatacgcatacacccaagctgcctacgtgactacctccgacccaactagatcaccgttcccctcccaacacctggaagcgcctgaagataaatccttcgggagctcgctgatggaatcagaagtgaacctggaccggtaccaaactgcccttgaggaagtcctcagctggcttctgtcggcggaggataccctgcaggctcaaggtgaaatctcgaacgacgtggaagtggtgaaggaccagttccacactcatgagggctacatgatggacctgaccgcccatcagggtcgcgtcggaaatatcttgcaactgggatccaaacttatcggtactggaaagctcagcgaggacgaagagactgaggtccaggagcagatgaacctcctcaacagccggtgggaatgcctgcgggtggccagcatggagaagcaatcgaatctgcaccgggtcctgatggaccttcagaaccagaagctcaaggaattgaacgattggctcactaaaaccgaggaacgtactcggaagatggaagaggaaccgctgggacccgatcttgaagatttgaagagacaagtgcagcaacacaaagtgctccaggaagatctcgagcaggaacaagttcgggtgaactccttgacccatatggtggtggtcgtggacgagtcctcgggagatcacgccacggcagccttggaagaacagttgaaggtcctgggagatcgctgggccaacatctgccgctggaccgaggaccggtgggtgctgcttcaagacatattgctgaagtggcaacggctgactgaggaacagtgtctgttttcagcttggttgtccgagaaggaggacgcagtcaataagattcataccaccggattcaaggatcaaaatgagatgctctcctcgctgcagaagctggctgtgctgaaagccgaccttgaaaagaagaaacagagcatgggcaaactctactcgctcaagcaggacttgctcagcaccctgaagaacaagtcggtgactcaaaaaaccgaagcatggctcgataacttcgcccgttgctgggacaatctggtccagaaactggaaaagtcaaccgcgcaaatctcccaggctgtgacgactactcaaccgagcctgacccaaaccactgtgatggaaaccgtcaccacggttaccacccgcgagcagattctggtcaagcacgcgcaggaagaactgccgccgcctcctccacagaaaaagagacagatcactgtggatactctcgaacgcctgcaggaactccaggaagcaaccgatgaactggatctgaaactcagacaagcggaagtcatcaagggatcgtggcaaccagtcggtgatctcctcatcgattcactgcaagatcacctggagaaggtcaaagccctgagaggggaaatcgccccactcaaggagaatgtgtcgcatgtcaatgaccttgcccggcagctcaccacgctgggcatccagctgtctccgtataaccttagcaccctggaggacctgaacactcggtggaagctgctgcaggtggcggtggaggatagagtgaggcagctccacgaagcacacagagacttcggtccagcgtcccagcatttcctgtccacctcagtgcaaggcccatgggaaagagctatcagcccaaacaaggtcccttactacatcaaccacgagactcagacgacctgctgggaccatcctaaaatgaccgaactttaccagagcctcgcagacctgaacaatgtgcgcttcagcgcttaccgcacggcgatgaagctgcgcagattgcaaaaggcactttgtctggatctgttgtcgctctccgccgcttgcgacgcgcttgatcagcacaatctgaaacagaatgatcagcctatggatatccttcagattatcaactgtctgaccaccatctatgaccggcttgagcaggagcacaataacctggtaaacgtgccgctgtgcgtggacatgtgcctgaattggctgcttaacgtttacgacacgggacggactggaagaatccgtgtgttgtccttcaagacggggatcatctcactctgcaaagcccatctggaggacaagtataggtacctctttaaacaggtggcatcgagcactggcttttgcgatcagcgcagactgggtctgctgctgcatgattccatccagatccctaggcaacttggagaagtggcatcatttggcggatcaaacattgaacctagcgtgcgctcctgtttccagttcgccaataacaaacctgaaattgaggctgcgctgttcttggattggatgcggctggagccacaaagcatggtttggctcccggtgctgcaccgcgtggctgccgcagaaaccgcgaaacaccaagccaagtgtaatatctgcaaggagtgcccgatcatcgggttcaggtatcgctcgctgaaacatttcaattacgatatatgtcaatcctgcttcttttccggccgcgtggccaagggacacaagatgcattatcccatggttgagtactgcaccccgaccacgtcgggagaagatgttagggacttcgcaaaggttttgaaaaacaagttcagaaccaaacgctactttgccaagcaccctcggatgggttacctcccagtgcagaccgtgctggaaggcgacaatatggaaaccgacactatg

SEQ ID NO: 251328 - DNA, 3591 bp, Artificial Sequence
  Description of Artificial Sequence: Synthetic coding sequence
atgctgtggtgggaagaggtggaagattgctacgaacgcgaggacgtgcagaagaaaactttcaccaagtgggtgaacgctcagttctcgaagttcgggaagcagcacatcgaaaatctcttctccgatcttcaggacggaagaaggcttctggacctgcttgaaggactcaccggtcaaaagctgccgaaggagaagggatcgaccagagtgcatgccctgaataacgtgaacaaagccctgagggtcctgcagaataacaacgtcgacctggtgaacattggatccaccgacatcgtggacggaaaccataagctgaccctggggttgatctggaatatcatccttcattggcaggtgaaaaatgtcatgaaaaacatcatggccggcctccaacagacgaacagcgaaaagatcctgctcagctgggtccggcagtccaccaggaactacccacaggtgaatgtgatcaactttaccacctcgtggtcggacggactggctctcaacgcgctgatccactcacaccgaccggacctgtttgactggaactcagtggtgtgccaacaaagcgcaacgcagcggctggaacacgcgttcaatattgctagataccaattgggaatcgaaaaactgttggatccggaggacgtggacaccacctaccccgacaaaaagtcaatcctcatgtacatcacctcacttttccaagtgctcccgcaacaagtgtcgatcgaagcaattcaggaggtcgaaatgctgccacgaccgccaaaggtgacgaaggaggagcactttcaattgcatcaccagatgcactacagccaacaaatcaccgtgtccctcgcgcagggatacgaaagaacctcttcccccaagcctcggttcaaatcatacgcctacacgcaggccgcttacgtcactacctccgaccccacccgctcccctttcccatcccagcacctcgaggctccggaagataagtcattcggcagctccctgatggaatcggaagttaacctggaccggtatcaaaccgctctggaggaagtgctctcttggctgctgagcgccgaagataccttgcaggcgcagggagaaatctcgaacgacgtggaggtggtgaaggatcaatttcatacccacgaaggctacatgatggatctgactgcacaccagggaagggttggaaacatcctgcagctggggtcgaagctcatcgggaccggaaagctgagcgaggatgaagagactgaagtccaagagcagatgaatttgttgaactcacggtgggaatgcctccgcgtcgcttccatggaaaagcagtcgaacctgcatcgggtgctgatggacctgcaaaatcagaaactcaaggaactcaacgattggctgaccaagaccgaggaacgtaccagaaaaatggaagaagagccgcttggaccagatctggaggacctgaagcgccaagtgcagcagcacaaagtgctgcaagaggatctggagcaggaacaggtgcgggtgaacagcttgacccatatggttgtggttgtggacgagagctcgggcgaccacgccaccgctgctctcgaagaacagctcaaggttctcggagacagatgggccaatatctgccgctggactgaggacagatgggtgctgctgcaagacattctcctcaaatggcagcggctgactgaagaacaatgtttgttcagcgcctggttgtccgagaaagaggacgctgtgaataagatccacactaccggattcaaagatcagaacgagatgctgtcaagcctccaaaagctggcggttttgaaggcggacctggagaagaagaagcagtcgatgggcaagctgtactctcttaaacaggacctgttgtctactttgaagaacaaatctgtgacccaaaaaaccgaggcctggctggacaacttcgccaggtgttgggataacctggttcagaagctcgaaaagtcgaccgcacaaatctcccaagcagtcaccaccactcaaccttccctgactcaaactaccgtgatggaaaccgtgactactgtgactacgcgagaacaaattctggtgaagcacgctcaggaagaacttccgccaccgccaccacagaagaagcgccaaataactgtggacaccctcgaaagattgcaagaactccaggaggcaactgacgagcttgacctgaaactccggcaggccgaagtcatcaagggtagctggcagccggtgggtgatctcctgattgactcacttcaagatcacctggaaaaagtgaaggccctgaggggtgaaattgcccctctcaaggagaatgtgtcgcacgtgaacgacctggcccgccaactgaccacgctgggaatccagctgtcgccgtacaacctttctactttggaagatctgaatactcggtggaaactgctgcaggtcgctgtcgaagatagagtccgccagctccacgaggcgcacagagatttcgggcccgctagccagcacttcctttcgacttcggtgcagggaccgtgggaaagggctatttccccgaacaaggtcccatactacattaatcatgaaacccagacgacctgttgggaccatccgaagatgactgaattgtatcagtcgctggcggacttgaacaatgtgcgcttcagcgcctaccgaaccgccatgaaacttcggcgcctccagaaagcactgtgcctggatctgctctcactgtccgccgcatgcgacgccctggatcaacacaacctgaagcagaacgaccaaccaatggatatcctgcagatcataaactgcttgacgactatctacgatcggcttgaacaggagcataacaacttggtcaatgtgcccttgtgtgtcgacatgtgcctcaactggcttttgaatgtctacgataccggacggaccggacggatccgggtccttagcttcaagacgggcatcatctcgctctgtaaagctcatctcgaggacaagtaccgatatctctttaagcaagtcgcctcttccaccgggttctgcgaccaacggcggctcgggctgctgcttcacgactcgatccagattccgagacagttgggagaggtggcgtccttcggaggatcgaatatcgaaccatccgtgcgctcttgcttccagttcgctaacaataaaccggaaatcgaagccgccctgttcctcgattggatgcggctggagcctcagagcatggtctggctccccgtgctgcatagagtcgccgccgcggaaactgcaaaacaccaggccaaatgtaacatctgtaaggagtgcccaattatcggatttcgctatcgcagtcttaaacactttaactacgacatctgccagtcgtgctttttctccggccgggtggcgaagggacataagatgcactatccgatggtagagtactgtactccaaccacctcgggtgaagatgtgcgagatttcgccaaagtgctcaagaataagttccgcactaagcgctacttcgccaagcacccgagaatgggttacttgccagtgcagaccgtcctggagggggacaacatggagactgacaccatg

SEQ ID NO: 251329 - DNA, 3591 bp, Artificial Sequence
  Description of Artificial Sequence: Synthetic coding sequence
atgttgtggtgggaggaggtagaggactgttatgagagggaggatgtgcaaaagaaaaccttcactaaatgggtgaacgcacagttttcaaaatttggaaagcaacatattgaaaatctgtttagcgacctgcaggacgggcggcgtctgttggacctgctggaagggctgaccggccagaagctcccaaaggaaaagggttcgacaagggtgcacgcgctcaacaacgttaacaaagctctcagagtgctccagaacaacaacgtggacctggttaacatagggagcaccgatatagtggatggcaaccataaattaacactcggcctcatttggaatatcatcctccactggcaggtgaagaatgtgatgaagaatatcatggccggattgcagcagaccaacagcgagaagatcctgctcagttgggtgcggcagagcacacggaactatccacaagtgaatgtgattaacttcaccacatcatggagcgacggactggctctcaatgcgctcattcatagccacagaccggacctgttcgattggaacagtgtggtgtgccagcagagtgcaacgcagaggctggaacatgccttcaatatcgcccggtatcagcttggtatagagaagctgctggatcctgaagacgtcgacactacttacccagataagaagtcaatattgatgtatataacctcgttattccaggtgctccctcagcaggtatcgatcgaagccatacaagaggtcgagatgctgccacggcctcccaaggtgaccaaagaggaacattttcagctccaccatcagatgcactactctcaacagataaccgtgtccctcgcacagggttacgaacgaacctcttcgccaaaaccgcgcttcaagtcttacgcctatacccaggccgcgtatgtcaccacgtctgatcccacgcgcagcccattcccatcacagcacttggaggcaccagaggataagagcttcggcagctcattaatggagtctgaggtcaacctggatcgatatcagacagcacttgaggaggtgctttcatggcttctgagtgcggaggacaccctccaggctcagggtgagataagcaatgacgtggaggtggtaaaggaccagttccacacacacgaaggatatatgatggacctgacagcacaccaggggagggtgggaaatattttgcagcttgggtctaagctcattggcaccggtaagctgagcgaggacgaggagaccgaagtccaggagcaaatgaatctgctcaactcccggtgggaatgtttaagagtggcgtctatggagaaacagagcaacctccaccgggtgctaatggacctccaaaatcaaaagctgaaggagctgaatgattggctgactaaaacagaggagcggacacgcaaaatggaggaggaacctctggggcctgacctggaagacctcaagcgtcaggtgcagcagcacaaggtcctccaagaagatttggaacaagagcaggtgcgcgtgaattctctcacccacatggtggtggtcgtggatgagtcttctggcgaccacgccacagccgccctggaggaacagttgaaagtgctcggagaccggtgggctaatatctgtagatggaccgaagaccggtgggtcctcctgcaagatatactcctcaagtggcagaggctcactgaagaacagtgcctcttttcagcgtggctgtctgagaaagaagatgcggttaataaaattcacactacaggttttaaagaccagaatgaaatgttgtcttctcttcagaaactggcagtcctgaaagccgatcttgaaaaaaagaaacaaagtatggggaagctctattccctcaaacaggatctgctgtcaactctgaaaaacaagtccgtcacgcagaagaccgaggcctggcttgacaatttcgcaagatgctgggacaacctggttcaaaagctggagaagtcgaccgctcagatatctcaggccgtgacaactacccagccttcattaacacagaccaccgttatggaaactgtgacaacggttacaactcgggagcagatattagtgaagcacgcccaagaggagctcccacctccaccaccccagaagaaacgtcagattacggtcgacacacttgagagattgcaggagttgcaggaggcaaccgatgaactcgatttaaagctgaggcaagcggaggtcataaaaggctcttggcaacctgtgggggatttgctcatcgactctctccaggaccacctggaaaaagtgaaagctctacgaggggaaattgctccactgaaggagaatgtgtcccatgtgaatgacctggccaggcaactgaccaccttgggcatccagctgtctccctacaatttatcaacactggaggatttgaacaccaggtggaagctgctccaggtggcggtggaagatcgggtgcgccaactccatgaggcgcatcgtgattttggacccgcctctcagcactttctgagcactagcgtacagggcccctgggaacgggccatcagccctaataaggtgccatactacattaaccacgaaacacagacaacttgctgggaccaccccaagatgactgagctgtatcagtccctggcagatcttaataacgtgcgctttagtgcgtataggacagcgatgaagcttaggaggctgcagaaagccctgtgcttagacctgctgagcctatctgcagcttgcgacgccctggatcagcataacctcaagcagaacgaccagcctatggacatcctgcagatcattaactgcttgaccactatatacgatcgcctcgagcaggagcataacaacctggttaatgtcccgctgtgcgtggacatgtgtctgaactggctcctgaatgtgtatgacaccggaagaacagggcgcataagggtactgtcattcaagactggaatcatctcactctgtaaagcccacctagaagataagtaccggtatttgttcaagcaagtagcatctagcacaggattttgcgatcagcgccggttgggacttctattacacgatagcattcagatccctcgacagctgggagaagttgccagttttggtggatcaaacatcgaaccaagcgtccgcagttgcttccaattcgcgaataataagcccgagattgaagcagctttattcctggactggatgagattggaacctcaatccatggtctggctgcccgtattgcaccgggtggccgctgccgaaactgctaaacaccaggccaagtgcaatatttgtaaggagtgccctattataggtttccgttacaggtctctcaagcactttaactatgatatatgtcagagctgtttcttcagtgggcgtgtcgccaagggtcacaaaatgcattatcccatggttgaatactgtacaccaaccacatccggtgaagatgtgagagatttcgctaaggtgctcaagaacaagtttcggaccaaacgctacttcgctaaacatccccgtatgggctatttgcctgtgcagactgttttggagggggacaacatggagaccgacaccatg

SEQ ID NO: 251330 - DNA, 3591 bp, Artificial Sequence
  Description of Artificial Sequence: Synthetic coding sequence
atgctgtggtgggaggaagtcgaggactgttacgaacgtgaggatgtgcaaaagaaaacgtttactaagtgggtgaatgcacaattttccaagtttgggaaacaacatattgaaaatctcttctcagatctccaggatggtagacgtctgcttgatctgctggaaggtcttaccggacaaaaacttccaaaggaaaagggtagcactcgcgtgcatgcacttaacaacgtgaataaggcactccgggtgcttcaaaacaacaacgtggatctggtcaatattggtagcaccgacattgtcgatggaaatcacaaacttactctgggactgatttggaacattattcttcactggcaagtgaaaaacgttatgaaaaacatcatggcaggcctccagcagactaactcagagaagattcttctgtcctgggtcaggcaatcgacccggaattacccacaggtgaatgttatcaactttaccacctcatggtccgatggactcgcattgaacgcacttattcactcccacagacccgacttgttcgactggaatagcgtggtctgtcagcagtcagcaacccaacggctcgagcatgcctttaacatcgctcgctaccagctgggtatagaaaaacttctggatcccgaagatgtcgatactacgtaccctgataagaagtcgattcttatgtatatcacgagcctgtttcaagtcctccctcagcaagtgtcgattgaggcaatccaagaagtggaaatgttgccacgccctccaaaagtcacgaaagaagaacattttcaacttcatcatcagatgcattattcccagcagattactgtgtcacttgcgcagggttacgaacgaacttcctcacccaagcctagattcaagtcctacgcttacactcaagccgcatacgtgaccacctccgatccaaccagatccccgtttccatcccagcaccttgaagcacctgaagataagtcgttcggctcgagccttatggagtccgaagtcaacctggaccgctaccaaaccgcacttgaagaggtgctgtcgtggctgctttcggctgaagataccctccaagcgcagggagaaatttccaacgatgtggaagtggtgaaagaccagtttcatacccatgaaggatacatgatggatctcaccgctcatcaaggacgagtgggtaacatacttcaactcggatcaaaactgatcgggactggcaaactctccgaggatgaagagactgaagtgcaagagcaaatgaatctgctgaattcacgctgggagtgcctgcgcgtcgcatccatggagaaacagtcaaatcttcatagagtgttgatggatctgcagaatcaaaagctgaaggaactcaatgattggcttaccaagaccgaggaaagaacccgcaaaatggaagaggaaccacttggaccagatcttgaggatcttaagagacaagtgcagcaacataaggtcctgcaagaagatcttgagcaggaacaggtgcgagtgaactcgctgactcatatggtcgtggtggtcgacgaatcgtccggcgatcatgcaaccgcagcccttgaagagcaactgaaggtcctcggtgacaggtgggccaacatctgtagatggactgaagatagatgggtgctgcttcaggatattcttctgaaatggcaacggcttactgaagaacaatgccttttcagcgcctggctgtctgaaaaggaagatgcagtgaacaaaattcataccactggattcaaagatcaaaatgaaatgctgtcgtcgcttcagaaacttgccgtcctgaaggcagatctggagaaaaagaagcagtccatgggcaaactttactccctgaaacaagaccttctttccaccctcaaaaacaagagcgttactcaaaagaccgaagcgtggcttgacaatttcgcgagatgttgggataacctggtccaaaagctggaaaagtcgaccgcacagatttcccaagcagtcactactacccaaccctccttgactcagactacggtgatggaaacggtgaccactgtgactactcgcgaacaaattcttgtgaagcatgcacaggaagagctccccccgcctcctccccaaaagaagaggcaaattactgtggacaccctggagcgtctccaggaacttcaggaagccaccgatgaattggacctgaaactgagacaagcggaggtgatcaagggaagctggcaacctgtgggagatctgctcattgactcgctgcaagatcatcttgaaaaagtcaaggcacttaggggggaaatcgcacctctgaaggaaaacgtctcccatgtgaatgatctcgcccggcaactgactacgctgggcattcagctgagcccctacaacctttctacccttgaagatctgaataccagatggaagctgcttcaagtggcggtggaagatcgagtgcgacagctgcatgaggcacaccgcgacttcggaccagcttctcagcacttcctgtccacgtcggtgcaaggtccctgggagcgcgccatctcaccaaataaggtcccatattacattaaccatgaaacccagaccacctgctgggatcatcccaagatgactgagctgtaccaatccttggccgatctcaacaacgtccggttttcggcatacaggactgccatgaaactcagacgacttcaaaaggcactttgccttgatctcctgtcgttgtccgctgcatgtgacgccctcgatcagcataacctgaaacagaatgatcaaccaatggatattctccagatcataaactgcctgaccacgatttacgacaggctggagcaggaacataacaacctcgtgaacgtccctctgtgtgtggatatgtgtctgaattggcttcttaatgtgtacgatactggtcgcactggtcgcatcagggtgctgtcgtttaagaccggtataatctcgctgtgtaaagcccacctggaggacaagtaccggtacctctttaagcaagtcgcctcgagcaccgggttctgtgatcaacggcggctgggtctgcttctgcacgatagcatacagatacctcgtcaactcggagaagtggcatcctttgggggttcgaatattgagccatccgtgcgatcctgctttcagtttgcgaacaacaaacctgaaattgaagcagcacttttcttggattggatgagacttgaacctcaatccatggtctggctgcctgtccttcacagagtggcagcagccgaaaccgcaaaacatcaggcaaagtgcaacatctgcaaagaatgcccaatcatcggctttcgttaccgatccctcaagcactttaactacgatatttgtcaaagctgtttcttttccggtagagtggcaaaggggcacaagatgcattaccccatggtcgagtactgcaccccaaccactagcggagaagatgtgagggattttgcaaaggtgctgaagaataagttccgaaccaaaaggtactttgcaaagcacccacggatgggttaccttccagtgcagaccgtgttggaaggagataacatggaaaccgataccatg

SEQ ID NO: 251331 - DNA, 3591 bp, Artificial Sequence
  Description of Artificial Sequence: Synthetic coding sequence
atgctctggtgggaggaggtagaggattgttatgaaagggaagatgtgcaaaaaaagacatttactaagtgggtaaacgcgcagttctccaaatttggaaaacaacatattgagaatctgtttagtgatttgcaagatggacgtagactccttgatcttcttgaagggttaactggacaaaagctgccgaaggagaagggtagtacacgagttcacgcgttgaacaatgtcaataaagcgttgagagttttgcaaaacaataacgttgatctcgttaacataggatcaacagacattgttgacggaaaccataagctaacacttggtttgatttggaatattattctgcactggcaagtgaagaatgtaatgaaaaatataatggcgggcttacagcaaacgaatagtgaaaagatcctccttagctgggtgagacaatctacccgtaattatccgcaagtgaacgtaattaatttcactacaagctggagtgatggactcgctttgaatgcccttattcatagtcaccgtccagacttattcgattggaattcagttgtttgtcaacaatcagctacacaacggcttgagcatgcttttaatattgcacgatatcaacttggcatcgagaaattgttggacccggaagacgttgacactacatatccagataaaaaatcaattctcatgtatatcacttccctttttcaagtccttcctcagcaggtatctatagaagcgattcaagaagtggagatgcttccccgtccgccaaaggtgacaaaggaagaacattttcagctccatcaccagatgcactattcacagcaaattacagtttcattggctcagggttatgaaagaactagtagtcctaaaccaaggtttaagtcatatgcttacactcaagctgcgtacgtcaccacatctgatccaacgcgatcccctttcccaagtcaacatttggaagcacctgaggataagtctttcggatcttcgcttatggaatctgaggtcaatcttgacagatatcagaccgcgctggaagaggttttgtcctggctcctttcagcggaagatactttgcaagcacaaggagagataagtaatgatgtggaagtagtaaaagatcagtttcacacacatgagggttacatgatggacctgacagcccatcaaggacgtgttggaaacattttacagctcggatcaaaactaatcggaactggaaagctatcagaggatgaagagactgaggtgcaagaacaaatgaacctcttgaactcgcgatgggaatgcctgcgagtggcatccatggagaagcagagtaatctccatcgtgtccttatggatttgcaaaatcaaaaattgaaagagctaaacgattggctaactaaaactgaagagcggacaagaaaaatggaggaagagcctttgggtccggatcttgaagacctcaaacgccaggtacagcaacataaagttctccaggaggatttggaacaagaacaagtgcgagtcaactcacttactcatatggtggtggttgtagacgaatcttcgggagaccatgctaccgctgccttggaggaacaacttaaagttttgggagatcgttgggctaatatttgtcgttggacggaggacagatgggttttactccaagatattcttctgaagtggcaacgtctcacagaagagcaatgtctgttcagtgcatggttgtcagaaaaagaagatgcggttaataaaattcatacaactggtttcaaagatcaaaatgaaatgctgtcttctttacagaaactagccgtcctaaaagctgatttggaaaaaaagaagcagagcatgggtaagctatattcgctgaagcaagatttgctttcaacactaaaaaataagtcggtgacacaaaaaacagaagcctggttagataattttgcaagatgctgggataatctcgtccaaaaactagaaaagtctacagcccaaatctctcaggcggtaacgacaacacaaccatctcttacacaaaccacggttatggaaactgtgaccacagtgacaactcgagaacaaattctagtcaaacacgcgcaggaggagcttccaccgccgcccccacaaaagaaaaggcagattactgtggatacgcttgaacgtcttcaagaattgcaggaggctacggatgagctagatcttaagctgaggcaggctgaggttataaaaggatcctggcaacctgttggagatttgcttattgattcattgcaagatcatctcgaaaaggtgaaagcactgcgaggagaaatcgcgccactgaaggagaacgtctcacatgtcaacgacttggcacgccaattgactacactgggtattcaattgagtccatataatctttcaactcttgaagatctgaatacaagatggaagctacttcaggttgcagtggaagaccgagtccgtcagctgcatgaggcccatcgagacttcggcccagcatcacagcacttcctctctacttctgtacagggaccgtgggaaagggctattagtccaaataaggtgccgtattatattaatcacgaaacacagacaacatgctgggaccatcctaaaatgacagaattgtaccaatctcttgcagacctcaataatgtccgtttttcagcgtatcgtacggcgatgaagctacgcaggcttcaaaaggcgttgtgtttagatttattaagtcttagtgcggcttgcgacgcacttgaccaacacaacctcaagcaaaatgatcaaccaatggatatcctccaaatcatcaattgcctgaccaccatctatgacagactggaacaggaacataataatcttgtgaacgtcccgctttgtgtggatatgtgtttaaactggcttctaaacgtctacgatactggccgtactggacgaataagggtacttagctttaaaaccggaattatttcgctctgtaaggcacatcttgaagataaatacagatatttgtttaagcaagttgcaagttctacgggtttctgcgatcaaagaagattaggattacttctccatgactcaattcagatccctcgccagttgggggaagtcgcatcttttggagggtcaaatattgaaccatctgttcgtagctgttttcaattcgctaacaacaagcctgaaattgaagccgcgcttttcttggactggatgcgactcgaacctcaatcaatggtctggctaccggttctgcatcgtgttgcggccgcagagaccgctaaacatcaagcaaaatgcaatatttgtaaggaatgcccaataatcggattccgttaccgctcgcttaagcacttcaattacgatatttgtcaaagttgtttcttcagtggcagagttgcaaaagggcataagatgcactacccgatggttgaatactgtaccccaacaacatcaggagaagacgtcagagatttcgctaaagtgctcaaaaacaaattccgaacaaaacgttatttcgccaaacatccaagaatgggatatcttcccgtccagacagttctggaaggtgataatatggaaacagacacaatg

SEQ ID NO: 251332 - DNA, 3432 bp, Artificial Sequence
  Description of Artificial Sequence: Synthetic coding sequence
atgctgtggtgggaagaggtcgaagattgttacgagagggaagatgtgcagaagaaaactttcactaagtgggtcaatgcccaattctccaaattcgggaagcagcacatcgaaaatctcttctccgacttgcaggacggacggcggctcctggaccttctcgaaggcctgaccggccagaagctgccaaaggaaaagggttcaacgcgggtacatgcgctgaataatgtgaacaaggcattgcgcgtgctgcagaataacaacgtggacctggtgaacattggatccaccgatatcgtggatggaaaccacaagctgactctcggactgatctggaacattatcctgcattggcaggtgaagaacgtcatgaaaaacatcatggccggactgcagcagaccaactcagaaaagatcttgctctcctgggttcggcaatccacccgcaattaccctcaggtgaacgtcatcaacttcactacttcgtggtcggacgggcttgcccttaatgccctcatccactcccaccgtcctgacctgttcgattggaattcagtggtgtgtcaacagtccgccactcaacggctggaacatgcttttaacattgcccgctaccagttgggaatcgagaaactgcttgaccccgaggacgtggatactacttaccccgacaaaaagtcgatcctcatgtacataacctctctgtttcaggttttgccccagcaggtgtcgatcgaagcaatccaagaagtcgaaatgctccctagacctccaaaagtgacgaaggaagagcactttcaactgcatcaccagatgcactactcacaacagatcacggtgtcgttggcccagggatacgaacggaccagtagcccgaagccaaggttcaagagctatgcgtacactcaggcggcttacgtgaccacgtccgacccgaccagatcgcccttcccgtcacaacatctcgaagcaccggaggacaagtccttcggtagcagcctgatggaatccgaagtgaacctcgaccggtatcagaccgccctggaagaagtcctgtcatggctcctgtcggccgaagataccctgcaggcacaaggagaaatctcgaatgacgtggaagttgtgaaagaccagtttcacactcatgaaggttacatgatggacctgaccgcacatcagggacgcgtgggaaatatcctccagctcggatccaaactgatcgggaccggaaagctgagcgaagatgaggaaacggaggtccaggaacagatgaacctgctgaactcgcggtgggagtgtctcagggtggcctccatggagaagcaatctaatctccacagagagatttcatatgtcccgtcgacctacctgactgaaatcacccacgtgtcacaagcgctgctcgaagtggaacagttgctcaacgcccctgacctgtgcgccaaggatttcgaggacctgttcaagcaggaggagtcactcaagaacatcaaggacagcctgcagcagtcctcaggacggatcgacatcatccactcgaaaaagaccgccgccctccagagcgctaccccggtcgagcgggtgaagctccaagaggcgctctcgcagctcgatttccagtgggaaaaggtgaataagatgtacaaggaccggcagggccgattcgataggtcggtcgagaagtggcggcgcttccattacgacattaagatcttcaaccaatggctgacggaagccgagcagttcttgagaaaaacccaaatccctgaaaactgggaacacgccaagtacaagtggtacctcaaagagctgcaggatggcatcggccaaagacaaaccgtggtgcggaccctcaacgctaccggcgaggaaatcatccagcagagctccaagactgatgcctccatcctgcaggagaaactgggctcgctgaatcttcgttggcaggaagtgtgcaaacagcttagcgatcgtaagaaacggcttgaagagactctggagagactgcaggagctgcaggaggctaccgatgagctcgatctgaagctgaggcaggctgaggtgatcaagggatcatggcaaccggtgggcgacctgctgatcgattcgttgcaggatcatctcgagaaggtgaaggccctgcgcggcgagatcgccccgctcaaggaaaacgtgagccacgtgaacgatctcgccagacaactcactactctcggtatccaactgtcaccatacaacctgtccaccctcgaggacctgaatactcgatggaagctgctccaagtcgcagtcgaagatcgcgtccgccaactgcacgaggcccaccgggacttcggccccgcttcacaacacttcctgtccacttcggtgcaaggaccttgggagcgcgcaatctcacccaacaaggtcccgtactacatcaatcacgagactcaaaccacctgttgggaccacccaaagatgaccgagctgtaccagtcgctcgccgacctcaacaacgtcagattttccgcctatcgcaccgccatgaaactgcgccggctccagaaagccctgtgtctcgacctcctgtcgctttccgcggcgtgtgacgcgctggaccaacacaacttgaagcagaatgatcaacctatggatatcctccaaatcattaactgtctgaccactatctacgacagactggaacaggagcacaataaccttgtgaatgtgccgctgtgcgtggatatgtgcttgaattggctcctgaacgtgtacgacactgggcgcacgggtagaatccgcgtcctcagctttaagaccgggatcatctccctttgcaaggcgcacctcgaggacaagtaccggtacctgtttaagcaagtcgcctccagcaccggcttctgcgaccagaggagactgggacttctgctgcacgatagcattcagatcccgcgacagctgggagaagtcgccagcttcggaggttccaacatcgaaccgagcgtgcggtcctgcttccaattcgcaaacaacaagccggaaatcgaggccgcgctgttcctcgactggatgcggttggaaccgcagtcgatggtctggctcccagtgctgcatcgcgtcgcggccgccgagactgcaaagcaccaggccaagtgcaacatctgcaaagagtgccctatcatcggattccggtatcggtcgctgaagcacttcaattacgatatctgccaatcatgttttttctcgggacgcgtggcgaaaggacataagatgcattacccgatggtggagtactgtacccccaccacgtccggtgaggacgtgcgggacttcgccaaggtgctgaaaaacaaattccgcaccaagagatacttcgcgaaacacccacgaatgggctacctcccagtgcagaccgtgctcgaaggagacaatatggagactgacacgatg

SEQ ID NO: 251333 - DNA, 3432 bp, Artificial Sequence
  Description of Artificial Sequence: Synthetic coding sequence
atgttgtggtgggaagaagtggaggactgctacgagagggaggacgtgcagaaaaagaccttcaccaagtgggtcaacgcccagtttagcaagtttggaaaacagcatattgagaaccttttcagcgatctccaggatggcagacgcctcctggacctccttgagggcctgacgggtcagaagctgccgaaagaaaagggatccacccgcgtccatgcgctgaataatgtgaacaaagctctgcgcgtgctccaaaacaacaacgtcgatctcgtcaatatcggatcgactgatatagtggacggcaatcacaagctcaccctgggtctgatctggaacatcatcctgcattggcaagtgaagaatgtgatgaagaatatcatggcggggttgcagcaaaccaactcagaaaagatcctgctgagctgggtgcggcagtcgactaggaactacccacaggtgaatgtcatcaacttcactacctcatggtcggatggattggccctgaatgcactcattcactcgcaccgcccagacctcttcgattggaattcagtcgtgtgccagcagtcggccactcagcgcctggagcacgctttcaacatcgcgagataccagctgggaatcgagaaactccttgaccctgaagatgtggataccacctatccagacaagaagtcaatcctcatgtacatcacgtcgctgttccaagtcctgccacagcaggtgtcgatcgaagcgatccaagaggtcgaaatgcttccacgaccgcctaaggtgaccaaggaggagcactttcaactccatcaccaaatgcactactcgcagcagatcactgtgtccctggctcaggggtacgaacgcacctcatcgccgaaaccgaggtttaagtcctacgcctacacccaggctgcgtatgttaccacttcagacccgacgcgcagccccttcccgtcacaacatttggaagcacctgaggataagtccttcggttcctccctcatggagtccgaggtgaacctcgaccgctaccagacggcgctggaagaggtgctctcatggctgctgagcgccgaggacaccttgcaggcacaaggggagatctcgaatgatgtggaagtcgtgaaggaccagttccacacccacgagggatacatgatggacttgacggcgcaccagggacgagtgggaaacattctccaactgggaagcaagctgatcgggaccgggaagctgtcggaggatgaagagactgaagtgcaagaacaaatgaacctcctgaattcacggtgggagtgtctgagagttgcgtcgatggaaaagcagtccaatttgcaccgggaaattagttacgtgccttcgacctacctgaccgagatcacccacgtgtcacaggccctgctggaagtggaacagctccttaatgctccggacctctgtgccaaggacttcgaggacttgtttaaacaggaagaatcgctcaagaacattaaggatagcctgcagcaatcatcaggtcggatcgacatcattcattcgaagaaaaccgcagctctccagtcggctaccccggtagaaagagtcaagctccaagaagccctctcgcaactggacttccagtgggaaaaggtcaacaaaatgtacaaggaccgccaaggaagattcgaccggtcggtcgagaaatggcgcaggttccactacgacatcaagatcttcaatcagtggctgaccgaagctgagcaattcctccgcaagacccagatcccggaaaattgggaacacgcgaagtacaaatggtacctgaaggaactccaagatggaatcgggcagaggcagaccgtcgtccgcaccttgaacgcaactggagaggagatcattcagcaatcgagcaagactgacgcctcaatcctccaggagaagctgggctcgctgaacctccgctggcaagaggtctgcaagcagctgtccgatcggaaaaaacggcttgaagaaactttggagcggcttcaagagctgcaagaagccactgatgaattggatcttaagctgcgccaggccgaggttatcaagggcagctggcagccggtgggggacctgctcatagactccctgcaagatcacctggaaaaggttaaggcgttgagaggtgagattgcgcctctgaaagagaatgtcagccatgtgaacgacttggcccgccaactgaccactctcggaattcagttgtcgccatacaacctgtccaccctcgaagatctgaatactagatggaaattgcttcaagtggccgtcgaggacagagtccgtcagctgcacgaagcccatcgggatttcggaccggcgtcgcagcacttcctctcaacctcggttcagggaccatgggaaagagccatctccccaaacaaggtgccgtactatatcaaccatgaaacgcagaccacttgttgggaccatcctaaaatgactgaactgtatcaatccctggccgatctgaataatgtcaggtttagcgcataccgcaccgcgatgaagctgcgcagactgcagaaggccttgtgccttgacctcctctcactctccgccgcgtgcgacgccctggatcaacacaacctgaagcagaatgatcagccgatggacattctgcagatcattaactgtctcactactatctacgataggttggaacaggaacataacaatctggtcaatgtcccgttgtgtgtggacatgtgcctgaactggctcctgaatgtgtacgataccgggcgcacgggacgcatcagggtgctctccttcaagactggaatcatctcgctgtgcaaggctcatctcgaagataagtaccgctacttgttcaaacaggtagcttcctccactggattctgcgaccaacggagactgggcctgctgctccacgatagcattcagatcccccggcagctgggagaagtcgcttcgtttggaggctcaaacatcgaacccagcgttcgctcttgcttccagttcgccaacaataagccggagattgaggccgcgttgtttctcgattggatgcggctggaacctcagtccatggtctggcttcctgtcctgcatcgggtggctgctgcggaaactgcgaagcatcaggcgaagtgcaatatctgcaaggaatgcccgatcatcggattccggtacaggtcgctcaagcatttcaactacgacatctgccagtcgtgcttcttctcgggaagggtggctaagggtcacaaaatgcattaccctatggtggaatactgcaccccgacgacttcgggcgaggacgtgagggatttcgcgaaggtgttgaaaaacaaatttcgcaccaaacgctactttgcgaagcacccgcgtatgggataccttcctgtgcagactgtccttgaaggggacaacatggaaacggacaccatg

SEQ ID NO: 251334 - DNA, 3432 bp, Artificial Sequence
  Description of Artificial Sequence: Synthetic coding sequence
atgctgtggtgggaagaggtcgaggactgttatgagcgagaagacgtgcaaaagaaaacattcaccaaatgggtcaacgcccaattttccaaatttggtaagcagcacatcgaaaatctgttcagtgacctgcaggatggacggagacttctggacttactcgaaggattaaccggccagaagctcccgaaagagaagggatccactcgcgttcatgccttgaataacgttaacaaggcactgcgggtgctccagaacaataatgtggatctggtcaacatcgggtctaccgacattgtagatgggaaccacaagctgaccctaggcctcatttggaatattatccttcactggcaggtgaaaaacgtgatgaaaaatattatggccgggctccaacagacgaatagcgagaagatcctgctctcctgggttagacagagcacccgcaactatcctcaggttaacgtcatcaacttcactacgtcttggtctgacggactcgcgctgaacgctctgatccactcccacaggcccgacctcttcgactggaacagcgtcgtttgccagcagtcagcaacccagcggctcgaacatgctttcaatattgcccgttaccagctgggaatcgagaaactgctcgatccagaagacgttgatacaacctaccctgataagaagtccatcctcatgtatatcacctctctgttccaggttctgccacaacaagtgagcatcgaggctattcaggaagtggagatgttgccgcgcccccctaaggtcaccaaggaggaacatttccaactgcaccaccagatgcactactcccagcagataacggtgagtctcgcacagggctatgaacggaccagttctcctaaacctagattcaagtcttacgcttatactcaggctgcctacgtgacgacctccgaccccacccggtcacccttcccctcccaacacttagaagcgcctgaggacaagtctttcggcagtagtctgatggaatcggaagtcaacctcgatcgataccagacagccctagaagaagtcctttcctggctactttctgctgaggacacgctccaggcacagggcgaaatttccaacgatgtcgaggtggtaaaggaccagttccacacccacgagggatacatgatggacctgactgcacatcagggccgtgtgggtaacattctgcagctggggtccaagctcatcggcaccggcaagctgagtgaggacgaagagactgaggtgcaggagcagatgaaccttctgaactctcggtgggaatgtctcagagtggcatcaatggagaagcagtctaatctgcatcgagaaataagttacgttccgtctacgtacctaactgagataacccacgtctcacaggcgcttctggaggtagagcagctacttaatgccccagatctgtgtgctaaagactttgaggatctcttcaagcaggaagaaagtcttaaaaatataaaggacagcctccaacagagcagcggtaggatcgacattattcattccaaaaagacagccgcactacagagcgctacgccagttgagagagtaaagttgcaggaagccctctcccagctagactttcagtgggagaaggtgaataagatgtataaggaccgacagggacgatttgacaggagcgttgagaaatggagaagatttcattacgatattaagatctttaaccagtggttaactgaggcggagcagttcttgaggaaaacacagatcccagagaactgggagcacgccaaatacaagtggtacctcaaggagttacaggatggcattggccagcggcagacagtagtgcggactctgaatgccactggtgaggagataatccagcagtcaagcaagaccgatgcgtctattctgcaggagaaactcggtagtttgaatttgagatggcaggaggtgtgcaaacagctgagcgaccgcaagaagcgacttgaggagacgctggaaagattgcaggaattgcaggaagctacggacgaactggacctgaagcttaggcaggccgaggtgatcaagggctcctggcagcccgtgggcgacttgctcattgactccctccaggaccatctagaaaaagtaaaggcccttcgcggggaaatagcccctctcaaggagaatgtgtcccatgtgaacgacctagcccggcagttgactactctgggtatccagttaagcccatacaatctctccaccctcgaggatctaaacaccagatggaaactgctgcaggtggctgtggaagatcgggtaagacaattgcacgaggcccaccgagactttgggcctgcttcgcagcatttcctctcgacttccgtgcaggggccctgggaacgggccatttcaccaaataaggttccctactacatcaaccacgagacccagacaacatgctgggaccatccaaaaatgaccgagctgtatcagtcattggctgatctgaacaatgtaaggttttccgcgtacaggactgcaatgaagttgcgtagactgcagaaggctctgtgtttggatcttctatctttatcagccgcctgtgacgcattggatcaacataacctaaagcagaatgatcagccgatggatattttgcagattatcaactgcctcaccactatctatgatcgattagagcaggaacacaacaatctcgtcaacgtgccattgtgcgttgacatgtgcctaaattggctgctgaacgtatatgatacagggcgcaccgggaggatccgggtgctttctttcaaaactgggataatatcactttgtaaagcccacctcgaggataagtatcgctacttgtttaagcaagttgctagcagcacaggattctgcgatcagcgcaggctcggactgctgctccatgacagcatacagattccgcggcagttgggtgaggtggcttcttttggaggctcgaacatcgagccaagtgtgcggtcctgttttcagttcgccaacaacaaacctgaaatcgaagctgcgttgttcctggactggatgaggctggagccacagtctatggtgtggctcccggtgcttcatcgcgtcgcagcagcggaaacagcaaagcatcaggccaagtgtaatatatgcaaggaatgccctataatcgggttccgctatagatctctcaaacatttcaactatgacatctgccagtcgtgttttttcagcgggcgggtggctaaaggtcacaagatgcactatccgatggtggagtactgcaccccaacaacctccggtgaagacgttcgtgactttgcaaaggtcctcaagaataagtttagaaccaagagatatttcgctaagcacccccggatgggctacctgccagtacagacagtgcttgaaggtgataacatggagaccgacacaatg

SEQ ID NO: 251335 - DNA, 3432 bp, Artificial Sequence
  Description of Artificial Sequence: Synthetic coding sequence
atgctttggtgggaagaggtggaagattgctacgagagggaagatgtccagaagaaaacctttactaagtgggttaacgctcaattttcgaagttcggtaagcagcatatcgaaaatctgttctccgacctgcaggacggaaggcggctgctcgatctgcttgaaggactgactggccaaaagctgcctaaggaaaagggatcgactcgggtccacgcactcaataacgtgaacaaggctctgcgtgtgcttcagaacaacaacgtggatctcgtgaacatcggatcaactgatattgtggatggcaatcataagctcactttgggtcttatttggaatatcattctccattggcaagtgaagaatgtcatgaagaacataatggcagggctgcagcaaaccaactcggagaaaatcctcctgtcttgggttcgacaatcgacccgcaactatccgcaggtgaatgtgatcaatttcaccacctcgtggtccgacggacttgcccttaatgcactgattcatagccatcgaccagatctgtttgactggaactcagtggtgtgtcagcaaagcgctacgcaacggctcgagcatgcatttaacatcgcacgataccaacttggaatcgaaaagctgctcgatccggaagatgttgacacgacctaccccgataagaaatcaatccttatgtacattacctcgttgttccaggtgttgccacagcaggtgtctattgaagccatccaagaggttgaaatgctccctagaccaccaaaagtgaccaaggaagaacattttcagcttcaccaccaaatgcactattcgcaacaaattaccgtgtcgttggcccaggggtatgaacgtacctcctcgccaaaacctcggttcaagtcgtacgcatacacccaagcagcctacgtcacgacttcagatcccactcgatctccatttccatcccaacacctcgaagcccctgaggataaatcgttcggttcctcgctgatggaatcggaagtgaaccttgatcgataccagaccgcccttgaagaggtgcttagctggctcctctcagctgaggataccctccaagcgcaaggtgaaatttcgaatgatgtggaagtggtgaaggatcaattccacacccacgagggctacatgatggaccttacggcgcatcaagggagggtcggaaacattctccaattgggttccaagctcataggtactggaaagctgtcagaagatgaggaaaccgaggtgcaagaacagatgaacctgcttaactcgcggtgggaatgccttcgcgtggcaagcatggaaaagcagtccaatcttcacagggaaatttcctacgtgccatccacctacttgactgaaattacccatgtgtcgcaagcccttctggaggtggaacagctgcttaatgctcccgatctctgtgcaaaggatttcgaagatcttttcaagcaagaggaatccttgaagaacatcaaggacagcctgcaacagtctagcggacgcatagatatcatccacagcaagaaaaccgccgctcttcagagtgcaactccagttgaaagagtgaagctgcaggaagcactgtcgcaacttgatttccagtgggaaaaagtgaataagatgtacaaagatagacaaggaagatttgatcggtcggtcgagaagtggcgcagattccattacgacatcaagatctttaaccagtggctgaccgaggcggaacagttccttagaaagactcagattcctgaaaactgggaacatgcgaaatacaaatggtaccttaaggagctgcaagatggtataggtcagcggcagacggtggtgagaaccctgaacgcgacgggagaggagataattcaacaaagctcaaagactgatgcgtcaattctgcaggaaaagttgggctcactgaacctgcgttggcaagaggtgtgcaaacagctgtcagacaggaagaaacgacttgaagaaacccttgaaaggctccaagagctgcaagaggcaactgatgaattggatctgaagctcaggcaggccgaggtcattaagggtagctggcaacctgtgggagatctgctgattgattccctccaggaccatctggaaaaggtaaaagcacttcgtggcgagattgcgccactcaaggagaatgtgagccatgtcaacgacctggcacgtcagctgactactctgggtatacagctgtcgccttacaatctcagcacgcttgaagatctcaataccaggtggaagctgttgcaagtcgccgtggaggatcgtgtgcgccagctgcacgaagctcatcgcgactttggaccagcctctcaacatttcctctcgacttcggtgcaaggcccttgggaaagggccatttccccaaacaaagtgccatactacatcaatcatgaaactcagactacctgttgggaccatccgaaaatgaccgagctctaccagtcgctcgcagatctgaacaacgtgagattcagcgcataccgcaccgcaatgaagctcaggagacttcagaaggcactgtgtcttgatctcctgtccctgtccgcggcttgtgatgcacttgaccaacacaacctgaaacaaaatgatcaaccaatggatatccttcagataatcaactgccttaccaccatatacgacagacttgaacaagagcacaataatctggtgaatgtgcctttgtgtgtcgatatgtgtcttaactggcttcttaacgtctatgacactggccgcactggacgaatcagagtgctgtccttcaagaccgggattatcagcctgtgtaaggctcacctggaagataagtacaggtaccttttcaaacaagtggcctcgtcaactggtttttgtgaccaaagacgtttgggcctcttgctgcatgattcgattcagattccccgccaacttggagaggtggcatccttcggaggatcaaacatcgaaccctccgtgagatcttgcttccagtttgctaacaataagcctgaaatcgaggccgcactcttcctcgactggatgagactcgagcctcagtcgatggtgtggctgcccgtgcttcatagggtggcggcggcagaaactgcaaagcaccaagcgaaatgtaacatttgtaaggaatgtccgataattggctttcgttacagatcgctgaagcactttaactacgatatctgtcagtcgtgttttttctcaggtcgagtcgcaaagggacacaaaatgcattatcccatggtggagtactgcacgcctaccacttcgggtgaagatgtgagggacttcgcgaaagtcctgaagaacaagtttcggactaagagatacttcgccaagcatcctcgtatggggtacctgccagtccagaccgtgcttgagggggataacatggagacggataccatg

SEQ ID NO: 251336 - DNA, 3432 bp, Artificial Sequence
  Description of Artificial Sequence: Synthetic coding sequence
atgctctggtgggaggaggttgaagattgctacgaacgagaagacgtgcagaagaagacgttcacaaaatgggtcaacgcacaattctcaaaattcggaaaacagcacatagagaacctgttcagtgatttgcaggatggccgccgactgctggatctgctggaggggctcactgggcagaaactgcccaaggagaagggatccacccgcgtccacgctcttaataatgtaaataaagctcttcgcgtccttcagaacaataatgtggatctggttaacatcggttctacagatatcgtcgacggaaatcataagttgaccctgggcctgatttggaacatcatattgcattggcaagtcaagaacgtcatgaaaaatataatggccggcctgcagcagactaactccgaaaagattctgttgtcctgggtgaggcagagcacacgaaactacccccaggtgaacgtgatcaacttcaccacgtcctggtccgatggactcgccctcaacgcgctgattcactcccacagacctgacctctttgactggaacagtgtagtatgccagcaaagtgcaactcagcgcctcgaacatgccttcaacatcgctagataccagttgggcatagaaaagcttctcgatcccgaggacgttgatactacataccctgacaagaagtccatcttgatgtatattacatcactgtttcaggtgcttccgcaacaggtgagcattgaggcgatccaagaggtggagatgctccctagacctccgaaagtcaccaaagaagagcattttcaattgcatcaccagatgcactactcccaacaaataaccgtttccctggcacaggggtatgaacggacatcatcccctaagcctaggtttaaatcctatgcttacacccaggccgcttatgtgaccacctccgaccctacgaggtctcccttcccttctcaacacctggaggctccggaggacaagtcctttggatctagccttatggagtccgaggttaacttggaccggtatcagacagccctggaggaggtcctgagttggctgctgagcgccgaggatacactgcaggctcagggagaaatttccaacgacgtggaagtcgtgaaggatcaattccatactcacgaaggatacatgatggatctcacagcccaccaaggccgcgtgggtaatatcctgcagcttgggtcaaagctgattggaacaggaaagctttctgaggacgaggaaaccgaagtgcaggagcagatgaacctgctgaattccagatgggagtgtctccgagtcgcttctatggagaagcaatctaatctgcaccgagagatctcttacgtgcctagtacttatcttaccgagatcacgcacgtgagtcaggcattgctcgaagttgagcagctcctgaatgctccagacctgtgcgcgaaggactttgaggatctgttcaagcaggaggagtcactcaaaaacatcaaagacagtttgcagcagagtagcggcaggatcgatattattcattctaaaaagactgccgcactccaatccgcaacacccgtggaaagagtaaaattgcaggaggcactgtcccagctggactttcagtgggagaaggtaaacaagatgtacaaagaccggcaaggccgctttgacagatctgtggagaaatggagaaggtttcattatgacattaagatctttaaccagtggctcaccgaagctgaacagtttctgcggaaaacacaaattccggagaactgggagcacgccaaatataagtggtatctcaaagaactgcaggatggaatcggccagcgccagaccgttgtgcggaccctgaacgccaccggcgaggaaatcatccaacagtcctcaaagaccgacgcaagcatcctgcaggaaaaactgggctccctgaatctccggtggcaggaagtctgtaaacaactgagcgaccgaaaaaagcggctggaagaaacgcttgagcgacttcaggaactccaggaggcaactgacgagctggacctgaagctgcgacaagccgaggtgatcaaggggtcttggcagccagtgggagacttgcttatcgattctctccaggatcacctcgagaaggtgaaggctcttaggggtgagatcgctcctctgaaagagaatgtctctcacgtgaacgaccttgctcgccaactgaccacactcggaatccagctctcaccctacaacttgagcactcttgaggacctgaatacgcgctggaaactcctgcaggtagccgtggaagaccgggtccgccagttgcacgaggctcacagggacttcgggcctgccagccagcactttctttctaccagcgtgcagggcccgtgggagcgggcgatcagcccaaataaggtgccatactacattaatcatgagacccagacaacttgttgggaccaccctaaaatgaccgagctgtatcagagccttgccgatctcaacaacgtgaggttctccgcctacaggaccgctatgaaactccgaaggttgcagaaagctttgtgtttggacttgctttctctgtcagctgcttgtgacgccctggaccaacataacctgaaacagaatgatcagcctatggacatactgcagattattaactgcctcaccaccatctatgaccgcctggagcaagagcacaataatctggtgaacgtccctctctgcgtagatatgtgtctgaactggctgctgaacgtttacgatacaggtcgcaccgggcgcatcagagtcctctccttcaagacaggcatcatcagtctctgcaaggcgcatctggaagataagtatcgctatctctttaagcaggttgcatcctccaccggcttctgcgatcagcggcgattgggcttgctgttgcatgatagtatccagataccccggcagcttggagaagtcgccagtttcggcggctcaaatatcgagcctagcgttcgctcttgcttccaatttgctaacaataagcccgaaattgaagcagcgctttttctggactggatgagactggaaccccaatctatggtgtggctcccagtcctgcaccgagtggcggcagcagaaaccgcgaagcatcaggccaagtgtaacatctgcaaggaatgtcctattatcgggtttaggtatcgaagtcttaaacatttcaactatgatatatgtcagagttgcttcttcagtggacgagtggccaaggggcataagatgcactacccaatggtagaatattgcactccaactacatccggtgaggatgtccgggattttgccaaggttttgaagaacaagtttaggaccaagcgatatttcgccaagcatcctcggatgggatacctccctgtgcaaacggtgctcgagggggacaacatggaaacagacactatg

SEQ ID NO: 251337 - DNA, 3432 bp, Artificial Sequence
  Description of Artificial Sequence: Synthetic coding sequence
atgctttggtgggaggaagtggaagattgttacgaacgagaagatgtgcagaaaaaaacatttacaaaatgggttaatgctcagttttcaaaatttggaaaacaacatatcgagaatctcttttctgatctccaggatggacgcagactgctagatctgcttgaagggctcacaggacaaaagctcccaaaagagaaaggatctacacgcgtgcatgcactcaacaatgtaaataaggctctgcgagtgctccagaataataacgtagacctcgttaatatcgggtcaacagatatcgtggatgggaaccacaaattaacactcgggcttatatggaatataatcttgcactggcaggtcaaaaatgtgatgaaaaatatcatggctggactccagcagacaaattccgaaaagatactactgtcgtgggtcaggcagtctacaaggaactacccccaggtcaacgtaataaatttcactacatcctggagtgatggactcgcactaaacgcactgatccattcccaccgccccgatctttttgactggaattctgtggtgtgccagcagtctgctacacaaagactcgagcatgcattcaatatcgccagatatcagttggggatcgaaaaactgctcgacccagaagatgtagacactacatatcccgataagaaatccatattaatgtatatcactagtctgttccaggtattgccgcagcaggtgtccatagaagcaattcaggaagtggaaatgctcccacggcctcctaaagtcacaaaagaggagcactttcagttgcaccaccagatgcattattctcagcagatcacagtttctcttgcccaggggtatgaaagaacatcttctcccaaaccaagatttaaatcttacgcctacacacaggcagcatatgtcacaacttctgatcctacacgatccccattcccctctcagcacctagaggctcccgaagataaatctttcgggtcttctctgatggaatccgaagtgaacctggatcggtaccagactgctcttgaagaagtgctctcctggctgctcagtgctgaagacactctacaggcccagggagaaatttcaaatgatgtagaagtggtgaaagatcagttccatactcacgaaggatacatgatggatttaacagctcatcaggggcgagtaggaaatatcctgcagctcggatccaaactgatcggaactggaaaactttccgaagatgaagaaactgaggtacaggaacagatgaatctactgaattcgcggtgggaatgcctaagggtggcttcaatggagaagcagtccaacctccacagagagataagttatgtcccttccacatacctaactgaaatcactcacgtgtcacaggcgttgctagaagtcgaacagctacttaacgctcctgatctgtgtgctaaagattttgaagatctctttaaacaggaagaatctctaaaaaacataaaggattctttacagcagtcttctgggcggattgatataattcactctaaaaaaacagcagctcttcagtccgcaacacccgtagaacgcgtaaaactccaggaagcgctgagtcagctggactttcagtgggaaaaagtcaataaaatgtataaggataggcagggacggtttgacaggtctgtcgaaaaatggcgccgatttcattacgatatcaaaatcttcaaccagtggctcactgaagccgaacagtttctgcgaaaaactcagattcctgaaaattgggaacatgccaaatataagtggtacctcaaggaactccaggatggaatcggacagagacagacggtggtgagaacacttaatgccactggagaggaaattatccaacagagttctaaaacagacgcttccattctccaggaaaagctgggaagtctcaaccttagatggcaggaagtctgcaagcagctatcagatcgcaaaaaacgactagaagaaacactggaaagactccaggaactccaggaagccactgatgaactagatcttaaactaaggcaagctgaagtgatcaaggggagttggcagcctgtcggggatctcttaatcgattctttgcaagatcacctagaaaaagtcaaagccctgcgtggggaaatcgctcctctgaaagaaaacgtctctcatgtgaacgacttggcaagacagctcactactctaggaatccagctgtccccatacaaccttagtacactcgaggatctgaatactcggtggaagttgctccaggtggccgtagaagatagggtgaggcagttacatgaagcccatagagatttcgggcccgctagtcagcactttctttccacatcagtccaggggccctgggaaagggccatttcccctaataaagtgccatattatataaatcacgaaacacagactacttgttgggaccaccccaaaatgacagaactgtaccagtcactagctgacctgaacaatgtccgcttcagtgcatatagaacagctatgaaactgcggagacttcagaaggctctctgtctggatctcctgagtctctctgctgcctgcgatgcgcttgatcagcacaatctgaagcagaacgatcagcccatggacatccttcagataataaattgccttacaacaatctatgatcgactggaacaggaacataataacctagtgaacgtgccactctgcgtggatatgtgcctaaactggctcctgaatgtctatgatactggacgaacaggaagaattcgagtgctatcattcaaaactgggattatctctctatgtaaagctcaccttgaagataaataccgatatctatttaaacaggttgcgtcatcaacaggattctgtgatcagcggcggctcggactgctccttcatgattccattcagataccacgccagctcggggaagtggcctcattcggaggatcgaatattgaaccttccgtaaggtcatgctttcagtttgctaacaataagcctgaaatcgaggctgcgctgtttctggattggatgcggctcgaacctcagtcaatggtatggttacctgttcttcaccgcgtggcagccgctgaaacagccaaacatcaggcaaaatgcaatatttgcaaagaatgcccaatcatcgggttcaggtaccgctctctaaaacatttcaactacgatatctgccagtcttgctttttcagtgggcgggtggctaaaggacacaagatgcactaccccatggttgaatattgcacaccaacaacatccggagaggatgttagggattttgcaaaggtactcaaaaataaatttcgcactaaacggtactttgctaaacatcccaggatgggatatctgcctgtccagactgtgctggaaggagataacatggaaacagacacaatg

SEQ ID NO: 251338 - DNA, 3432 bp, Artificial Sequence
  Description of Artificial Sequence: Synthetic coding sequence
atgctgtggtgggaggaggtggaggactgttacgagcgcgaggatgtgcagaagaagaccttcaccaaatgggttaacgcccagtttagtaaatttggtaagcagcatatagagaaccttttttccgatttgcaggatgggcgccggctactggatctgctggaggggcttacaggacagaagttgcccaaagagaagggatctacaagagtacacgcccttaataacgttaacaaagcgctgcgggtgctccaaaataacaacgttgacctggtgaacataggaagtaccgatattgtggacggcaatcacaagcttacacttggtttgatctggaatattatactgcattggcaggtgaaaaatgtcatgaagaacattatggcggggttgcaacagactaattccgagaaaattctactgtcttgggtgcgccagtcaactagaaattatccgcaggtcaacgtgatcaacttcacaacctcgtggagtgacggactagcactcaacgcacttatccacagccacaggccggatctattcgactggaattcagttgtgtgtcagcagagcgcaacccagcggctggagcatgccttcaacattgcacgatatcaactcggcattgagaagctgctggaccccgaggatgtcgacacgacctatccagacaagaaaagtatcctcatgtatattaccagcttgtttcaggtcctgccccagcaggtttcaatcgaggctatccaagaagtggagatgctaccccggccacccaaagtgactaaagaggagcacttccagctgcaccaccaaatgcactattcccagcagatcacggtgagtctcgcacagggatatgagagaaccagttctccgaagccacgattcaagtcatatgcctacacgcaggcagcctacgtaacaaccagcgacccaacccgaagtcccttcccttctcagcatttggaagcaccagaagataaaagttttggaagcagtctgatggaatctgaggtgaacctcgatagataccagactgcactggaagaagtgctgtcatggctcctctctgccgaagataccctgcaggcccagggcgagatctctaacgatgtcgaagttgtgaaggaccagtttcatacgcacgaagggtacatgatggatcttaccgcacatcaggggcgagtgggcaacatcttgcagctgggcagtaaactaatcggcacaggtaagttgagcgaggacgaggagaccgaggttcaggaacagatgaatctgcttaattcacggtgggagtgtctgcgtgttgcctctatggaaaagcagtctaacctccaccgcgagatttcgtatgtgccatctacatatctaactgagatcactcatgtttcccaggctctgttggaggttgaacagctcctcaacgcgcctgacctgtgcgcgaaggacttcgaggatctctttaagcaggaggaatctctcaaaaacataaaggattccctacagcagagttctgggagaattgatatcattcattctaagaagacagcggcgctacagtcagcgactccggtggagagggtcaagcttcaggaagcgctatctcagctggacttccagtgggagaaagtgaataagatgtacaaagacaggcaagggcgatttgaccgatccgtcgaaaagtggcgccggtttcactacgatataaaaatctttaaccagtggcttaccgaggccgagcaatttctgaggaagacccagatcccagaaaattgggagcacgccaagtataagtggtacctaaaagaattgcaagatgggataggtcagcgtcagacggtggtgcggacactgaacgctaccggcgaagaaatcattcagcagagctcaaagaccgatgcaagtatcctccaggagaagcttgggtcccttaacctacgatggcaagaagtatgcaaacaattgtcagacagaaaaaagcgccttgaggagactctggaaaggttgcaggaactccaagaggccacggacgagctggatttgaagctcaggcaggccgaggtgataaagggatcatggcagccggtgggggatctcctcattgattccctccaggaccacctcgaaaaggtaaaggcactgaggggggagattgccccactcaaagagaacgtctcccacgtaaacgacctggctcgccaactcacgacactaggcatccagctttccccgtacaatctcagcactctggaggatttgaacactagatggaagctgctgcaggtagctgtagaggacagggtgagacaattacacgaagcacaccgtgatttcggacccgccagccaacatttcctttccacctcagtccaggggccgtgggagagggctatttcacccaacaaggtaccctactatataaatcacgagactcagaccacgtgctgggaccatcccaagatgaccgagctttatcaaagcctcgctgatctcaacaacgtcaggttcagtgcataccgcaccgccatgaagctgcggagactacagaaggccctgtgcttagatctcctgtctctctcagcagcctgcgacgccctagaccagcataatctcaagcaaaacgaccagccaatggatattttgcagatcatcaattgcttgacaacaatctacgatagactagaacaggagcataataacctcgttaacgtgccattatgtgtcgacatgtgtctgaactggctgctgaacgtgtacgacaccgggaggactggaaggattagagtgcttagttttaaaactggcataatctctttgtgtaaggctcatttggaagacaagtacaggtatctgttcaagcaggttgcatcttctaccggcttctgcgaccagaggaggctgggtctgttgctgcacgacagtattcagattccccgccagctgggagaagttgccagttttggcggctctaatatagaaccatcagtgcgaagctgtttccagtttgccaacaacaagcccgagatcgaagccgccctcttccttgattggatgcgactggaacctcagagcatggtttggttacccgtcctccaccgtgtggcggcagccgagaccgctaagcaccaggctaaatgcaacatttgtaaagagtgtcctataatagggttccgatatagaagcctaaaacacttcaattacgacatctgtcagtcctgctttttctccgggcgggtggccaaaggacacaagatgcactatccaatggtcgaatattgtacaccaaccacatctggggaagacgtgcgggactttgccaaggtgcttaagaataaatttcggactaagcggtattttgcaaagcaccccagaatgggttacctgccagtgcagaccgtccttgagggcgacaatatggaaactgacaccatg

SEQ ID NO: 251339 - DNA, 3432 bp, Artificial Sequence
  Description of Artificial Sequence: Synthetic coding sequence
atgctctggtgggaagaagtcgaggactgttatgagcgggaggatgtccaaaagaagacatttactaagtgggtgaatgcccaatttagtaagtttggcaaacaacacattgagaacctgttttcagacctgcaggacggtcggcgcctgcttgatctgctggagggactgaccgggcagaagctgccaaaagagaaggggagcactagggtccatgcattgaacaacgtgaacaaggctttgcgggtgttgcagaataacaacgtggatctggtgaacatcggatccacagacatcgttgatggcaatcacaagcttactctggggctgatctggaatattattctgcactggcaggttaagaacgtgatgaagaatattatggctggactgcagcaaaccaatagcgaaaagatcttgttgtcctgggtccggcagtccacgcggaactatccccaggtcaatgttattaacttcaccacctcttggagcgacggtctcgcactgaacgctctcatccacagccaccgccctgacctgttcgattggaactcagttgtttgtcagcagtcagctactcaaagacttgaacatgcattcaatatcgcaagataccagctgggaattgagaagctcttggacccagaggatgtagacaccacctatcccgataagaagtctatcctcatgtacataacatccctgtttcaggtcctgcctcagcaagtgtccattgaagctattcaggaggttgagatgctccctcgcccgcctaaggtgacgaaggaagagcattttcagctccatcatcaaatgcattacagtcagcagattactgtatccctggcccaggggtacgaacgaaccagcagccctaagcctcggttcaagtcttatgcttatacccaggcagcttatgtcacgacaagcgacccgaccaggtcaccctttccctctcagcacctggaggcaccggaggacaagtcctttggtagctcactcatggaatccgaggtgaacctggaccggtatcagacagcgttggaagaagtgctctcctggcttctctccgcagaagacactcttcaagctcagggagagattagcaatgacgtcgaggtggtgaaggatcagtttcacacccatgagggttacatgatggatcttaccgctcatcaaggccgagtgggcaacatccttcagctgggtagcaagctcatcggcacagggaaactttcagaggatgaggaaacagaggtgcaggaacaaatgaatttgctcaatagtagatgggagtgtctgagagtggccagcatggagaaacaatccaatctgcacagagagatctcctacgtgccctctacctacctcaccgagataacccacgtctctcaggccctgttggaagttgagcagcttctcaacgcccccgatctgtgtgccaaagattttgaggacctgttcaagcaggaggagagcctcaagaatattaaagattcccttcagcagagtagcgggaggatcgatataatccactccaagaaaacagctgcattgcaatcagccacgcctgtagaaagggttaagctgcaggaggccctctctcaactcgattttcagtgggagaaggtaaataagatgtacaaagaccgccagggtcggttcgacagaagtgtggagaaatggaggcgctttcactatgacattaaaatcttcaaccagtggttgaccgaagccgaacagtttctcagaaagacacagatccccgagaattgggagcacgctaaatacaagtggtacctcaaggagctgcaggacgggatcggtcaacgccagacagtcgttcgcacactgaacgcaaccggggaagagatcatacagcagtcctctaaaacagatgcctcaatcttgcaagagaaacttgggagtttgaacctgcgctggcaggaagtgtgtaagcagctcagcgataggaagaagcgacttgaagagacgctcgagaggctgcaggagcttcaggaggccacagatgagctggacctgaaacttagacaggcagaagtgatcaagggctcttggcaaccggtgggggatttgctgatcgactccctccaggaccacctggagaaagtaaaagccctccgaggcgagattgcacctctcaaggaaaacgtgagtcatgtgaatgacttggctcggcaactcaccacactggggatccagctgagcccttacaacctctctaccctcgaggatctcaacactaggtggaagttgctgcaggttgctgttgaggaccgggtacggcagttgcacgaagcacatagagattttggccccgccagccagcattttctgagcactagtgtgcagggtccgtgggagcgggctatctctccaaacaaggtaccatactacataaaccacgaaacacagacaacttgctgggatcacccaaaaatgacagagctctatcaatccctcgctgacctcaacaacgtccggttctctgcataccggactgccatgaagctccgccggttgcaaaaagccctctgtcttgacctcctcagcctcagtgcggcctgcgacgctctcgatcagcacaacctgaaacagaatgatcaacccatggacattctgcagattatcaactgtttgacaacgatctatgatagactggagcaagagcataacaatctggtgaacgttcctctgtgcgtggatatgtgcctcaactggctgcttaacgtatacgacaccgggagaacgggacgaattagggtcctttccttcaaaacaggaatcatttctctgtgtaaggcccaccttgaggataagtaccgatatctgtttaaacaagtggcatcttccactggtttctgtgaccaacggagactgggactgctgttgcacgacagcatacagattcccagacagctcggggaggtggcttcttttggcggcagcaacatagaaccctctgtacgctcatgcttccagttcgccaacaataaacccgaaatcgaggccgcgctgtttctcgattggatgaggctggagccacagtctatggtgtggctgccggtgctgcatcgagttgcagccgccgagacagccaagcatcaggccaagtgcaacatctgtaaggagtgccctatcattggattccgctaccgctccctgaagcatttcaactacgatatctgtcagtcctgctttttctccggcagagttgccaaagggcataagatgcattatccaatggtggagtattgtacacccacaactagcggagaggatgtgagggatttcgcaaaggtgctgaagaataaatttcggaccaagaggtattttgccaaacacccccgaatgggttaccttccagtgcagacagtattggaaggggacaacatggaaacggacactatg

SEQ ID NO: 251340 - DNA, 3432 bp, Artificial Sequence
  Description of Artificial Sequence: Synthetic coding sequence
atgctctggtgggaagaggttgaggactgttacgagcgggaggatgtccagaagaaaaccttcacaaagtgggtgaacgctcaatttagtaaattcggaaagcagcatattgagaacctgttcagcgacttgcaagatggacgacgcctgctcgacctactggagggattgaccggtcaaaagttaccaaaagaaaaaggtagtacgagagtacacgcccttaataatgtgaataaggcactgcgggtgctgcagaacaataatgtcgaccttgtcaacatcggaagcactgatatcgtggatggaaatcataagttgacccttggtcttatttggaacataatacttcactggcaggtgaaaaacgtcatgaaaaatatcatggccggccttcagcagacgaactcagagaaaattttgttaagttgggtgaggcagtccactaggaattatccccaagtaaatgttatcaactttaccacttcttggtcggacgggcttgccctaaatgccctcattcactctcatcgacccgacctcttcgactggaattccgtcgtatgtcagcagtccgcgacacagcgcttagaacacgctttcaacatcgcaaggtaccagcttgggatcgagaagcttctggatccggaggatgtcgataccacctacccagataagaaatccatcctgatgtacattacatctctcttccaagttctgcctcagcaggtatccatcgaagcaatccaggaggtcgagatgctgccaaggcccccaaaggtgaccaaagaggagcatttccaattgcatcatcagatgcattactctcagcagataaccgtgtctttagcccaggggtatgagcgtacttcatcgccgaagcctcgctttaagtcttacgcttatacccaggctgcatacgttactacctctgatccaacgcggtcgcccttccctagtcagcaccttgaggccccagaggataaatccttcggatcatctctcatggaaagcgaggtcaacctggaccgctatcagactgccctcgaagaggtcctatcttggctgctgtctgcagaggacacgctacaggcacagggagaaataagtaatgacgtcgaagtagtcaaggaccaatttcatactcacgaagggtacatgatggacctgactgcccatcaaggccgggtgggtaatatcctccaactaggaagcaagctcattggcacaggcaagttgtccgaggacgaggagacggaggtgcaggaacaaatgaaccttctgaactctcgttgggagtgcctcagagtggcttcaatggaaaaacaaagtaatctgcaccgagagatctcttatgtacccagcacttacttgacggaaattactcacgtttctcaggccctactggaggtagaacagttactcaatgcacctgatctctgtgcgaaggacttcgaggatctgttcaaacaagaggagagtttgaaaaacattaaagactccctgcagcagtcttctgggagaatagacatcattcattctaagaagactgctgcgctgcagtccgctacaccagtagagcgagttaaattgcaggaagcgctcagtcagttggactttcagtgggagaaagtgaataaaatgtataaagaccgtcagggtagattcgacagaagcgtggaaaagtggcgccggtttcactacgacatcaagatcttcaaccagtggctaacagaggccgaacagttcctgcgcaagacccagattcccgagaattgggaacatgctaagtacaagtggtacctgaaggagttgcaggatggcattggccagcgacaaacggttgttaggactctgaatgccaccggtgaagaaatcattcagcagagtagcaagacggacgcaagcatcctgcaggagaagctgggaagcctaaacttgcggtggcaggaagtgtgtaagcagctctcagaccggaaaaaacgtctggaggagacactcgaacgtctgcaagagctgcaggaggctacggacgagctggatctcaagttaagacaagcagaagtgattaaagggtcctggcagccggtcggagatctgttgatagactcactgcaggatcaccttgaaaaggtaaaagcgctgcgtggggagatagccccgctgaaagaaaatgtcagtcatgtcaatgatttagctcgacaactcaccacacttgggatccagctttccccatacaatctcagcaccctcgaagatttgaacacaagatggaagctgctccaggtggctgtggaggatagggtacggcagctccacgaagcgcaccgtgattttggaccggcatcacagcatttcctaagcacatcagttcaaggcccatgggaacgggcaatatcccccaataaagtgccctactacattaatcacgaaacacagacaacctgttgggaccaccccaagatgactgagttatatcagtccctggcagacctcaacaacgtccgcttctcagcttaccgtaccgccatgaagttgagacgtcttcaaaaggctttgtgtttggatctgctatcactctcagccgcctgcgacgcactggatcagcataaccttaaacaaaacgaccagcccatggacatcttacagattatcaattgtcttacgaccatttacgaccggttagaacaagagcacaataatctggtgaacgtgccactgtgtgtggacatgtgcctgaactggctgctgaatgtttacgatacaggacggacggggcgtataagggttctgtcttttaaaacaggtatcatctccctttgtaaggctcacctcgaggacaagtacagatacctgttcaaacaggttgcgtcctccacagggttttgcgaccaaaggcggttaggcctcctcttacacgatagcattcagatcccacgccagttaggcgaagtcgcatcattcggcggaagtaacatcgagcctagcgtgagatcatgttttcagtttgcaaataacaaacctgagattgaggccgcgttgttcttggattggatgcgcctggagccccagagtatggtgtggcttcctgtcctgcaccgggtggcagcagcagagacagccaagcaccaagccaaatgtaatatctgcaaagagtgcccaattattggatttcgttacagatcactcaaacattttaactacgacatctgccagagctgttttttctcaggaagggtcgcgaaggggcataaaatgcattaccccatggtcgaatattgcacccccacgacctcaggagaggacgtgagggacttcgccaaagtgctgaagaataagtttagaaccaagaggtactttgctaagcacccccggatgggatacctgcccgttcagaccgtgctggagggggataatatggaaacggacacaatg

SEQ ID NO: 251341 - DNA, 3432 bp, Artificial Sequence
  Description of Artificial Sequence: Synthetic coding sequence
atgctctggtgggaagaagtggaggattgttacgaacgagaggacgtccagaaaaagacgtttactaagtgggtcaacgcacagttctcaaagttcggaaaacagcatattgaaaatcttttctcagatctccaagacggtcggcgcttgcttgaccttttggaaggcctgacgggccaaaaactgcccaaggagaagggctcaacccgggtgcatgctctcaataatgtgaacaaagcccttcgcgtgcttcagaataacaatgtggacctggtcaacattggatccactgacatcgtcgacggaaaccataagttgacgcttggtctgatttggaacattatactgcattggcaagtgaagaacgtgatgaaaaacatcatggcagggctgcaacagactaactccgagaaaattctccttagctgggtgagacaatccacgcgcaactacccccaagtgaacgtgattaactttactactagctggtcggatggcttggcactgaatgcgttgattcactcccatcgccctgacctgttcgattggaatagcgtggtgtgccaacagtcggcaactcagagactggaacacgcgtttaacatcgctagataccagctgggcatcgaaaagttgcttgatcccgaagatgtcgacaccacttatccggacaagaagtcaatcttgatgtacattactagcttgtttcaggttcttcctcaacaagtctcaatcgaagcaatccaggaagtcgaaatgctgccccgtcctccgaaagtgaccaaggaagaacacttccagctgcaccaccaaatgcattacagccaacaaattactgtgtccctggctcaggggtacgaaaggacctcgtcaccgaagccacggttcaaatcatacgcttacactcaggcggcgtatgtcaccacttcggatcctacccggtcgccatttccatcacaacatcttgaggcgccggaagataagtcgtttggaagctcgcttatggaatccgaggtcaatctcgatcgctaccagacggcactggaagaagtgttgtcgtggctgctgtcagcagaagataccctccaagcacaaggggaaattagcaacgatgtggaggtcgtcaaagaccaattccatacccatgaaggttatatgatggacctgactgcgcatcaaggacgggttggaaacattcttcagctgggctccaagctgataggcactggtaagctgtcggaggacgaggagactgaagtgcaagagcagatgaatcttctgaatagcagatgggaatgcctgcgcgtcgcatctatggagaagcaatccaatttgcatagagagatcagctacgtgccatccacttatcttactgaaattacccacgtctcacaagcgttgctggaagtcgaacaactgctgaatgctcctgacttgtgtgcaaaggactttgaggatttgtttaaacaggaggagtcactgaagaacattaaagacagcctccagcaatcgtccggaagaattgacatcatccactcgaagaaaaccgcagccctgcaatcggcaaccccagtggaaagagtgaaacttcaggaggccctgtcacagcttgatttccaatgggaaaaggtcaacaaaatgtacaaggatcgtcagggtcgctttgataggtctgtggagaaatggcgaagatttcactacgacataaagatattcaatcagtggcttactgaagcagaacagtttcttcgcaagactcagattccagaaaactgggaacatgcaaaatacaagtggtacttgaaggaacttcaggatgggataggtcaaagacagaccgtggtccgaactcttaatgcaaccggagaagagattatacaacagtcatccaagaccgatgcatcaattttgcaagagaagctcggtagccttaacttgcgatggcaagaagtctgtaagcaactttcagataggaagaagcggcttgaagagactctggagagactgcaggagcttcaggaggcaactgatgaacttgatctgaagctgcggcaagcagaagtgataaagggatcgtggcaacctgtcggggaccttctcattgactccttgcaagatcatcttgagaaggtgaaagcccttaggggtgaaatcgcaccgttgaaagagaatgtttcccatgttaacgatctggcgcgtcaactgaccaccctcggaattcaactgtccccctacaacctgtccacccttgaagatctcaacactagatggaaactgttgcaggtggccgtggaagatcgcgtgcgccaattgcatgaagcacaccgagattttggaccagcgtcccagcactttctgtccacctccgtgcaaggaccttgggaacgggccatttcacccaacaaggtgccttactacatcaatcacgaaactcaaaccacctgctgggaccaccccaaaatgactgagctgtaccaaagccttgcagatctgaacaacgtgagattttcggcttacagaaccgctatgaagctgcgccgactgcaaaaagccctctgtctggatctgctcagcctttcggcggcctgcgacgcccttgatcagcacaaccttaagcagaacgaccaacctatggatatactgcagatcattaactgtcttactaccatttacgaccggcttgagcaggaacataacaatctggtgaacgtcccactttgtgtggatatgtgtcttaattggcttcttaatgtgtacgataccgggcgtacgggaaggatccgggtgctttcctttaagactggaatcatcagcctgtgcaaggcacatctggaggacaagtacagatacctctttaagcaggtggcctcatcgaccggtttctgtgatcagcggagactgggactgcttcttcatgattccatccaaattcctaggcagcttggcgaggtggcgtcgttcggagggtcgaatattgagccatcggtgagatcgtgctttcaatttgcaaacaacaagcctgaaatcgaggccgcactttttctcgattggatgaggcttgaaccccagtcaatggtctggctccctgtgctccatcgagttgcggcggcagaaaccgcaaagcatcaagccaaatgtaacatctgcaaggaatgtcccattataggatttagataccgatccctgaagcatttcaactacgatatatgtcagtcgtgttttttctcgggacgggtggctaagggtcacaagatgcactaccctatggtggagtactgcacccctactacctcgggtgaagatgtccgcgattttgccaaggtgctgaagaataagttccgcaccaagcgctactttgcaaaacatccacgaatgggttacttgccagtccaaaccgttctcgaaggagacaatatggaaactgatacgatg

SEQ ID NO: 251342 - DNA, 3432 bp, Artificial Sequence
  Description of Artificial Sequence: Synthetic coding sequence
atgttgtggtgggaggaggtcgaagattgttacgagcgcgaggacgtgcagaagaaaacttttaccaagtgggtgaatgcacagttttccaaattcggtaagcaacacattgagaatctgtttagcgacctgcaggacggacgtagactccttgacttgcttgaaggattgacgggacaaaaacttccaaaagaaaaagggtcaactcgagtgcatgctcttaacaacgtcaataaggctcttcgcgtcctccagaataacaatgtcgatctggtgaatattggatcgactgatattgtggatggtaaccataagctgacccttggactgatctggaacatcattttgcattggcaagtgaagaacgtgatgaaaaacattatggccggccttcagcagaccaactcagaaaagattctgctttcctgggtgcgacaatccacccgcaactaccctcaagtgaacgtcattaactttaccacttcgtggagcgatggtctggcacttaatgcacttatacattcccaccggcctgatctgtttgattggaactcggtggtgtgccaacagtccgcaactcaacggcttgagcatgcattcaacattgcaagataccaacttggaattgagaaacttcttgatccagaagatgtcgacaccacttacccagacaagaagtccattctcatgtacatcacctcgctcttccaagtgctgcctcaacaagtctcgatcgaagcaatacaggaagtcgagatgcttcctagacctcctaaggtcactaaggaagaacatttccaacttcatcatcaaatgcattactcccagcagattactgtgagccttgcacagggatacgaaagaacttcctcccctaagccacgctttaagagctatgcatacactcaggcagcctacgtgaccacctcagaccctaccaggtcgccctttccatctcaacatcttgaagcacctgaagataagtcattcggcagttccctcatggaatcggaagtgaacctggatagatatcaaacggcactcgaagaggtgctcagctggcttctttcagccgaagatactctgcaagcacagggagaaatttcgaacgatgtggaggtggtcaaagaccaattccacacccacgagggttacatgatggatctcacggcacatcagggacgcgtgggaaacattcttcagctgggaagcaagttgataggaaccgggaagctctccgaagatgaggagactgaagtgcaggaacaaatgaatctcctcaactcgagatgggagtgtcttagggtcgcatcaatggaaaagcagtcaaatctgcatagagaaatatcatacgtgcctagcacttacttgactgaaatcacccacgtgtcgcaggctctgcttgaggtggaacaactcctcaacgctcctgatctttgtgcaaaggattttgaagatctgttcaagcaggaggagagcttgaagaacattaaagactcgctgcagcaaagctccggccggatcgatatcattcactcgaaaaagacggcagcactgcagagcgcaactccagtcgagcgggtgaaacttcaagaggccctttcgcaacttgatttccaatgggaaaaggtgaacaaaatgtacaaggatagacaaggtagatttgacaggtcagttgagaagtggagacgcttccattacgacataaagatcttcaatcagtggctgactgaagcggaacagtttctgaggaaaacgcaaattcctgaaaattgggagcatgcgaagtacaaatggtacctcaaggaactgcaggatggcataggacaaagacaaaccgtggtcaggaccctcaacgcaactggagaggagatcattcagcaatcatccaagactgatgcatcgattcttcaagaaaaactggggagccttaatcttcgatggcaggaggtgtgcaagcaactctcagatcgtaaaaagagactcgaggaaaccttggaaaggctgcaagagttgcaagaagcaactgatgagcttgacctgaaacttcgccaggccgaagtgataaagggatcatggcagccagtgggtgacctgctgattgattcacttcaggatcatttggagaaggtgaaggcactgcggggggagattgctccccttaaggagaatgtctcgcacgtgaacgatcttgcaagacaacttaccacgctggggattcagctttcaccttacaacctgtccactctggaggatcttaatactcggtggaagctcctgcaggtggcagtggaagatagggtgcgccaactgcatgaagcacatagagattttggaccagcgtcgcagcactttcttagcacttctgtccaaggaccctgggagagggccatctcgcccaacaaagtgccttactacataaaccatgaaactcaaactacctgttgggatcatccgaagatgaccgagctgtaccaaagcctggcagatctcaataatgtccggtttagcgcgtacagaaccgcaatgaagctcagaaggctgcagaaggcattgtgtcttgacctcctgtcccttagcgcagcgtgtgatgcactggatcagcataatctgaaacagaacgatcagccaatggacattctgcagataatcaattgccttactactatctacgatcgcctcgaacaggaacataacaatcttgtgaacgttccactttgtgtggacatgtgtctgaattggcttctgaatgtgtacgacaccggtcgaactggacgtattcgcgtgctctcctttaagactggtatcattagcttgtgcaaggcccatctggaggacaagtatcggtatctgttcaaacaagtagcctcgtctacgggattctgtgatcaacgcaggcttggccttctcctgcacgatagcatccaaatccccaggcagctcggggaagtggcatcatttgggggttcaaacattgaaccttcggtgagatcctgttttcaatttgcaaataacaagcctgagattgaggctgcactgtttctggattggatgcggttggagcctcaatcgatggtgtggcttcccgtcctccatcgagtcgccgcagctgaaaccgcgaagcaccaggcaaagtgcaatatctgtaaggaatgtccgattattggtttcagataccgctcgcttaaacactttaactatgatatttgccaatcctgtttcttttcggggagagtggcaaaaggacataagatgcattacccaatggtggagtactgcactcctacgacttccggggaagatgtcagagactttgccaaggtcctcaagaacaaatttcgtacgaagcgctacttcgctaaacatccaagaatgggatacctgccagtgcagaccgtgcttgagggtgacaacatggaaaccgataccatg

SEQ ID NO: 251343 - DNA, 3432 bp, Artificial Sequence
  Description of Artificial Sequence: Synthetic coding sequence
atgctgtggtgggaagaggtggaggattgctatgaacgggaagatgtgcaaaagaagacttttacaaagtgggttaatgcccagtttagtaagtttgggaagcagcacatcgagaatctgttttccgacctccaggatggtaggcggttgctggacctgctcgaaggcctgactggccagaaactacctaaggagaaaggctctaccagagtacacgcccttaataatgtgaacaaagcgctgagagtccttcagaataataacgtggacctggttaacataggatcgacagacatcgtggatgggaatcataaacttactctcgggctgatctggaatatcatactacactggcaagtaaaaaacgtgatgaagaacatcatggccggactgcagcaaacaaattccgaaaagatcttactttcgtgggtgagacagagcactcgcaattatccccaggtgaatgtgataaactttaccacctcatggtcagatggcttagctcttaacgcactcatccactcccaccgccccgaccttttcgactggaactccgtggtgtgccagcagtccgccactcagaggctcgagcatgccttcaatatcgccagataccagctgggtattgagaaattgttagacccagaagacgtggacactacttatcccgacaaaaaaagtattctgatgtacattacatccctgtttcaggtgctcccccaacaagtctccattgaggctattcaggaagtggagatgctccctcgaccccctaaggtgactaaggaagaacattttcagctgcaccaccagatgcattacagccagcaaatcacagtatcattggcgcagggctacgagcgcacttccagccctaaaccgagatttaagagttatgcttatacgcaggcagcctacgtgacgacttccgaccccactaggtctccctttccctcccagcaccttgaggctcctgaggacaagagttttggaagtagcctaatggaatcagaagttaatttggaccggtaccagacagcactggaggaagtgctgtcatggctgctgagcgccgaggataccctgcaggctcagggcgagataagtaacgacgtcgaggtcgtcaaagatcaattccatacacacgagggttacatgatggacctcaccgcccaccaaggacgggtgggcaatatattacagctaggctctaagctgatcgggaccggaaagttgtccgaagatgaagagaccgaggtgcaggagcagatgaatctgctgaactcacggtgggaatgtctgagggtggctagcatggaaaaacagtccaatctacaccgtgagatatcctacgtgccatccacttacctcacggaaatcacacacgttagccaggccttgcttgaggtggagcagctgttaaacgcaccggatctgtgtgctaaagacttcgaggacctgtttaaacaggaggaatcactgaaaaatattaaggatagtctccagcagtcaagcggccggatagatatcatccacagcaaaaaaactgcggccctacagtctgccaccccagtggaacgggtgaagttacaggaggcgttgtcacaactggacttccaatgggaaaaggtgaataagatgtataaagatcgtcagggccgcttcgaccggagcgtggagaagtggcgccgcttccactatgatataaaaatcttcaatcaatggttgacagaagcggaacagtttctacggaaaacgcaaattcctgaaaattgggagcatgcaaaatacaagtggtacctcaaagaactccaggacggaataggccagcggcagacagtggtgcgaacactaaacgctacaggggaagagatcatccaacaatcatctaagaccgacgccagtatactgcaggagaaactgggaagcttgaatctgcgctggcaagaagtgtgcaaacagttgtccgatcgaaaaaagaggcttgaggagacgctggagaggctgcaagagctgcaggaagcgacagacgaattagaccttaagttgcgacaggccgaagttatcaaaggatcgtggcagcccgttggggacctgctgatcgacagccttcaagaccatttagagaaggttaaggcgctgaggggtgaaattgctcccctgaaagaaaacgtgagccatgtcaatgaccttgcccggcagctgactaccctagggattcaattaagcccatataacctatcaacactggaggacctgaatacgcggtggaaacttctgcaggtggcagtcgaggaccgggtgaggcagctgcatgaagcacatagagatttcggacccgcctcgcagcacttcctctctacctcagttcaggggccttgggaacgcgcgatcagtccaaataaagttccatattatatcaatcacgaaacgcagaccacatgctgggaccaccccaagatgaccgaactgtaccagtctcttgccgatctaaacaatgtgagatttagcgcctatagaaccgccatgaaactgaggagactgcagaaagctctttgtctggatctcctgtctttgtccgccgcctgcgatgccctggaccagcacaacctgaaacagaacgaccagcccatggacattctgcagattattaactgcttgactactatctacgaccgtttagaacaagagcataataaccttgtcaatgtgcccctgtgtgttgatatgtgtctcaattggctgctaaacgtgtacgacaccggacgtaccggcagaatcagggtgctaagctttaaaaccgggataatctcactatgtaaggctcatcttgaggataagtataggtacttatttaaacaggtggcttcttccacaggtttttgcgaccagcgacggctcggactgcttctgcacgattctatccagattcctaggcagttgggtgaggttgcctccttcggggggagcaacattgaacccagcgtgcgaagctgttttcagtttgcaaataataagccggagatagaggccgcattattcctcgattggatgagacttgaaccccagagcatggtctggcttccagttttgcatcgagtggccgcggctgagaccgcaaagcaccaggccaagtgtaacatttgcaaagagtgtcctatcattgggttccggtaccggtccctgaagcactttaattacgacatttgtcagtcatgcttcttctccggcagagtcgcgaaggggcacaaaatgcattatcctatggtagaatattgcactccgaccacttccggcgaggatgtgagagactttgctaaagtcctaaagaacaaattcagaacgaagcgatacttcgccaaacatcctcgaatgggttacctgccagtacagactgtgctggaaggagacaacatggagaccgatacaatg

SEQ ID NO: 251344 - DNA, 3432 bp, Artificial Sequence
  Description of Artificial Sequence: Synthetic coding sequence
atgctatggtgggaagaggtggaagattgctacgagcgcgaagatgtgcagaagaagaccttcacaaagtgggtcaacgcccagttctccaagttcggcaagcagcacatcgaaaaccttttttcggacctccaggatggcagacgtctcctcgacctgctcgagggcctgaccggccagaagctgcccaaggaaaagggctcgacccgtgtgcacgcgcttaacaacgtcaacaaggctttgcgggttcttcaaaacaacaatgtcgaccttgtcaacatcggaagcactgatatcgtcgatggaaaccacaagctcaccctagggctgatctggaacattatcttgcactggcaggttaagaacgtcatgaaaaatattatggcgggcctgcagcagacgaactcagaaaagatcctgttgtcttgggtcaggcagagtacgcgtaactatcctcaggtgaacgttattaacttcacaaccagttggtccgatggcctcgcactgaacgcgcttatccactcccaccgacctgacctgttcgattggaattccgtggtatgtcagcaaagcgcgacccagcgcttggagcatgctttcaacatcgcccgatatcagctgggcatcgagaagcttcttgaccctgaggatgtggacaccacttaccctgacaagaagagcatactcatgtacatcaccagcctttttcaggttctccctcaacaagttagcattgaggcgatccaggaagtcgagatgctgccccgccccccaaaggtcacaaaggaggagcacttccagctccaccaccaaatgcactacagccagcagattacagtttccttggcacagggctacgagcggacctcctctcccaagcctcggttcaagagttacgcctacacacaagcggcttatgtcacaacctccgatccgacccgttcccccttcccttcccaacacctcgaagccccggaggacaagtcttttggttcttccttgatggagagcgaagtcaacctggatcggtaccagacggccctggaggaagtgttatcttggctgctcagcgctgaagacaccctccaggcgcagggcgagatctcaaacgacgtcgaggtcgttaaggaccagttccacacacatgagggctacatgatggatctgactgcgcaccagggcagagtcgggaacatcctccaactcggtagcaagctgataggtaccggaaaactttcagaagacgaggagaccgaggtccaggagcagatgaacctcctgaactcgaggtgggagtgtttgcgcgtggcgagtatggagaagcaatctaacctgcatagggagatcagctatgtgccctcgacgtatctgacggagatcacgcacgtcagtcaggccctgctcgaggtggagcagttgttgaatgcacccgatctctgcgccaaggattttgaggatctgttcaagcaggaagagtctctcaagaatattaaggactctttacagcagtcgtccggtcgtatcgacattatccattcgaagaagaccgctgccttgcagtccgccacaccggttgagcgcgttaagctacaggaagcgcttagccaattggattttcagtgggagaaggtcaataagatgtacaaggatcgtcagggacgcttcgaccgtagcgtcgagaagtggcggcgattccactatgacatcaagatcttcaaccagtggctcaccgaggccgagcaattcctgagaaagactcagattcccgaaaattgggaacatgccaaatacaaatggtatttgaaggaattgcaagatggcataggccaacgccagacagttgttcggaccctgaacgccacgggcgaagagatcatccagcagtcgagcaagaccgatgcctccattctgcaagagaagctgggcagcttgaacctccggtggcaggaggtctgcaagcagttgtcggaccgcaaaaagcggctcgaggagaccttggagcgtctccaggaactccaggaagccacagacgagctcgaccttaagctccgtcaggccgaggtgatcaagggctcttggcagcctgtgggcgatctgttgatagattctttgcaagatcacctggagaaggtcaaggccctccggggcgagatagctcctcttaaggaaaacgtaagtcatgtgaacgaccttgcccgacagcttaccactctcggtatccaacttagcccctacaacctcagcacgttggaggacctgaacacccgctggaagttgctacaggtcgccgtcgaagaccgggtgcgccagctccacgaggctcatcgagatttcggccctgcgtcccaacacttcctgagtacttccgtgcaggggccctgggagcgcgctatcagtcccaacaaggttccctactacattaaccatgagacccagaccacttgttgggaccacccgaagatgaccgagttgtatcaatccctcgcggaccttaacaacgtccggttctccgcctaccgtactgctatgaagttgcggcggttgcagaaggctttgtgccttgacctcttgtctctgtcggccgcctgcgacgccctagaccaacataacttgaagcagaacgatcagccgatggacatcctacagatcatcaattgcctgacgaccatttatgaccgtctggaacaagaacacaacaacctcgtcaacgtgcctctatgcgtagacatgtgccttaattggcttttgaacgtctacgacacaggtcgtacaggccgtatccgtgttctgtccttcaagaccggtatcatctccttgtgcaaggcccaccttgaggacaagtatcgctacctcttcaagcaggtcgcctccagcaccggcttctgtgaccagcgacgtttgggccttctgctccatgattccattcaaattccccgtcagttgggcgaggttgcctctttcggaggctcgaacatcgagccgagcgttcgcagttgctttcagttcgccaacaacaaacccgagattgaagctgctctgttcttggattggatgcgtctagagccccagtccatggtttggctcccggtcctccatcgtgtcgccgccgctgagacggccaagcatcaagctaagtgtaacatctgtaaggagtgccctattattggatttcgttacagatccctgaaacactttaactacgacatttgtcaatcgtgcttcttctctggccgtgtcgcgaagggccataagatgcactatcccatggtcgagtactgtacaccgaccactagcggtgaagacgttcgcgactttgccaaggtcctgaaaaacaagtttcgcactaagaggtacttcgccaaacatccgaggatgggttacttgcccgtccagacagtactcgagggtgataacatggagaccgatacaatg

SEQ ID NO: 251345 - DNA, 3432 bp, Artificial Sequence
  Description of Artificial Sequence: Synthetic coding sequence
atgctgtggtgggaggaggtagaagattgctacgagagagaggatgttcaaaagaagactttcaccaaatgggttaacgctcaattcagcaagttcggtaagcagcatattgaaaacctgttctctgatctgcaggatggtagaagactgctggatcttctggaagggctgacgggccagaagcttcccaaggagaagggcagcacacgcgtgcatgccctcaacaatgtgaataaagcccttagggtgctgcagaataataacgtagaccttgttaacataggctccacagacatcgtggatggtaaccacaaactgacacttggtctcatttggaacatcattcttcactggcaggtcaaaaacgtgatgaagaatatcatggccggacttcagcagactaacagtgagaaaatcctgctctcatgggtgcggcagagcacaagaaattacccgcaggttaatgtcatcaactttactacctcctggtccgacggtctcgcactcaacgctctcattcatagccatcgcccagacctcttcgattggaattccgtcgtgtgccagcagagcgctacccagcgccttgaacatgccttcaatattgccagatatcagttgggtatagaaaaactcctggatcccgaggacgtagacactacctatcccgacaagaaatccatactcatgtacatcaccagcctgtttcaggtcctcccacagcaggtgagtattgaggccatacaggaagtcgaaatgctccctaggccacccaaggttacaaaagaggagcactttcaactccaccaccagatgcactactctcaacagataacggtctcactggcgcaaggctacgagagaacctcctctcctaagccccggtttaagtcatatgcgtatacccaagctgcctacgttactaccagtgatccaacgcgatcccccttcccttctcaacacctggaggcccccgaagacaaaagctttggctccagtcttatggaatcagaggtgaacctggaccgctatcagacagctctggaagaagtcctgagttggctgctgtccgccgaagacacccttcaagctcaaggagagataagtaacgatgtggaggtcgttaaagatcagttccacacacacgagggttatatgatggacctcaccgcccaccagggcagggttggaaatatcctgcagctggggtccaagctgattggcaccggaaaactgtccgaagatgaagaaactgaggttcaggaacaaatgaacttgttgaattcccgctgggaatgccttagagtagctagtatggagaagcagtcaaatctgcatcgggagatctcttatgtaccatctacgtatctgacagaaatcacgcatgtctcccaggcactgctggaagtcgaacaactgcttaatgctcccgatctctgtgccaaggactttgaggacctgttcaagcaggaggagagtctcaaaaacattaaagacagtttgcaacagtccagcggccggatcgacataatccactcaaaaaagaccgctgctctgcaaagcgcaaccccagtagaacgagttaaactgcaagaggcactgagccagttggacttccagtgggaaaaggttaataaaatgtataaggacagacaaggtcgattcgacaggtctgtagagaaatggaggcggtttcattacgatatcaagatattcaaccagtggctcactgaggctgagcaattcctgagaaagacgcagattccggaaaattgggaacatgccaagtataagtggtacctgaaggagctgcaagacgggatcggccagcgccagacagtcgtccgcacactcaacgctaccggcgaggagatcatccagcagagctccaagacagatgcctcaatactgcaggagaagctggggtccttgaacctccgctggcaggaggtgtgtaaacaactgtccgataggaagaaacgcctggaagagacactggaaagactgcaggaattgcaggaagcaaccgacgaactcgatcttaaactgcgccaggccgaggtgatcaagggttcctggcagcctgtgggcgatctgttgatcgactccctccaggatcatctggaaaaggtaaaggccctgaggggagagattgcccctctcaaggagaacgtcagtcacgtcaacgatctggccagacagttgacgaccctggggatccaattgtctccatacaatctgtctaccctggaggatctgaacaccaggtggaaattgctgcaggtagccgtcgaagatcgcgtaaggcagttgcacgaagcccaccgcgattttggtcctgcctcccaacacttcctctccaccagcgttcaggggccctgggagcgcgcaatcagccccaataaggtgccctattacattaatcacgaaactcagactacatgttgggatcatcccaagatgactgagctctatcagagccttgcagacctcaataatgtccggttctccgcgtaccggactgcaatgaaactccgcagactgcaaaaggccctgtgcctggatctgctgtctctgtccgcagcctgcgacgctcttgaccaacacaatctgaaacagaacgaccaaccaatggacatactgcagattataaactgtctgaccactatctatgaccgccttgagcaggagcacaacaacttggtcaatgtgccactgtgcgtcgatatgtgtttgaactggctgctgaacgtgtacgacactggtcggacgggtagaattcgcgttctgtcttttaagacaggtatcatctctttgtgcaaggctcaccttgaagataaatacaggtacctgtttaagcaggttgcgtcatccactgggttctgcgaccagaggagactcggtctgctcctgcacgacagtatccagattcctcgccagctgggggaggtggcctcattcggggggtctaacatcgagccatctgttaggagctgtttccagttcgccaacaacaaacccgagatcgaggccgcgctcttcctggattggatgaggctggaacctcaatcaatggtatggctgcccgttctgcatagagtggcagccgccgagacagccaagcatcaggccaagtgcaacatatgtaaagaatgtcctatcattggcttccggtaccgctccttgaaacattttaattacgatatctgccagagctgttttttctctggtcgggtcgcaaaaggccacaaaatgcattaccccatggttgagtactgtacgccgaccacctccggcgaagacgttagggatttcgcaaaggtgttgaagaacaaattcaggacaaagcgctactttgcgaaacatcctcggatggggtatctccctgtccagaccgtcttggagggcgacaatatggaaacagacactatg

SEQ ID NO: 251346 - DNA, 3432 bp, Artificial Sequence
  Description of Artificial Sequence: Synthetic coding sequence
atgctgtggtgggaagaagtggaggattgctacgagagggaggatgtccagaagaaaacttttactaaatgggtgaacgcccagttttccaagtttggaaaacaacacatcgaaaacctcttcagtgacttgcaggatggccggaggctgctggatctgctggagggcctcaccgggcagaagttaccaaaggaaaagggaagcacccgggttcacgccctcaataacgtgaacaaagccttgcgagttctccagaataacaatgttgatttagttaacattggcagtactgacatagtggacgggaatcacaagctcacactcggcctgatctggaatatcattttgcactggcaggttaaaaacgtgatgaaaaatataatggcagggctgcagcagacaaactctgaaaagattctgctgtcttgggtaagacagagtaccaggaactatccccaggttaatgtcattaattttactactagttggtctgatggcctggccttaaacgctctcatacactcccaccgacctgatttgtttgattggaacagtgtggtttgccagcagagcgccacccaacggcttgagcacgcatttaatatagcacgttatcagctcggaatcgaaaagcttctggacccagaggatgtagacaccacataccccgacaaaaagagcattttgatgtacatcacctcattattccaggttctgccacagcaagtctcgattgaagccatccaagaagttgagatgttgccgaggcctcccaaggtgacaaaagaagaacatttccaattacaccaccagatgcattactctcagcagattaccgtgtctttagcgcaggggtatgagagaacctcaagtcccaagccacgatttaagtcatacgcatatactcaagctgcctatgttaccacgagtgatcccactaggtctccctttccctctcagcacctggaagcccctgaggacaagtcgttcggctcttcgctcatggaaagcgaagtgaacttagatcgatatcagacggctctagaggaggtgctgtcctggcttctttcggccgaggatacactccaggcgcagggagaaatcagcaacgatgtagaggtggttaaagatcagttccatacacacgagggctatatgatggacctgactgcccatcagggccgcgttggcaacattctacagctggggtccaagctcatcggaaccggcaagctgtccgaagatgaggaaacagaggtgcaggaacagatgaatctgctcaattcacggtgggagtgcctgcgagtggcctcgatggaaaagcagagcaacctccaccgagaaatctcttacgtgccgtcaacttacctcacagaaatcacacacgtcagccaggctctactcgaggtggaacagctgttgaatgcccccgacctctgtgccaaagattttgaggacctgttcaagcaggaggagagtttaaaaaacatcaaggactctcttcaacagtcctccggaagaattgatatcatccacagtaagaaaacagcggctctccagtccgctactccagtagagagagtgaaacttcaggaggcactctctcagctagattttcagtgggagaaggtgaataagatgtacaaggaccgccagggcagattcgaccgcagcgtcgaaaagtggcggcgattccactatgacataaagatcttcaatcagtggttgactgaagcagagcaatttctgagaaagacgcagatcccagaaaactgggagcacgctaagtacaagtggtatcttaaggaattacaggacggcatcggccagcgacagactgtcgtgcgaacattgaacgctaccggtgaagagattatacagcagtcaagcaagaccgacgcgtccattctgcaggagaagctgggcagccttaacttgaggtggcaggaggtctgcaagcaactgagcgataggaaaaagcgcctggaagagaccctggaaagactacaggagcttcaggaggccacagacgaattagacctcaagctgcggcaggcagaagttattaagggatcctggcagcctgttggagacctactgatcgattctttgcaggaccatctagagaaggtcaaagcgctgcggggtgagatagcacctctgaaggagaatgtgtctcatgttaatgatctggccagacagctcacaaccctgggaatacaactgtccccttacaacctcagtactttggaggatttgaatacccgatggaaactgttacaggtagccgtggaggaccgggtaagacagctgcacgaggcacatagggactttgggcctgcctcccagcacttcctgtcgaccagcgtccagggaccctgggagcgggctatcagcccaaacaaggttccttactatatcaaccacgagacccaaaccacatgttgggatcatccaaagatgacagagctgtaccaaagcttggcggatctaaacaacgtccgattcagcgcctatcgcaccgccatgaaattacgtcgcctgcagaaggccctgtgcctcgacctgctatccctttccgccgcttgcgatgccctcgaccagcacaatttaaagcaaaacgaccagccaatggacattctccagatcattaattgcttaaccacaatctacgaccgcctggagcaagagcataataacttggtgaacgtccctctttgtgtggacatgtgtctgaattggttacttaatgtgtacgacaccggtaggaccgggaggatcagggtgctgtcttttaaaaccggaatcatttcactgtgcaaggcccacctggaggacaagtatcgatacttgtttaagcaggtagcatccagtactgggttttgtgaccaaaggagattgggcctgctgctacacgatagcatccagattccgaggcagctaggagaagttgcttcatttggcgggagtaatatcgagccctccgtgcggagctgcttccaattcgctaacaacaagccggagattgaggctgcgctcttcttagactggatgaggctggaacctcagtcgatggtgtggctccccgtgctgcaccgcgttgccgcagccgagactgccaagcaccaggccaagtgtaatatctgcaaggaatgcccgatcattggctttcgctatcggagcctaaaacatttcaattatgatatttgtcagtcatgttttttctcaggtcgtgtggcgaaggggcacaagatgcattaccccatggtcgagtattgcactcccactacctccggggaagatgtgcgggatttcgcgaaagttctcaaaaacaagtttaggaccaagcgatactttgctaagcatcccaggatgggctatctgccggtgcagactgtgctggaaggggacaacatggagactgataccatg

SEQ ID NO: 251347 - DNA, 3432 bp, Artificial Sequence
  Description of Artificial Sequence: Synthetic coding sequence
atgctgtggtgggaagaggtcgaagactgttacgagcgcgaggacgtacagaagaagactttcactaagtgggtgaacgcccagtttagcaaattcgggaagcagcatattgagaacctgttcagtgatctgcaggacggacggcgcctgctagatctgctggaggggttgacagggcagaaactgccaaaggaaaaagggtccacacgagtgcatgccctcaacaacgtcaataaagcgcttcgggtgcttcagaataataatgtagacctcgttaatataggctcgaccgatatagtggacgggaatcacaaactgacactgggcttgatctggaacattatcctccactggcaggtgaagaacgtgatgaagaatatcatggcagggcttcagcagacgaactcagagaagattctcctttcctgggtcagacagagcacacgaaattatccacaggtgaatgttatcaatttcactacgagctggagcgatggactggctttaaatgcactgatacacagtcaccgaccagacctgtttgattggaactccgtggtgtgtcaacagtctgccacccagagactagagcacgccttcaatatagcccgatatcaacttggaattgagaaactcctcgatcctgaagacgttgacacaacttacccggacaagaagagtatactgatgtatatcaccagtctgttccaggttctgccacagcaagtcagcattgaggctatccaggaagtcgaaatgctgccacgccctccgaaagttaccaaagaggaacactttcaactccatcaccaaatgcactatagccagcagatcaccgtctctctcgcgcaagggtatgaaagaacctcctcccctaagcctaggtttaagtcctatgcttatacacaggctgcatacgtcactacttctgacccaacccgctcaccctttccctcccagcacttggaggcacccgaggacaagagctttggatcctccctgatggagtcagaagtcaatctggatcgttatcagacagccctagaagaggttttgtcatggttgctctcggctgaggatacactacaagcccagggtgagatcagcaacgatgtggaagtcgtcaaagaccagttccacacccacgaggggtatatgatggacctgactgctcaccagggtagagtggggaatattctgcagttagggtctaagctaataggcactggcaagctgtccgaagacgaggagaccgaggtgcaagaacagatgaatttattgaactcccggtgggagtgcctgcgggtggcatcgatggagaaacaatctaacctgcatcgtgaaatttcctatgtaccctcaacttatctcactgagattacccacgttagtcaagctctactcgaggtagagcagctgctgaacgctcccgacctgtgcgccaaggactttgaggaccttttcaagcaggaagaaagcctgaaaaacattaaggacagcctacagcagagcagcggcaggatagacattattcactccaaaaaaaccgcggcactgcagtccgcaacgcctgttgagcgagttaaattgcaagaggcactctcacagctcgatttccaatgggagaaggtcaataagatgtataaagataggcagggacggtttgataggagcgtggaaaaatggcggaggtttcattatgacatcaagattttcaaccagtggctaacagaagctgagcagtttctcaggaagactcaaattccggaaaactgggagcatgccaagtacaagtggtacctcaaggagctccaagacggtattggccagcggcaaacagtggtacggaccctgaacgcaactggcgaagaaatcattcagcaatcctctaaaaccgacgctagcatcctgcaggagaagctggggagcctgaatttgagatggcaggaggtttgcaaacagcttagtgaccggaagaagcggctcgaggagaccctagagcgactccaagaacttcaagaggcaaccgatgagcttgacttgaagctccgtcaagcagaggtcataaaaggttcttggcagcctgtaggtgacttgctaatagatagcctgcaggatcacttggaaaaggtcaaagcactacgtggggagatcgctccattgaaagagaacgtctctcatgtgaacgatctcgcaaggcagctcactacattgggaatacaattaagcccttacaacctcagcacactggaggacctgaatactagatggaagcttctccaggtcgcagtcgaagatcgtgttcgccagctgcacgaggcacacagggactttgggcctgcttcccaacacttcctgtcaacctccgtgcaggggccctgggaacgcgcgatctcccctaataaggtaccttactatattaaccacgaaacccagactacatgctgggaccaccccaaaatgaccgaactgtaccagtccctggctgacctgaataacgtgcgattcagtgcttaccgcaccgctatgaaattgcgcaggctccagaaggcactgtgtctggaccttctctccctgtccgccgcttgcgacgcactcgatcagcacaatctgaagcaaaatgaccagcccatggacatattacagatcattaattgtctcaccactatctatgacagattggagcaggaacataacaaccttgtgaatgttcctctttgcgttgatatgtgtctgaattggttgctgaatgtgtacgataccgggaggacagggcgcatacgggtgttatcatttaagaccggtatcatcagcttatgcaaggcccacctggaagataagtatcgttacctttttaagcaggtcgcctcctctaccggattctgcgatcagaggcggctgggtctgctgttgcacgatagtattcagattccacgccaattaggagaagtcgccagcttcggcgggtcgaacatcgagccatcggtgcggtcatgtttccagttcgcaaacaacaagccagaaatcgaggccgctctgttcttggattggatgcgattagagccacagagtatggtttggctcccagttttacatcgcgtggctgctgcagagactgcaaaacatcaagccaagtgtaacatttgcaaggagtgtcccataataggcttccgataccgcagtctcaaacacttcaactacgacatctgtcaatcctgttttttctcaggtcgcgtggctaaggggcacaagatgcactaccctatggtcgagtattgcacacctaccacttcaggggaggacgtcagggattttgctaaagtgcttaagaacaaatttaggacaaaacgttattttgccaagcatccgaggatggggtacctcccagttcaaactgtgctagagggtgacaacatggagacggacactatg

SEQ ID NO: 251348 - DNA, 3432 bp, Artificial Sequence
  Description of Artificial Sequence: Synthetic coding sequence
atgctttggtgggaagaagtggaggattgctatgagcgtgaggatgtccaaaagaaaacattcaccaaatgggtcaatgctcaattctctaaatttggaaagcagcacatcgagaaccttttctctgatctccaggatggcaggagattactggacctcctggaggggctgacgggccagaaactgccgaaggagaagggaagcacgcgagtgcatgcacttaacaacgtcaacaaggcacttcgtgtattgcagaacaacaacgtggatcttgtgaatattggctctactgatatcgtggatggaaatcataagttgaccctgggcctgatttggaacattatactacattggcaggtgaagaatgtgatgaagaacatcatggcggggctccaacagaccaactcagagaaaattctgctgagctgggtgaggcagtccactcggaactatccccaggtgaacgtgatcaactttaccacaagctggtcagatggactggcactcaatgccctcattcattcccacagaccggacctcttcgattggaactccgtcgtgtgccagcagtctgcaactcaacgcctggagcatgcctttaacatcgcgcggtatcagctgggaatcgaaaagctgctagacccagaggacgtggatacaacatatcctgataagaagtccatcttaatgtacatcacaagccttttccaagtactcccacaacaggtatcaatcgaagccattcaggaagtggagatgctccctcgcccacccaaggtgacaaaggaagaacactttcagctacatcatcagatgcattattcccagcaaataactgtgtcactggctcaaggatatgagcgaacatcaagtcccaaaccacgttttaagtcctacgcatatactcaggctgcgtacgtgacaacgtctgatccaactagatcgccgttccccagtcaacacttggaggcacccgaagacaagagcttcggatcctccttaatggagtcagaggtgaatctggaccgataccaaacagcactggaagaggtgctatcctggctactgtccgccgaagatacattgcaggcacagggggaaatttccaacgacgttgaagtcgtgaaagatcagtttcacacacacgagggctacatgatggaccttacagcgcatcaaggacgagtcgggaacatcctgcaactgggctctaagctgatcggaactggaaagttatcagaggatgaggaaaccgaagtacaggagcagatgaatctgctgaactctaggtgggagtgtctgcgagttgcatcaatggagaagcagtctaatctgcacagagagattagttacgtcccctccacttacttgaccgaaatcactcatgtttcccaggctctgttggaagtggagcagcttctaaatgcaccagatctgtgtgctaaggacttcgaggatcttttcaaacaagaagagtccctgaagaatataaaggactctcttcagcagtcttcagggagaatcgatatcatccactctaagaagacagctgccttacagtctgctactcctgtggagagggtgaagcttcaagaggccctttcccagcttgatttccaatgggagaaagtgaacaagatgtacaaagataggcagggccggttcgaccgcagcgtggaaaaatggagacggttccattacgatattaagattttcaatcaatggctcactgaggccgagcagtttctccgcaagacacaaataccagaaaattgggagcatgctaagtataaatggtatctaaaagagctgcaggatggcatagggcagcgacaaactgtggtgcggacactgaacgctaccggcgaagagattattcagcagtccagtaagactgacgcgagcattctgcaggaaaaattaggttcattgaatctacggtggcaggaggtttgtaagcaactgagcgataggaaaaaacgcctcgaagaaactctggaacggttacaggagctccaggaagccacagacgagttggatctcaagcttcgtcaggctgaggtcattaagggcagctggcagcccgttggcgatctgctgatcgattccctgcaggaccacctagaaaaagtgaaggcactgagaggagaaatcgctcccctgaaggagaacgttagtcatgtgaacgacctcgctcggcagctgaccactttagggatccagctatccccatataatctgtctacactggaagatctgaacactcgatggaagctgctgcaggtcgcggttgaggaccgggtaaggcagttgcatgaggcacacagggacttcggccctgctagtcagcacttcttaagcacaagcgtccaaggcccatgggagagagccattagtccaaataaggtcccctattatatcaaccacgaaacccaaacgacttgttgggaccacccaaaaatgaccgagctgtaccagtcacttgctgaccttaacaatgtgcggttcagcgcatatcgaacagccatgaaattgcggagattgcaaaaggcgctctgcctggaccttttaagcctaagtgcagcttgtgacgcactggatcagcacaatctgaagcagaatgaccagcccatggacatattgcagatcattaactgcctcactacaatttacgatcgcttggagcaagaacacaacaacctggtgaacgtgcccctctgcgtggacatgtgtctgaattggctactgaacgtgtatgatactggtagaacgggaaggattcgtgtcctctcattcaagactggtattatctccctgtgcaaagcccacctggaggataagtacaggtacctttttaaacaggttgcgtcttcaacgggattttgcgatcaaaggaggttggggctacttttgcatgatagtatccaaattccgcggcagctaggagaagtcgcctcattcggcggaagtaacattgagccttctgtccgcagctgcttccagtttgcaaacaacaaacctgagattgaggctgccctgttcttagattggatgcgcttagagccacaaagcatggtctggttgcccgttctgcatagagtggctgccgctgagactgcgaaacatcaggctaaatgcaacatttgcaaagagtgtcccattattggttttcgctatagatccctgaagcacttcaactacgatatctgtcaatcgtgttttttctctggacgggtggctaaagggcataagatgcactaccccatggttgagtattgcacaccgacaacatccggagaagatgtcagggattttgccaaagttctcaagaacaaatttcggacgaaacgctactttgccaaacatcccagaatgggttacctgccggtgcagaccgtactggagggcgataacatggaaaccgacacaatg

SEQ ID NO: 251349 - DNA, 3432 bp, Artificial Sequence
  Description of Artificial Sequence: Synthetic coding sequence
atgttgtggtgggaggaggtcgaagactgctacgagagggaggatgtacaaaaaaaaacatttactaagtgggttaacgcacagttctctaagttcggaaagcagcatatcgagaatctgttttcagatctgcaggatggcagaaggcttttggatctcctggaggggcttacggggcaaaagcttccaaaggagaaggggtcaacgcgggtccacgccttgaacaacgtgaacaaagcgctgcgggttctacaaaataataatgtcgatctcgtcaacatcggtagcactgacatcgtagatggcaaccacaagttgacactgggtctgatttggaacattatcctgcactggcaggtcaagaacgtaatgaagaatatcatggccggcttgcagcagacaaatagtgaaaagatcctgttgagctgggttcggcagagtacgcgtaattatccacaagtcaacgttattaactttactacaagctggtccgacgggttagccctcaatgccctcatccattcacaccgacctgacctctttgattggaactctgttgtctgtcagcaatctgcaactcagaggctggaacacgcattcaacatcgcccggtaccagctcggcatcgagaaactgctggacccagaggatgtcgataccacttatcccgacaagaagtctatattaatgtacatcacgtccctgtttcaggttctgcctcagcaagtgagcattgaagccatacaggaggtggaaatgttgccaaggcctcccaaagttacgaaggaagagcatttccagttgcaccaccagatgcattactcccaacagatcaccgtctctctggcgcagggatatgaaagaacttcatctccgaaacctagatttaaaagctatgcctacacacaggcagcctatgtcacaactagcgaccccaccagaagtcctttcccttcccaacacttggaggctcccgaagataaatccttcggctcttccttgatggagtccgaagtgaacctcgaccgctaccagacggcactggaggaagtcctgtcctggctgctcagcgcggaggacactctgcaagcccagggcgagatcagcaacgatgtggaggttgtcaaggatcagttccacacccatgaggggtacatgatggatctgacagctcaccagggaagggtgggaaatatcctgcagcttggatcaaagcttattggcactggcaagctatccgaggatgaagagaccgaggtacaggaacaaatgaacctgctcaatagcaggtgggaatgtctgagagtggcttcaatggaaaaacagagtaacttacatagagagatctcttacgtgccgtcgacatatctgactgagattacccacgtctctcaggccctgctggaagttgagcagctattgaacgcccccgacttgtgtgccaaggattttgaggatctgttcaaacaggaagagtctctcaagaacatcaaggactccctccaacaatcttccggccgaatcgatatcatccactctaaaaagaccgccgccctgcaaagcgccacccctgtggagagagtcaagctgcaggaagccttgagtcagctcgatttccaatgggaaaaggtgaacaagatgtacaaagaccgacaagggcggttcgacagatccgtggagaaatggaggcgcttccactacgacatcaaaatcttcaatcagtggcttactgaagccgaacagtttctacgcaagacacaaattcctgaaaattgggaacatgccaagtacaaatggtacctgaaggaactccaagatggcattgggcagaggcaaacggtggtgagaaccctcaacgcaactggcgaggagatcattcagcaatcctctaagacggacgcttccatcctgcaggaaaagttggggtccttaaaccttcgttggcaggaggtttgtaagcagctcagcgaccgaaaaaagcggctcgaggagaccctggagaggctgcaggaactccaagaggcaaccgatgagctggacctcaagctgcggcaggctgaggtcattaaagggtcgtggcagcccgtaggggacttacttatcgactctctgcaggaccacctggaaaaggtgaaggctttgcggggagagattgcccccctgaaggagaacgttagccatgtgaacgacctggcaagacaactgacaactctcgggatacagttatcgccttacaatttatccactctcgaggacctgaacacccggtggaagctgctgcaggtggcggtggaagaccgtgtaaggcagctgcatgaggctcaccgggattttgggcccgcttcccagcacttcctgagtacaagcgtgcaggggccctgggagcgagctatttcacctaataaggtgccctactatatcaaccacgagacccagaccacctgctgggatcaccccaagatgactgaattgtaccagtcccttgctgatcttaacaacgtgcgcttctctgcctaccggacagccatgaagttacggagactgcagaaagcactgtgcctggatctgctttctctgagcgcagcgtgcgatgcactggatcagcataatctcaaacagaacgaccagccgatggatattcttcagatcattaattgccttaccaccatctacgacaggctggaacaggagcataataatttggtgaatgtgccactgtgcgtcgacatgtgcctgaactggctccttaatgtctacgacacaggccgcacagggcggattcgggtcctgtcatttaagaccggcattatttctctctgcaaggcccacttggaggacaagtatcgttatctgttcaagcaggtggcaagctctaccggattttgcgaccagcgccggctggggctcctgttacacgactctatacaaattccacgacagctgggagaggttgccagcttcgggggaagcaacatcgaaccatccgtgcgttcttgttttcagttcgccaacaacaagcccgaaatcgaggccgccttgttccttgactggatgcgcctcgagccacagtccatggtgtggctgccggtgctgcatcgagtagctgccgcggaaaccgccaagcaccaggcgaaatgcaatatatgcaaggaatgcccaattattggattcaggtatcgctcccttaaacattttaactacgatatatgccagtcttgcttcttttcagggcgagtcgcaaaagggcataagatgcactatccaatggtggaatactgtacacccaccacaagtggggaggatgtccgggacttcgccaaagtgttaaagaataaatttcgaaccaagaggtactttgctaagcacccaaggatgggttacttgccagtacagaccgtccttgagggcgacaacatggagaccgacactatg

SEQ ID NO: 251350 - DNA, 3432 bp, Artificial Sequence
  Description of Artificial Sequence: Synthetic coding sequence
atgctgtggtgggaggaggtggaagattgctatgaacgagaagatgtccagaaaaagaccttcaccaaatgggttaatgcccagttctctaaatttggcaaacagcatatcgaaaacctgtttagtgacttgcaggatggccggcggctcctggatctgctcgaaggattaaccgggcagaaactgcccaaggaaaagggcagtacccgagtccatgccctgaacaacgtgaacaaggcactgcgggtgctgcagaacaataacgtagacctggttaatataggtagcaccgatattgtggacggaaatcacaagctaaccttggggctcatttggaatattatactgcattggcaggtcaagaacgtgatgaaaaatattatggccggactgcaacagaccaactccgaaaagatactgctgagttgggttaggcagtccactagaaattaccctcaggtgaatgttattaacttcactacaagttggtctgatgggcttgccctgaacgccctcatacacagccatagacctgatctgttcgattggaacagcgtggtgtgccagcagtccgcaactcagagactagagcacgcttttaacatagcaaggtatcagctgggtatcgagaaattgctggatcccgaggacgtggacactacataccccgataagaaaagcattctgatgtatattacctctctgttccaagtgctccctcagcaagtcagcattgaggctatacaggaggtggagatgcttccccgtcctcctaaggttaccaaagaagaacattttcagctgcaccaccagatgcattatagccagcagattactgttagtctggcccagggatacgagcggacctcctcaccaaaacctcgctttaaatcttacgcatatacccaggctgcctatgtgaccactagcgatcccactagatcccctttccctagccagcacctggaagctcctgaagacaagagttttggttccagtttaatggagtcagaggtgaacctagataggtatcagaccgcactggaggaagtgctgtcctggctcttaagtgccgaagacactctgcaggcccagggagagatttctaatgacgtggaggtcgtgaaggaccaatttcatacccatgagggctatatgatggacttaaccgcccatcagggacgggtgggcaatatcctgcagctggggtctaagctgattggaaccggcaaactctccgaagatgaagagactgaggtgcaagagcaaatgaacctactcaacagtaggtgggagtgcctgagggttgcctccatggaaaaacagagcaacctgcacagagagatctcctacgttccctctacctacctgactgagattacccacgttagtcaggccctgttagaagtggagcagctcttaaacgcccctgacctctgtgcaaaagatttcgaagatctgttcaagcaggaagagagtctgaagaacataaaggattctctgcagcagtccagcgggaggatagacataattcacagcaagaagacagcagccctccagtctgcaactcctgtggagcgggtgaaactgcaggaagccctgagccagctggacttccaatgggagaaggttaataaaatgtacaaagaccgtcagggaagattcgacagaagcgtggagaagtggcgaagatttcattatgacataaagatttttaaccagtggctaaccgaggcagagcagtttctgcgaaaaacacagatcccagagaactgggagcacgcaaagtacaaatggtatctaaaagaacttcaagatggaataggccagcggcagaccgttgtgcgtactttaaatgccaccggcgaagaaatcattcaacagtctagcaaaaccgacgcctccatactacaggagaaattgggatctctgaatctacgatggcaggaggtgtgcaaacagctatccgacagaaagaaaaggctggaagagacacttgagagactgcaggagctgcaggaggccacagacgagttagatctcaaactgagacaggctgaagttataaaaggctcttggcagcccgtgggagacctgctgatagattctctgcaggatcatctggagaaagtgaaggccctgcggggcgaaattgcaccactgaaagagaacgtcagccacgtgaatgacctggctcgccagctgactaccctcggcatccaactctcaccatacaacctgtctacattagaagatctgaatactaggtggaagctgctgcaggtggcagtggaagatcgcgtaagacagctgcacgaggctcacagagattttgggccagcctctcagcactttctcagtacatctgtgcaaggcccgtgggagcgggctataagccctaacaaggtgccttattacattaatcatgagacccagacaacatgttgggaccatcctaagatgaccgaactatatcaaagtctggccgatctgaataacgttcgctttagcgcttatcgcaccgcaatgaagctgcgtcggctccagaaggctctatgtctggatctgctgagtctaagtgcagcctgcgacgctctcgaccagcacaacctgaagcagaacgaccaaccaatggacatattgcaaatcatcaattgtctgacaacaatttatgatagactggaacaggagcacaataatctggtgaacgttcctctgtgtgtagacatgtgtttgaattggctcctgaatgtctacgacactggtcggaccggcaggatcagggttctatcctttaaaactggcattatttctttatgtaaagcacacctcgaggataaatacaggtacttattcaaacaagtggcaagtagcacagggttctgtgaccaacgtcggttaggcctgctactacatgattcaattcaaattcctaggcagttgggggaagttgcttcttttggaggctcaaacattgagccaagtgtccgcagctgctttcagtttgctaacaataagcctgaaatcgaggccgctttatttctggactggatgcggctggagccccaatccatggtgtggctgcctgtcctgcatagagtggccgccgctgagaccgcaaaacaccaagccaagtgcaatatctgcaaagaatgccctataatcggctttaggtacagaagcttaaaacactttaactatgacatttgccaatcatgttttttctccgggagggtggccaaaggccacaagatgcactacccaatggtggaatactgtaccccaaccaccagtggtgaggatgtgagagacttcgcaaaggtgctgaagaacaaattcagaactaaacggtatttcgcaaagcaccctcgaatgggctatctgcctgtacaaactgttctggaaggagacaatatggagaccgacaccatg

SEQ ID NO: 251351 - DNA, 3432 bp, Artificial Sequence
  Description of Artificial Sequence: Synthetic coding sequence
atgttgtggtgggaagaagtagaagactgttatgagcgggaagatgttcaaaagaaaacatttaccaaatgggtcaacgctcagtttagcaagttcggcaaacaacacatcgaaaacctgttttctgatttacaagatggtagacgccttcttgacttattagaaggcctgacaggacagaaacttcctaaggagaaagggtcaacaagagtccacgcgttaaataacgttaacaaggctctacgcgtactacagaataataacgttgatcttgtgaatattggcagtacggacattgttgatggtaatcataaactgaccttaggcctgatatggaatatcattttgcactggcaagtgaaaaacgtaatgaaaaacataatggcaggtttacaacaaacaaactcagaaaagatcctgctgtcatgggtccggcagagcacacgcaactatcctcaagtaaacgtaattaatttcacgacaagctggtctgatggactcgctctgaatgctctgattcactctcacagaccggatctgtttgactggaacagcgtagtgtgccaacagagtgctacgcaaagactcgagcacgcatttaatattgcgagatatcaattgggcattgaaaaacttcttgatcctgaagatgtggataccacatatccggacaaaaaaagcattcttatgtatatcacatcactttttcaagtgttaccgcagcaggtttctattgaggcgatacaggaagttgagatgttgcctagacctccgaaagtgacaaaagaagaacattttcaactgcatcaccaaatgcactactctcagcaaataacggtatcgttagctcagggttacgaaagaacttcttcgccgaaaccgagattcaagtcctatgcctatacacaggctgcgtatgttactacctcagaccctacacgtagtccgttccctagccagcacctggaagccccggaagacaaatcgtttggcagtagtctgatggaaagcgaggtcaatttggatcgctatcaaaccgcgctggaagaggtattgtcttggttattgagcgccgaagataccttgcaggctcaaggagagatatcaaatgatgtggaggtcgttaaagatcagtttcacacgcacgaaggctatatgatggacctgactgctcatcaaggacgagttgggaatattttacaacttggaagcaagttgatcggaactggaaagctgtctgaggatgaagagacggaagttcaggaacagatgaatttattgaactctagatgggaatgcctgcgcgttgcaagcatggagaagcagtctaatctccatcgcgaaattagctacgtaccatcaacttacttgactgagattacccacgtgtctcaagctttattagaagtggagcaattacttaatgctcctgacttatgtgcgaaagactttgaagatctgtttaaacaagaagagtctttgaaaaacatcaaggatagcttgcagcaatcatcgggacgtatagatataatacactctaaaaagactgctgccttacagagtgcaacccctgttgagagagtgaagctgcaggaagctctctcccaattagattttcaatgggaaaaagtgaataagatgtacaaggatcgccaaggccgattcgataggtcagtcgaaaaatggcggcggtttcactatgatattaagatctttaaccaatggctgacagaagccgaacaatttcttcggaaaactcaaattccggaaaattgggaacatgcgaagtataagtggtaccttaaggaacttcaagacggaatcggacaaaggcagacagtagtcaggacactcaacgctactggcgaagaaataatacagcagtcatcaaaaacagatgcatcaatccttcaggagaagcttggttcacttaacctgaggtggcaggaagtgtgcaagcaacttagtgatcgtaaaaagcgcttggaggaaacactcgaacgcttgcaggaattgcaggaggcaacggatgagttggatctgaaactgagacaagcagaagttatcaagggatcttggcagcctgttggtgatcttctgattgattcgctccaagaccatcttgaaaaggtcaaagcactgcgtggtgaaatagcccccctcaaagaaaacgttagtcatgtcaacgatcttgcgcgccaattgacaactttgggcattcagttgtcaccgtacaatcttagcacattggaagatctgaacactcgatggaaattactgcaagtggcggtcgaggatcgtgtcagacaactgcatgaagcacatcgtgactttgggccggcgtcacaacattttctttcaacttccgtccaaggtccgtgggaaagagccatttctccgaacaaagtaccgtactacatcaaccatgaaacccagacaacgtgctgggaccatcctaaaatgacagaactgtatcaatcacttgccgatctgaataatgttcgattttcagcctatcgtacagcaatgaaattgcgcaggctacagaaagcactgtgcctggatctattatctttgagtgcagcctgcgatgcgctagatcaacataatctgaagcagaatgatcaaccgatggatattctgcaaattattaattgcctcacgacgatctatgatcgtttagagcaagaacacaataacctcgtgaatgtcccactctgcgtcgatatgtgcctgaactggctgctgaacgtctatgatacgggcagaacgggacggattcgcgttttatcttttaaaacaggaattatttcgctttgcaaggcacatttagaggataaatatagatatctctttaagcaagtggcatcttcgactggattttgtgatcaaagacgtctgggtttgctcttgcatgactccatacagattccgcgccaactcggggaagtcgcaagctttggtggatcaaacatagaaccaagcgtccgttcctgctttcaatttgcaaataacaaacctgaaattgaagcggctttgtttctggactggatgcgtctagagcctcagagcatggtttggcttccagtattacaccgggtcgctgctgccgagaccgcaaaacaccaggctaagtgtaacatatgtaaggaatgcccgattattggtttccgttatcggagccttaaacactttaactatgatatctgtcaaagctgctttttttccggtcgcgtagcaaagggtcataaaatgcattatcccatggtcgagtactgtaccccaaccacgtctggggaggacgtccgcgattttgcaaaagtcctgaaaaataaattccgcacaaaacgctattttgcgaagcatccgagaatgggctatcttccagttcaaacagtgttagagggtgacaatatggaaacagacacgatg

SEQ ID NO: 251352 - DNA, 3432 bp, Artificial Sequence
  Description of Artificial Sequence: Synthetic coding sequence
atgctgtggtgggaagaggtcgaggattgctacgagcgcgaggatgtccagaaaaagaccttcactaagtgggtgaatgcgcagtttagcaaatttggaaaacagcacatcgagaaccttttctcagaccttcaggacggacgtcgcctgctcgacctcctcgagggtcttacgggtcagaagctgcctaaggagaaaggatccactcgagttcacgccctgaacaatgtgaacaaggcgctgagggtcctccaaaacaacaatgtggacctggttaacataggaagcaccgacatagtcgacggcaatcacaagctgactcttggattgatctggaacattatccttcactggcaagtcaaaaacgtgatgaagaacatcatggcgggactgcaacagactaatagcgaaaagatcttgctgtcgtgggtgcgccaatcgacgagaaattacccgcaagtgaacgttatcaacttcacgacgtcctggtccgatggcctcgccctgaatgcgctgatccattcccatcggcctgatttgtttgattggaatagcgtggtgtgtcagcagtcggccacccagagactggagcatgccttcaatattgcgagatatcaactggggatcgaaaagctcctggacccggaggacgtcgataccacttacccagataagaagtcgatccttatgtacatcacgtcgctgttccaggttctgccgcagcaagtgtcgatcgaagcgatccaagaggtcgagatgctcccacggcctccaaaggtgactaaagaagaacatttccagctgcaccaccaaatgcactactcccaacagatcaccgtgtccctggctcaaggctatgaaagaacctcctcgccaaagcctcggttcaaatcatacgcctatactcaggccgcctacgtgaccacttccgaccccacccgctccccgtttccgtctcagcacctggaagctccggaggataagtcattcggctcaagcctcatggagtcggaggtgaacctggatcgctaccagaccgctctggaggaggtgctgtcgtggctgttgagcgccgaagataccctgcaagcccagggcgagatctctaatgacgtggaggtcgtgaaggaccagtttcacacccatgagggatacatgatggacttgaccgcgcatcagggacgcgtggggaacatcttgcagttgggcagcaaactcattggaacgggaaaacttagcgaggatgaagaaaccgaagtccaagaacaaatgaatctcctgaattccaggtgggaatgtctgcgcgtggctagcatggagaagcagtcgaacctgcaccgcgagatctcgtacgtgccctcgacctatcttactgagattacccatgtctcacaggctctgctggaagtggaacaactcctcaatgcgccggacttgtgcgctaaggacttcgaagatctctttaaacaggaagagtcgctcaaaaacatcaaggacagtctccagcaatcgagcgggcggatcgatatcatccactcaaaaaagacggcggctctccagtccgcaactccggtggaacgcgtcaaattgcaagaggcactgtcgcaactggacttccaatgggaaaaagtgaataagatgtacaaggacagacaggggcgcttcgatcgctccgttgaaaaatggcggcgcttccactacgacatcaagattttcaaccagtggctcaccgaggcagagcagttcctgcgtaagacccaaatccccgagaattgggagcacgcaaagtataagtggtacttgaaagaactccaagacggcatcggccagcgccagaccgtggtgaggactctgaacgcgaccggcgaagaaatcattcaacagagctctaagactgacgcgtccatccttcaggagaagctggggtcactgaacctgcggtggcaggaagtgtgcaagcaactgtcagaccggaagaaaagactggaggaaacgctggagcggcttcaagaattgcaagaagccaccgacgagcttgatctgaagctgcggcaggcagaggtgatcaagggatcatggcagccggtgggagatctgctcattgactcgctccaggatcacctcgagaaagtgaaagcgcttcgaggggagatcgcgcctttgaaggagaacgtgtcacacgtgaacgatctggcccgacagcttactactttgggaatccagctgtcaccctacaacctgtcaactctcgaagatctgaatactagatggaaacttttgcaagtggcggtcgaggaccgcgtccggcagctgcacgaagcgcacagagacttcgggccggcgtcgcagcattttctctccaccagtgtccaaggtccgtgggaacgcgccatctcgccgaataaagttccttattacatcaaccacgagactcagactacgtgctgggatcacccgaaaatgactgaactttaccaatcgcttgccgacttgaataatgtccgcttttcagcgtaccggactgcaatgaagctgcgcagactgcagaaggccctctgcctggacctgctgtcgctgtcggccgcttgtgatgcgctcgaccaacataatcttaaacagaatgatcagccaatggacatcctgcaaatcatcaactgcctgactactatttacgatagactggagcaagagcacaacaacttggtgaacgtgccactctgtgtcgacatgtgcctcaactggctgctgaacgtgtacgataccggtcgcaccggtaggatccgcgtgctcagcttcaagactgggatcatctcgctgtgcaaagcgcacctcgaggacaagtacagatatctcttcaagcaggtggcatcctcgaccggattctgtgatcaacgtagactgggactgctcctgcacgattctattcaaattccacggcagctcggagaagtggccagcttcggaggctccaacatcgagccgtcagtgcggtcgtgtttccagttcgccaacaacaagccggaaatcgaagccgcactctttctcgattggatgcggctggaaccacagtcgatggtgtggctccctgtgctgcacagagtggcggccgctgagactgctaagcatcaagccaaatgcaacatttgcaaagagtgcccgatcatcgggtttcggtaccggtcgctcaaacatttcaactacgacatctgccagtcgtgcttcttttcgggtcgcgtggccaaaggacataagatgcattacccgatggtcgaatactgcactccaactacctccggtgaagatgtgcgcgatttcgcgaaggtgctcaagaataagttccggaccaagcggtacttcgccaaacacccaagaatgggatatctgccggtgcagacggtgctggagggagacaatatggagactgataccatg

SEQ ID NO: 251353 - DNA, 3432 bp, Artificial Sequence
  Description of Artificial Sequence: Synthetic coding sequence
atgctctggtgggaagaagtggaagattgttacgagcgcgaagatgtgcagaagaaaacgttcaccaagtgggtgaatgctcagttctctaagttcggtaagcaacacatagagaacctgttctcagacctgcaagatgggcgccggctgctggacctcctggagggattgacgggacagaaactgccgaaggaaaaggggagcaccagagtccacgcgctgaataacgtcaataaagcgttgcgggtgctccaaaacaacaacgtggacctggtgaatattggatcgactgacatcgtggacggaaaccataagctcaccctgggattgatttggaacattatcctgcactggcaggtgaagaatgtgatgaagaacattatggctggactccagcagaccaattcagagaaaatcctcctctcatgggtccgccagagcaccagaaattacccccaggtcaatgtcatcaactttaccacgtcgtggtcggacggactcgcattgaatgcgctcatccactcacatcggcccgatttgtttgactggaactcagtcgtctgtcagcagtcggcgacccagaggcttgaacacgcgttcaacatcgctagataccagctgggaatcgagaagctgctggatccggaggacgtcgacacgacctacccggacaagaaaagtatcctgatgtacattaccagcctcttccaggtgctgcctcagcaagtgtcaatcgaagcgatccaggaggtcgaaatgttgccgcgccctccaaaggtgactaaggaggagcatttccagctgcaccaccaaatgcactattcgcagcaaatcactgtgtcgctggcccagggctacgaacgcacctcctccccgaagccgaggtttaagtcctacgcctacacccaggccgcatacgtgaccacttcggacccgaccagatcgccgttcccaagccaacacttggaggcgccggaagataagtcgttcggtagctccctgatggagagcgaagtcaacctcgaccgctaccaaacggcacttgaggaggttctgtcgtggctgctttcggctgaggacaccctccaagcgcagggagagatcagcaacgacgtggaagtggtgaaagaccaattccacacccacgagggctacatgatggatctgactgcccaccaaggccgcgtgggcaacatcctgcagcttggatcaaagctgatcggcaccgggaagttgagcgaagatgaggagactgaagtccaggagcagatgaacttgctcaattccagatgggagtgcctccgcgtggcttcaatggagaagcagagcaacctgcatcgggaaatctcatacgtgccgtccacctacctcactgagattactcatgtgagccaggcgttgctcgaagtggaacagctgctgaacgccccggacctgtgtgcaaaagattttgaggacctgttcaagcaagaggaaagcctcaagaacatcaaagattcgctccaacagagttcgggtcgcatcgacatcatccattcgaaaaagacggcagcgctgcagtccgctactccggtggagagagtaaagctccaagaagcgctgtcgcagctggactttcagtgggaaaaggtgaacaagatgtacaaagatagacagggaagattcgatagaagcgtggaaaagtggaggaggttccattacgacatcaagattttcaaccaatggctgactgaggccgaacagtttctcagaaagactcagattcccgaaaattgggagcatgccaaatacaagtggtatctcaaggaattgcaagatggaatcggacaacggcagacggtcgtccggaccttgaacgccactggagaggaaatcatccagcaaagctcaaaaactgatgcctcgatcctccaggaaaaactcggcagcctcaacctccgctggcaggaagtgtgcaagcagctgtccgatcgcaaaaagagactggaagagacgctggaacggctgcaagagctgcaagaggctactgacgagctggatctgaagttgcggcaggcagaggtgatcaagggatcctggcaaccggtcggtgatctgctcatcgactccctccaagatcatctcgagaaggtcaaagccctgcggggggaaatcgcgccgctcaaggagaacgtgtcgcacgtcaacgacctggctcgccaacttaccactttgggtattcagctctcgccgtacaatctgtcgactctcgaggacctgaacaccaggtggaagttgctgcaggtcgccgtggaggaccgggttcgccagctgcatgaagctcatcgcgacttcggaccagcatcacaacatttcctttcaaccagcgtccaggggccgtgggagcgggcgatctcgccaaacaaggtgccctactacatcaatcacgagactcaaaccacgtgctgggaccacccgaagatgactgagctgtatcagtccctggccgacctgaacaacgtccggttctccgcatatcggactgccatgaagctgcggcggctgcaaaaggcgctgtgccttgatctgctgtcattgagcgccgcgtgtgatgcactcgaccagcataacctgaaacaaaacgatcagcctatggacatcctgcagatcatcaactgccttaccaccatctacgaccggctggagcaggaacacaacaatcttgtgaacgtccctctgtgcgttgatatgtgtctgaattggctgctcaatgtgtacgacaccgggagaactggccgcatccgggtgctctcgtttaagaccggaatcatctcactgtgcaaggcgcacctggaggacaagtatcggtacctgtttaagcaagtcgccagctcaaccggattctgcgaccagagacggttgggcctgctgctccacgatagcatccaaatcccacgtcaattgggagaagtggcgtcgttcggcggatccaacatagagccgtctgtaagaagctgcttccagttcgccaacaacaaaccggagatcgaagcggcgctgttcttggactggatgcgcctggagccgcagagcatggtctggctgccggtgctgcaccgcgtggcggccgcggaaacggccaaacaccaggccaagtgcaatatctgcaaagaatgcccaatcattggcttcaggtaccgaagtttgaagcatttcaattacgacatctgtcagtcgtgctttttctcaggacgcgtggcaaaaggacacaagatgcactacccgatggtggagtactgcaccccaaccacctcgggagaggacgtgcgagatttcgccaaggtcttgaaaaacaagtttcggactaagcggtacttcgcgaaacaccctcggatgggatacctccctgtgcaaaccgtcctggaaggagacaacatggaaaccgataccatg

SEQ ID NO: 251354 - DNA, 3432 bp, Artificial Sequence
  Description of Artificial Sequence: Synthetic coding sequence
atgctgtggtgggaagaggtggaggattgctacgagagagaggacgtccaaaagaagaccttcacaaagtgggtgaacgcgcagttctccaagtttggcaaacagcacatcgagaacttgtttagcgacctgcaagacggccgtaggctgctcgatctgttggagggcctgacaggccagaaacttcccaaggaaaagggctccacacgggtgcacgcgttgaacaatgttaacaaagctctcagagttcttcagaacaataatgttgatctcgttaatatcggttctacagacattgtagacggtaaccacaaactgaccttgggacttatttggaacattattctccactggcaggtgaagaacgtgatgaagaatatcatggctggcctgcagcagacaaattccgaaaaaatcttactgtcatgggtcaggcagtccaccagaaactaccctcaggtgaatgtaattaacttcactacctcgtggagcgacgggcttgcgctgaatgccctgattcactctcacaggcccgacctctttgactggaattcggtggtttgtcagcagagcgcaactcaacgactggaacacgcttttaacattgctagataccagctaggcatagagaagttgctcgaccctgaggacgtggacaccacatatcccgacaagaaaagtatattgatgtatattactagcctgtttcaggtactgccccagcaggtctccatcgaggcgatccaagaggttgaaatgctgcctagaccccccaaggtcacaaaggaggaacatttccagctccatcaccagatgcactacagccagcaaatcaccgtgagcttggctcaggggtacgagcggacctctagcccgaagcccagatttaaatcctacgcttatacccaggcagcttacgtgacaacttctgaccccacgcgcagtcctttcccatcccaacatcttgaggcaccggaagataagtcctttggcagttctctgatggagtctgaagttaatctcgatagatatcaaacagcactggaggaagtgctgtcgtggcttttatccgccgaagatacactgcaagcccagggagagattagtaatgatgtggaagttgtgaaggaccagtttcacacacatgagggatacatgatggacctcaccgctcatcaggggcgagtcgggaatattttacagctggggtccaagctgatcggtaccgggaagttatctgaggacgaagagaccgaagtccaagagcagatgaatttactgaactcaaggtgggagtgtctaagggtagcctccatggaaaagcaatcaaacctacacagagagatctcttacgtgccgagtacttatctgaccgaaataactcacgtttcacaggccctgctggaggtcgagcagctgctgaatgctcccgacctgtgcgccaaggacttcgaggacctgttcaagcaggaagagtccctgaagaatattaaggatagcctccagcagtccagcggccgcattgatatcattcacagcaaaaaaaccgctgcccttcaatcagctactcccgtggagcgagttaagctccaggaggcactaagtcagctggacttccaatgggagaaggtgaacaagatgtataaagacagacagggcagattcgataggtctgtcgagaagtggaggaggtttcactatgacatcaaaatcttcaaccagtggttgaccgaggctgagcagtttctgcggaaaacccagattccagagaactgggaacatgctaagtataaatggtaccttaaggagcttcaagatggcattggtcaacggcaaaccgtggtgcgtaccttgaacgctaccggtgaagaaatcatccaacaatcctccaaaaccgacgcaagtattcttcaggaaaagttaggcagcctgaacctgcgttggcaggaggtctgcaagcaactatcagaccgaaaaaaaaggctggaagagactctcgagagactacaggaactgcaggaggccactgacgagctggacctgaagctaagacaggcagaagtaataaagggttcttggcagcctgttggcgaccttctcatcgactctcttcaggatcatctcgagaaggtgaaggctcttcgaggcgagatcgcccccttgaaggagaacgtcagccacgtgaacgacctggctaggcagctgaccactctaggaatacagctttctccctataatcttagcacactggaggacctgaacacaagatggaagctgctgcaggtagcggtcgaggaccgtgtgcgacagctgcacgaagcccatagagatttcgggccagcatctcagcacttccttagcacctcagttcaggggccatgggaaagagctattagccccaataaggtcccttattatatcaatcacgaaacacagacaacttgttgggaccatcctaagatgacggagctgtatcagtctctggccgatttgaacaacgttagattcagtgcttataggactgcaatgaaactgagaagactgcagaaagcactatgtctggacttgctgtcgctgtccgcagcctgtgacgcgctcgaccagcataatctcaaacaaaacgatcaaccaatggatattttacagattatcaattgcttaactaccatctacgatcggcttgagcaggaacacaacaacttggtgaatgttcctctatgcgttgacatgtgtctcaactggctgctgaatgtatacgacaccggccggacaggtcggatacgagtccttagttttaaaacaggtattattagcctgtgcaaggcccatcttgaggataaataccgctatctatttaaacaggtcgcctccagtaccggcttctgcgatcagcggcggctcggtctgttgctgcacgacagcattcagataccccggcaactgggggaagtagcgtctttcggcggtagtaacatcgaacccagcgtgcggtcatgcttccaattcgccaacaacaaacccgagatcgaagctgcgctgttcctggattggatgcgcctcgagcctcagagtatggtgtggctccctgtgctacatagggtcgctgctgccgagaccgcaaagcaccaggcaaagtgcaatatctgtaaagagtgtccaattattgggttcagatacagaagcctcaagcacttcaactacgacatatgccaatcatgcttcttcagcggtagagtcgcaaaagggcataagatgcattacccgatggttgagtattgcaccccaacaacttccggcgaggatgttcgagattttgccaaagtgcttaagaataaatttaggactaagagatactttgccaagcacccccggatgggctatttgccggtgcaaacggtccttgaaggtgacaacatggagacggacacgatg

SEQ ID NO: 251355 - DNA, 3432 bp, Artificial Sequence
  Description of Artificial Sequence: Synthetic coding sequence
atgctgtggtgggaagaagtcgaagattgctacgaaagggaggatgtgcagaaaaagaccttcactaagtgggtcaatgcacagttcagcaagttcggaaaacagcacatcgaaaatctcttttcggaccttcaggacggccgccggctgctggatcttctggaaggcctgactggacaaaagctcccaaaagagaagggttccactcgtgtccatgccttgaacaacgtgaacaaggcactgcgggtgcttcagaacaacaacgtggacctggtgaacatcgggtcaaccgacatcgttgacggtaaccataaactgaccctgggactgatctggaatatcatactgcactggcaagtcaagaatgtgatgaagaatatcatggcgggcttgcagcagacgaattcggagaaaatcctcctttcatgggtgagacagtcaacccggaactacccgcaagtcaacgtgatcaacttcacgacttcgtggtccgacggactggcattgaacgccctgatccactcacataggccggacctctttgattggaactcggtcgtctgtcagcagtccgccactcagcgcctggagcatgcgttcaacattgcgcgctatcagctgggaatcgagaaactccttgacccggaagatgtggacactacttaccctgataagaagtcaatccttatgtatatcacttctctcttccaagtcctccctcaacaggtgtccatcgaagccatccaggaggtggaaatgctgccacgaccgccaaaggttaccaaggaagagcacttccaactgcaccatcaaatgcattactcgcaacaaatcacggtgagcctggcgcagggctacgagcggacttcgtcgcctaaaccaagattcaagtcatacgcatacacccaagctgcgtacgtgaccacttcggacccgactagaagcccattcccttcgcaacacctcgaggcgccggaggacaagtcctttggttcgtcactcatggaatccgaagtgaacctggaccggtaccagaccgcgctggaagaggtgctgtcctggcttctcagcgcggaggacactctgcaagcacagggtgagatctcgaatgacgtcgaggtggtgaaggaccaattccacacccatgagggctacatgatggacctcaccgcgcatcagggacgcgtggggaacattctgcagctgggctccaagctgatcggcaccggaaagctctcagaggacgaggagactgaagtgcaagagcagatgaatctccttaactcgagatgggaatgcctgcgcgtcgcgtccatggaaaagcaaagcaacctgcatcgcgaaatcagctacgtcccgtcgacctacctgactgaaatcacccatgtctcccaagccctgctggaggtggaacaactgctcaacgcaccggacctgtgcgcaaaggatttcgaggatctcttcaaacaggaagagtccctgaagaacatcaaggactcactgcaacagagcagcggaaggatcgatatcatccacagcaagaaaacggccgccctccaatcggccactcctgtggaaagagtcaaactccaggaagccctttcgcaactggacttccaatgggagaaggtcaataagatgtacaaagaccggcagggaagattcgataggtcagtggaaaagtggcggcgcttccactacgatatcaagatctttaatcagtggctgaccgaagccgaacagttcctgagaaagacccagattccggaaaactgggagcatgcgaaatacaagtggtacctcaaagagctgcaggatgggatcggccaaaggcaaactgtcgtaaggaccctgaacgccacgggcgaagaaatcattcagcaatcttcaaaaaccgatgcatctatattgcaagagaagttgggatcccttaacctgcggtggcaggaggtctgcaagcagctgtcagacagaaagaaacggctggaggaaacgctcgaacgccttcaggagctgcaagaagccaccgatgagctggatctgaaactgaggcaagcagaggttatcaaggggtcgtggcaaccagtgggggacctcctgatcgacagcctccaggaccacctggaaaaggtcaaagcactgcgcggagagatcgcccctctcaaggagaacgtctcacatgtcaacgaccttgcccgccagctgactacgctgggaattcagctgagcccgtacaatctttcgactttggaggacctcaacaccaggtggaagttgctccaggtggcggtcgaggaccgcgtgcgccaactgcacgaagctcacagagactttggaccagcttcgcagcacttcctgtcgacgtcagttcaagggccctgggaacgggctatctcgcccaacaaggtcccgtactacattaatcacgagactcaaaccacctgttgggaccaccccaaaatgaccgaactgtaccaatccctcgcggacctgaacaacgtgcgcttctccgcttaccggactgctatgaagctgagaaggctgcagaaggccctctgcctggatctcttgagcctgtcagcagcatgcgatgcgctggaccaacataacctcaagcagaacgaccagcctatggacatcctccaaatcatcaactgtctcaccaccatctacgaccgtctggaacaggaacataacaacctggtcaatgtccccctctgcgtggacatgtgcctgaactggctgctgaatgtgtacgacaccggacgcacgggaagaatcagagtgctctcatttaagactggaatcatttcgctgtgcaaggcacacctggaggataagtatcgctatttgtttaagcaggtggcatcctccaccggcttctgcgaccagcgtagactgggcctgctgctgcatgacagcatccaaattccgcgacagctgggcgaggtcgcctcgttcggaggatccaatattgagccttcggtccggagctgctttcagttcgccaataacaagccggaaatcgaggctgctctgttcctcgactggatgcggcttgaaccgcagtcgatggtgtggcttccggtcctgcatcgtgtggccgctgccgaaactgcgaaacaccaagcgaaatgcaacatctgcaaagagtgccctatcatcggcttcagataccggtcactgaaacacttcaactatgatatctgtcaatcgtgcttctttagcggacgcgtcgcgaaagggcataagatgcattaccctatggtggaatattgcaccccgacgactagcggagaggacgttcgagacttcgccaaggtgttgaagaataagtttaggaccaagcggtacttcgcaaagcatccgagaatgggctacttgccggtccagaccgtgctggagggcgacaacatggaaaccgacactatg

SEQ ID NO: 251356 - DNA, 3432 bp, Artificial Sequence
  Description of Artificial Sequence: Synthetic coding sequence
atgctgtggtgggaagaagtggaagattgctacgaacgggaggacgtgcagaagaaaactttcactaagtgggtgaacgcacagttcagcaaattcggcaaacaacatattgaaaacctgttttcggatctccaagatggccgtcgcctcctggatcttcttgaaggactcaccggacaaaagttgcccaaagagaagggatcgacccgggtgcacgcgctgaacaatgtcaataaggcgctgcgcgtcctgcagaacaacaatgtggatctcgtgaatatcggatccactgacatcgtggacggaaaccacaagctgaccctcggcttgatctggaatatcatcctccactggcaggtcaagaacgtgatgaagaatatcatggcgggtctgcagcagactaattcggaaaagattctcctgagctgggtgaggcagtctacccgaaactaccctcaggtgaatgtcattaactttaccacgtcatggtctgacggactggccctcaacgcgctgatccactcacaccgcccggatctgtttgattggaacagtgtcgtgtgtcaacagtccgcgacccagaggctcgaacacgcatttaacatcgcgcgctaccagctcggcatcgaaaagctgttggaccctgaggatgtcgacacgacttatccagacaaaaaatccatcctcatgtacatcaccagcctcttccaggtgctgccgcagcaggtgtcaatcgaggccatccaagaagtcgagatgctgcctagaccccctaaggtcactaaggaagaacacttccagctccaccatcagatgcactactcgcaacagattaccgtgagcttggcccagggatacgagcggaccagcagcccgaagcccagattcaagtcctacgcgtacacccaagcggcctacgtgacgacctcggacccgaccagatcaccattcccgtcccaacatcttgaagcgcctgaggacaaatcattcgggtcatcgcttatggaatccgaagtgaacctggatcgctaccagactgcacttgaggaggtgctgtcgtggctcctgtcggcggaggacactctgcaggcacagggtgaaatctctaacgatgtggaggtggtcaaggaccaatttcatactcatgaaggatacatgatggaccttactgcccaccaaggacgagtgggaaacatcctgcagctgggatcaaaactgatcggaactggcaagctgagcgaagatgaagaaactgaagtccaagagcagatgaatctgttgaatagccgctgggagtgtctgcgggtggcttcgatggaaaagcaatcgaacctccaccgcgagatctcctacgtgccgagcacctacctgactgagatcacccatgtgtcccaggccctgcttgaggtggaacagctcctcaacgccccggacctgtgcgcaaaggacttcgaggacctgttcaaacaagaggaatccctcaagaacattaaggattcattgcaacagtcctcaggaagaatagacattatccactcaaagaaaaccgccgccctgcaatccgcaaccccagtggagcgggtgaaactgcaggaggccctctcgcagctcgacttccagtgggagaaggttaataagatgtacaaggatcggcagggtagattcgaccgcagcgtcgagaagtggcggagattccactatgatatcaagatttttaaccagtggctcacggaggcagaacaattcctgcggaaaactcagattccagagaactgggaacacgctaagtacaagtggtacctcaaggagttgcaggacggaatcggccagaggcagactgtggtgaggaccctgaatgccactggggaggaaatcatccaacaatcaagcaagaccgatgcgtccatactccaggaaaaattggggtccctgaatctgcggtggcaggaagtgtgcaagcaactgtcagaccggaagaaaagactggaagagactctcgaacggctccaagagctccaggaagcgaccgatgagctggatctgaagctgaggcaggccgaagtgatcaaggggtcgtggcaaccggtcggtgacctgttgatcgactccttgcaagaccatctggagaaggtgaaggcacttcgcggagagattgctcctctcaaggaaaacgtctcccacgtgaatgacctggcacgccaacttactacgctgggaatccagctttcgccttacaatctgtcgacgcttgaggatcttaatacccgctggaaactgctgcaggtggctgttgaggatcgggtcagacaactgcacgaggctcatcgcgacttcggtcccgcatcgcaacattttctgtcgacttccgtgcaggggccgtgggaacgcgcaatctcgccgaacaaggtgccatactacatcaaccatgaaacgcaaaccacctgttgggatcatccgaagatgaccgaactgtaccagtcactggctgacctcaacaacgtccgcttctcggcttatcggaccgccatgaagctgcgacggttgcagaaagccctgtgcttggacctgctctccctctcagccgcttgcgacgctcttgaccagcataatctcaagcaaaacgaccagccaatggacatcttgcagatcatcaactgcctgactaccatctatgaccgcctggaacaagagcataacaacctggtcaatgtgccgctgtgcgtggatatgtgcctcaattggttgctgaacgtgtacgacaccgggcggactggtcggatcagagtcctgagcttcaagactggcattatcagcctttgtaaagcccacctggaggataagtacagatacctcttcaagcaggtggcctcgagcaccggattctgcgaccagcgccgccttggcctgctgctccacgactcgatccaaatccctagacaactcggagaggtagcgtccttcggaggctccaacatcgagccaagcgtccgcagctgcttccagttcgcgaataacaaaccggaaatcgaagcagctctcttcctggattggatgcgcctcgagccacagtcgatggtgtggctcccagtcttgcatcgggttgccgccgctgaaaccgccaagcatcaggccaaatgcaacatctgtaaggaatgcccgatcattggattcaggtaccgctccctgaagcactttaactacgacatctgccaaagctgtttcttcagtgggagggttgccaaaggacacaaaatgcactacccaatggtggaatactgcactccgactacgtccggagaagatgttcgcgatttcgccaaagtgctgaagaataagtttcgtaccaagcggtactttgccaaacacccgagaatgggctacctgcccgtgcagactgtcctggaaggcgacaacatggaaaccgacaccatg

SEQ ID NO: 251357 - DNA, 3432 bp, Artificial Sequence
  Description of Artificial Sequence: Synthetic coding sequence
atgctatggtgggaagaagttgaagattgttatgaacgtgaagatgtacaaaaaaaaacgtttacgaaatgggttaatgcgcaattttcgaaatttggtaaacaacatatagaaaatttattttcggatttacaagatggtcgacgtttactagatttattagaaggtctaacgggtcaaaaattaccgaaagaaaaaggttcgacgcgtgtacatgcgctaaataatgtaaataaagcgttacgtgtactacaaaataataatgttgatctagtaaatataggttcgacggatatagtagatggtaatcataaactaacgttaggtctaatatggaatataatactacattggcaagtaaaaaatgtaatgaaaaatataatggcgggtctacaacaaacgaattcggaaaaaatactactatcgtgggtacgacaatcgacgcgaaattatccgcaagttaatgtaataaattttacgacgtcgtggtcggatggtttagcgctaaatgcgctaatacattcgcatcgtccggatctatttgattggaattcggttgtttgtcaacaatcggcgacgcaacgtttagaacatgcgtttaatatagcgcgatatcaattaggtatagaaaaattattagatccggaagatgtagatacgacgtatccggataaaaaatcgatactaatgtatataacgtcgttatttcaagttttaccgcaacaagtttcgatagaagcgatacaagaagtagaaatgctaccgcgaccgccgaaagttacgaaagaagaacattttcaattacatcatcaaatgcattattcgcaacaaataacggtatcgttagcgcaaggttatgaacgtacgtcgtcgccgaaaccgcgttttaaatcgtatgcgtatacgcaagcggcgtatgtaacgacgtcggatccgacgcgatcgccgtttccgtcgcaacatttagaagcgccggaagataaatcgtttggttcgtcgctaatggaatcggaagtaaatctagatcgttatcaaacggcgctagaagaagtactatcgtggttattatcggcggaagatacgttacaagcgcaaggtgaaatatcgaatgatgtagaagtagtaaaagatcaatttcatacgcatgaaggttatatgatggatctaacggcgcatcaaggtcgtgtaggtaatatattacaattaggttcgaaattaataggtacgggtaaattatcggaagatgaagaaacggaagttcaagaacaaatgaatctactaaattcgcgttgggaatgtttacgtgtagcgtcgatggaaaaacaatcgaatttacatcgagaaatatcgtatgttccgtcgacgtatctaacggaaataacgcatgtttcgcaagcgttattagaagtagaacaattattaaatgcgccggatctatgtgcgaaagattttgaagatctatttaaacaagaagaatcgttaaaaaatataaaagattcgttacaacaatcgtcgggtcgtatagatataatacattcgaaaaaaacggcggcgctacaatcggcgacgccggttgaacgagtaaaattacaagaagcgctatcgcaactagattttcaatgggaaaaagttaataaaatgtataaagatcgacaaggtcgatttgatcgttcggttgaaaaatggcgacgatttcattatgatataaaaatatttaatcaatggctaacggaagcggaacaatttttacgaaaaacgcaaataccggaaaattgggaacatgcgaaatataaatggtatttaaaagaactacaagatggtataggtcaacgtcaaacggtagtacgtacgctaaatgcgacgggtgaagaaataatacaacaatcgtcgaaaacggatgcgtcgatattacaagaaaaactaggttcgctaaatctacgttggcaagaagtatgtaaacaattatcggatcgtaaaaaacgattagaagaaacgttagaacgtctacaagaactacaagaagcgacggatgaattagatttaaaattacgtcaagcggaagtaataaaaggttcgtggcaaccggtaggtgatttactaatagattcgttacaagatcatctagaaaaagtaaaagcgctacgaggtgaaatagcgccgttaaaagaaaatgtatcgcatgttaatgatttagcgcgtcaactaacgacgctaggtatacaattatcgccgtataatctatcgacgttagaagatttaaatacgcgttggaaattattacaagttgcggttgaagatcgagttcgtcaattacatgaagcgcatcgtgattttggtccggcgtcgcaacattttctatcgacgtcggtacaaggtccgtgggaacgtgcgatatcgccgaataaagtaccgtattatataaatcatgaaacgcaaacgacgtgttgggatcatccgaaaatgacggaactatatcaatcgttagcggatttaaataatgtacgtttttcggcgtatcgtacggcgatgaaactacgacgactacaaaaagcgctatgtctagatttattatcgctatcggcggcgtgtgatgcgttagatcaacataatttaaaacaaaatgatcaaccgatggatatattacaaataataaattgtctaacgacgatatatgatcgactagaacaagaacataataatttagttaatgtaccgttatgtgtagatatgtgtctaaattggttattaaatgtatatgatacgggtcgtacgggtcgtatacgagtactatcgtttaaaacgggtataatatcgctatgtaaagcgcatttagaagataaatatcgttatctatttaaacaagttgcgtcgtcgacgggtttttgtgatcaacgtcgtttaggtctattattacatgattcgatacaaataccgcgtcaattaggtgaagtagcgtcgtttggtggttcgaatatagaaccgtcggtacgatcgtgttttcaatttgcgaataataaaccggaaatagaagcggcgttatttttagattggatgcgtctagaaccgcaatcgatggtatggctaccggttttacatcgtgttgcggcggcggaaacggcgaaacatcaagcgaaatgtaatatatgtaaagaatgtccgataataggttttcgatatcgttcgttaaaacattttaattatgatatatgtcaatcgtgttttttttcgggtcgtgtagcgaaaggtcataaaatgcattatccgatggtagaatattgtacgccgacgacgtcgggtgaagatgtacgtgattttgcgaaagtactaaaaaataaatttcgtacgaaacgttattttgcgaaacatccgcgaatgggttatttaccggtacaaacggttttagaaggtgataatatggaaacggatacgatg

SEQ ID NO: 251358 - DNA, 3432 bp, Artificial Sequence
  Description of Artificial Sequence: Synthetic coding sequence
atgctgtggtgggaggaggtggaggactgctacgaaagagaggacgtgcagaagaaaactttcactaagtgggttaacgcccaattttccaagtttgggaagcagcacatcgaaaatctgttttccgatttgcaggacggacgacggcttctggacctgctcgagggactgacgggtcagaagctcccaaaggagaaaggatcgacccgggtgcatgccctgaataacgtcaacaaagccctccgggtccttcaaaacaacaacgtggacctcgtcaacattgggtccactgacatcgtggatggcaaccataagctgaccctgggtctgatttggaacattatactgcactggcaggtgaagaacgtgatgaagaacattatggccggcctgcaacagaccaactcggagaaaattctcctcagctgggtgcggcaatccactcggaattatccgcaagtgaacgtgatcaactttactacttcgtggtccgacggactcgcactgaatgcgctcattcactcacaccggcctgacttgttcgactggaactcagttgtctgccaacaatcagcgacccaacgcctggaacatgctttcaatatagctcgctaccagttgggaatcgaaaaactcttggacccagaggatgtggataccacctacccggataagaaatcgatcctcatgtacattacttctctcttccaagtcctgccacagcaggtgagcatcgaagctatccaggaggtggaaatgttgccacgcccccctaaggtgactaaagaggaacatttccaactgcatcaccaaatgcactactcgcagcaaatcactgtgtcactggcgcaggggtatgaacgcacttcgtcgccgaagccacggtttaagtcctacgcctacacccaggcagcgtacgtgacgacttccgacccgacccgcagcccgttcccatcccagcatctggaggccccagaagataaatcctttggctcctcgctgatggagtcagaggtcaacctcgaccgctaccaaaccgcactggaagaggtgctgtcgtggcttctctcggcggaggataccctgcaggcacaaggggagatcagcaatgatgtggaagtggtgaaagatcaattccacactcatgaaggatatatgatggatctgacggcacaccaaggacgcgttggaaacatcctgcaactgggctcgaagctcatcggtactggtaagctgtccgaggacgaggaaactgaggtgcaggaacagatgaacttgctgaattcacgctgggagtgcctcagggtggcctcaatggaaaagcaatccaatcttcatcgcgaaatcagctatgtgccgtccacttacctcactgagatcacccacgtgtcacaggcactgctcgaggtggagcagttgctgaacgctccggatttgtgtgccaaggacttcgaagatctcttcaagcaagaggaatcattgaagaacatcaaggactcgctgcagcagtcgtctgggcggatcgatatcatccactcgaagaaaactgccgccctgcagtcagccacccctgtggagcgcgtcaagctccaggaagcactgagccagctggactttcaatgggagaaggtgaacaaaatgtacaaggacagacagggaagattcgacagatcggtggaaaagtggaggcgcttccattatgacatcaaaatcttcaatcagtggcttacggaagccgaacagttccttcgcaagactcagatcccggagaactgggagcatgccaagtacaagtggtatctgaaagagctgcaggacggaatcggacagcgccagaccgtggttcgaaccctgaacgcgaccggcgaagagatcatccaacagtcgtctaagaccgacgccagcatcctgcaggagaagctgggctcattgaacctgcgctggcaggaagtgtgcaagcagctgtcagatcgcaaaaagcgcctcgaagagactctcgaacggctccaggagcttcaggaagccactgatgaactcgacctgaagctgcggcaagcagaagtgatcaagggatcatggcagcctgtcggagatcttctgatcgattctctgcaggatcacctggaaaaggtgaaagccctgcgcggggagatcgcgccgctcaaggaaaatgtgagccacgtcaacgacctggcgagacaacttactaccttgggtattcaattgtcgccctacaatctcagtactctcgaggacttgaatactagatggaagctcttgcaggtggcggtggaggatagagtgaggcagctgcacgaagcccacagggacttcggacctgcttcccagcacttcctctctacttcagtgcaggggccatgggagcgggccatttcacctaacaaggtgccctactatatcaaccacgagactcaaactacttgctgggatcacccgaagatgaccgaactgtaccagtcactcgccgatctcaacaacgtgcggttcagcgcctaccggaccgccatgaaactgcgcaggctccagaaggcgctgtgtctcgaccttctcagcctttccgccgcttgcgatgctctggaccaacacaaccttaaacagaacgaccagccaatggacatcctccagatcatcaactgtctcactaccatctacgaccgcctggagcaggaacacaataatcttgtgaatgtgcccctctgcgtcgacatgtgcctcaactggcttctgaatgtgtacgacactggacggaccggtaggatccgcgtcctgtccttcaagactgggatcatttcattgtgtaaagcccatctggaggacaagtaccggtacctcttcaagcaggtggccagctcgactggattctgcgatcagcgcaggctgggcctgctgctgcacgattccatccagatcccgcggcagctgggagaagtggcctccttcggaggctcaaacatcgaaccttcagtgcgctcctgcttccaattcgcgaacaataagccagaaatcgaagcagcactctttcttgactggatgaggctggaaccgcagagcatggtgtggcttccagtgctgcaccgggtggccgccgcagaaaccgccaaacatcaggcgaagtgtaatatctgcaaggagtgtccgatcatcggattccgctacagatccctgaaacactttaactacgacatctgccaaagctgcttcttctcgggacgggttgcaaagggacataagatgcattaccctatggtcgagtactgcactccaactacttcaggcgaggacgtgcgcgactttgcgaaggtcctgaagaacaaatttcgcactaaaaggtatttcgctaaacaccctcgaatgggatacctgccggtgcaaaccgtgctggaaggtgacaatatggagactgacaccatg

SEQ ID NO: 251359 - DNA, 3432 bp, Artificial Sequence
  Description of Artificial Sequence: Synthetic coding sequence
atgctgtggtgggaggaggtggaagactgctacgaacgggaagacgtccagaaaaagacctttacaaaatgggtgaatgctcagttcagcaagttcggaaagcaacacattgagaacttgtttagtgacctccaagacggacgtagacttttagacttgttggagggacttactgggcagaaactccctaaggaaaagggatcgacccgcgtccacgcactgaataacgtgaataaagccctgagagtgttgcagaataataatgtggacctggtgaacatcgggagcacagatatcgtggatggaaatcacaagctaacactggggttgatctggaatatcattctccactggcaggtaaagaacgtaatgaagaatatcatggctggcctccagcagaccaattctgagaagattctcctgtcatgggtcagacagtcaacgaggaattatccccaggtaaacgtgataaactttacaacgtcttggtcagatggacttgctctaaatgccttgattcactcgcaccgaccagacctgttcgattggaatagcgtggtctgccagcagtccgccacccaacgactggaacacgcctttaacatagcccggtaccagctgggtatcgagaagcttcttgacccagaagatgttgataccacttaccccgataaaaaaagcattctgatgtatatcacatcactgttccaagtgctgcctcagcaggtttcgatagaggccattcaagaggtggagatgctgcctcgccctccgaaagtcacaaaggaggaacatttccaactgcatcatcagatgcactattctcagcaaattaccgtgtcattagcacaggggtatgaacgcacatcaagtcccaagccccgcttcaaatcatatgcatacactcaggcggcatatgtgactacgagcgatcccacccgttccccctttccgtcgcagcacttagaggcacctgaggataagagcttcggcagctccctcatggaaagcgaagtgaatctagaccgctaccagaccgccctagaggaggtattgtcctggttgctctccgcggaggataccctgcaagctcagggagagatatccaacgatgtggaagtcgtgaaagatcaatttcatacccatgaggggtatatgatggatcttacagcgcaccagggtcgcgtgggcaacatactccaactggggtcgaaactgatcgggactggtaagcttagcgaagatgaggaaaccgaggtccaagagcaaatgaatctgctgaacagcagatgggagtgtttgcgcgtcgcctccatggaaaagcagtcaaacttgcaccgagaaatcagctatgttccttcgacttatctgacggagatcacgcacgtgtcccaggcactgctcgaagttgagcagctcctgaacgcgccggatctatgcgctaaagacttcgaagatctgtttaaacaggaagaaagtcttaagaacatcaaagattcgctgcagcagtccagtggacgaatcgatataatccactccaaaaagacggctgctctccagagcgctactcccgtggagcgggtgaagctgcaagaggcactatctcagctcgacttccaatgggaaaaggtcaataaaatgtacaaagatcggcaggggcgatttgatcggagtgtagaaaagtggaggcgatttcactacgacattaaaatctttaaccagtggctgaccgaggcagagcagttcctccgaaagacacaaatcccagaaaactgggagcacgcaaagtacaagtggtacctgaaagagttacaagatggtatcggccagagacagaccgtcgtgagaacgctgaatgctactggcgaggaaatcatccagcagtcaagcaagaccgatgcgagcatactccaggagaagctggggtctctgaatctgagatggcaggaggtatgcaaacagttatctgatcgtaaaaaacggctggaggaaaccctggagcggctccaggagctccaggaagccacagacgagctggacctgaagcttcgacaagcagaggtaataaaagggagctggcaacccgttggcgatcttttaatagatagtctccaggaccatctggagaaggtgaaggccctccgtggggaaatagccccgctcaaggagaatgtttctcacgtaaacgacctggctcgtcaactgaccacgctggggatccagctttcaccatacaatctctcaaccctggaggacctaaataccaggtggaaacttctgcaagttgccgtggaggatcgtgttagacaactgcacgaagctcaccgagactttggcccagcttcgcagcactttctatctactagcgtccaggggccttgggagagagcgatctccccaaataaagtcccgtactatatcaaccatgagacacagacgacctgttgggatcatcccaaaatgaccgagctctaccaatctctggcagacttaaataacgtcaggttctccgcctacaggaccgcaatgaaactgcggcggctgcaaaaagctttgtgtctggacctgctgtctttgtcagctgcttgtgatgccctggaccagcataacctgaagcagaatgaccaacctatggatattctccaaatcatcaattgcctgaccaccatttacgatagactcgagcaggagcataacaacctagtcaacgtgcctctctgcgtcgatatgtgcttaaattggctacttaacgtctacgacacgggcaggaccggtcgtatacgtgtgttgtcgttcaaaacaggcattattagtttgtgcaaggctcacctcgaggacaaatatcgctatctgtttaaacaagtggcctccagcacaggcttctgcgatcagcgtcgtctcgggctgctgctgcatgattcaattcagataccgaggcaactgggagaagtggcaagtttcggcggtagtaatattgagcccagcgtccggtcatgcttccagtttgcgaacaataagcccgaaattgaagcagccctgttcctggactggatgagactggaaccccaatcaatggtctggctgcctgtcctccaccgagtcgcggctgctgaaacagcaaagcaccaagccaaatgcaatatatgcaaggaatgcccgatcattggcttccggtaccgtagcctgaaacactttaattacgatatctgccagagctgctttttcagtggccgagttgcaaaaggtcataagatgcactaccccatggtcgagtattgtacgccaacaactagcggagaggatgtccgcgactttgccaaggtcttgaaaaacaagtttcgaactaaaaggtacttcgctaaacaccctcgaatgggctatctcccagtgcagactgtgcttgaaggggacaacatggaaactgacaccatg

SEQ ID NO: 251360 - DNA, 3432 bp, Artificial Sequence
  Description of Artificial Sequence: Synthetic coding sequence
atgctctggtgggaagaggtggaggattgttatgaacgggaggacgttcagaagaagacattcacaaaatgggtgaatgcacagttctctaagttcgggaagcaacacattgagaacttgttctctgatttgcaggacggcagaagactcctagacctacttgaaggcctcaccggtcagaaattgccaaaggagaagggttcaactagagtacacgcactcaacaacgtgaataaggcgttacgagtgcttcagaataacaatgtggatttggttaacataggatccaccgacattgtagacggcaaccacaagctcaccctaggactgatttggaacatcatccttcactggcaagtgaaaaatgttatgaaaaatataatggccggactacagcagaccaattcggaaaagattctgctgtcctgggtgaggcagtcaaccagaaattacccccaggttaatgtcatcaactttacaactagctggagtgacggcctggccctgaacgcactgatccattcccataggccagatttgttcgactggaactctgtggtgtgccagcagtctgccactcagcgattggagcacgcctttaacatcgcccgctatcagctggggatcgaaaagttgctcgatcccgaagatgtggataccacctatcctgacaagaagagcattctgatgtatattacttctctctttcaggttctccctcagcaggttagcattgaggcaatccaggaggttgaaatgctgccccgacccccaaaggtgacaaaggaggagcacttccagctgcatcatcagatgcattactcacagcagataacagtaagtcttgcccaggggtacgagcggacttcttcaccgaagcctagattcaagtcatacgcttatacacaggctgcctacgtaaccaccagtgatcccactcggagcccattcccctcccaacatttggaggctcctgaggacaagagtttcggaagctcattgatggaaagcgaagtcaatttagaccgctatcagacagccctggaagaggtcctgtcttggctactgtcagccgaagacacgctgcaggcacagggagagatctctaacgacgtggaggtcgttaaggatcaattccacacccacgaagggtacatgatggacctcaccgcccatcagggacgtgtaggaaacatcctccagctcggatcaaaactgatcggaactgggaagctgagcgaagatgaagaaacagaagtgcaggagcagatgaacttgctgaattccaggtgggaatgtctccgcgtggcctctatggagaagcagtcgaacttgcaccgcgagatctcttacgtgccctccacttacctgaccgagattacccacgtgtctcaggcactgctcgaggtggagcaattgttaaacgcaccagacttgtgcgctaaagattttgaggatctcttcaaacaggaggaatccctcaaaaatatcaaagattctctgcagcagtcttcgggaagaatcgacatcatccacagcaagaaaacagccgcccttcagtctgccacacctgtggaacgggttaaactccaagaggccctgtcccagcttgactttcaatgggaaaaagtgaataaaatgtataaagaccgccaaggaagatttgacagatccgtcgagaaatggcgtaggttccactatgatatcaaaattttcaaccaatggttaaccgaggcagagcagttcctgcgcaaaactcagattccagagaattgggaacacgccaaatacaagtggtatcttaaagagcttcaggacggaatcggccaacgtcagactgtagttagaactctgaatgccaccggtgaggagataatccagcagagttccaagaccgatgcttccatcctacaagagaaactaggctctttaaacttacgctggcaggaggtgtgtaagcagctttccgaccggaagaaacggctcgaggaaaccctcgagcggctacaggagcttcaagaggcaacagacgaactcgacctcaagctgagacaggctgaggtgattaaaggctcctggcaacctgtgggtgacctgctgattgactcactgcaggaccacctggaaaaggtcaaggcactgcggggagagattgcccccttaaaggagaatgtaagccacgtaaatgacctggcgaggcaactgaccacccttggcatccagctctccccctacaatctgtcaacccttgaggacctcaacactcgttggaagctccttcaggtggccgtggaggaccgcgtccgtcagctccacgaggcgcaccgggactttggaccagcaagccaacacttcctatctacaagcgtgcagggtccctgggaaagagctatcagtcccaacaaggtcccatactatataaaccacgagacccagacaacgtgctgggatcatccaaaaatgacggagctgtaccaaagtcttgcagatcttaacaacgttagattctccgcttaccgtactgccatgaaactgcgccgcctgcagaaagccttatgtttagatctgttatcactttccgcagcatgcgacgcattggaccagcataacctgaaacagaatgaccaacccatggacatcctacaaattatcaattgcctcacgacaatctacgacagacttgaacaggagcacaacaacctggtgaacgtacctctgtgtgtagacatgtgcctcaactggctgcttaatgtgtacgacacaggccgtacaggcagaatccgggtactgagttttaaaacaggcattattagtttgtgtaaggcccaccttgaggataagtataggtacctgtttaagcaggtggcctccagcaccggattttgtgatcaacgtcgcctagggctgctcctgcacgatagcatccagattccacgccagttgggtgaggtcgcctcatttggtggcagcaatatcgaaccctcagtgcggagttgcttccagttcgctaacaacaaacccgagattgaggcagcgctttttttggactggatgcggctagaaccgcagagcatggtgtggctgcctgtactgcatcgcgtggcagctgcagaaacagccaagcaccaggccaaatgcaacatctgtaaggaatgcccaataataggatttcgatatcgatcacttaaacactttaactacgacatctgccagagctgttttttttccgggcgcgtggccaaagggcataagatgcactatccgatggtggaatattgcactccaacgacctccggcgaggatgtcagagacttcgctaaggtgctcaagaacaagtttcgtaccaaacggtacttcgcgaaacaccccagaatgggatatttacccgtgcagacggtgctcgaaggggataatatggaaacggatacaatg

SEQ ID NO: 251361 - DNA, 3432 bp, Artificial Sequence
  Description of Artificial Sequence: Synthetic coding sequence
atgctctggtgggaagaggtcgaggactgttacgaaagagaagatgtgcagaagaagaccttcaccaaatgggtcaatgcgcagttctcaaagttcggtaagcagcatatcgaaaacctgttctcagatctccaggatgggcgccggctgctggacctcctcgaaggactgacggggcagaagctcccgaaggaaaaaggaagcactcgagttcacgcgctcaacaacgtgaacaaggcactcagagtgttgcaaaacaacaatgtggacttggtcaacatcggctctaccgacattgtggatggtaatcataagctgactcttggcctgatctggaacattatccttcactggcaagtcaaaaacgtcatgaagaatatcatggccggcctgcagcaaacgaattcggagaagatactcctctcctgggtgaggcaatcaacgaggaactaccctcaagtgaatgtgatcaacttcaccacttcctggtcagacgggctggcactcaacgcacttatccactcccaccgtcctgacctgtttgattggaactcggtggtttgccaacagagcgccacgcaacgcctggaacatgcattcaacatcgctagataccaacttggtatcgagaaacttctcgacccagaggatgtggacaccacttacccggacaagaagtcaatcctcatgtacatcaccagcctgtttcaggtgctgcctcaacaagtgtccatcgaagctatccaggaggtggagatgctgccgcgcccgccaaaggtgactaaagaagagcactttcaactgcaccatcaaatgcactactcacagcagatcaccgtgagtctggctcagggatacgaaagaactagctcgcccaaacctcgcttcaagtcatacgcatatactcaagcagcttatgtcactactagcgacccaactcgctcacctttcccctcgcagcacttggaagccccggaagacaagtccttcggatcctcgctgatggaatcagaagtgaacttggatagataccagactgccttggaagaggtgctgtcatggttgctttcggcggaggacactctgcaggcgcaaggcgagatctccaacgatgtggaggtggtgaaggatcagttccatacgcacgaaggctacatgatggacctcactgcccatcaaggaagggtgggcaatatcttgcagctcggttcgaagttgatcggtaccgggaagttgtcggaagacgaagaaaccgaagttcaagaacagatgaatttgctcaatagccgctgggagtgcctgagagtggcgagcatggagaaacagtcaaacctgcaccgggaaatctcctacgtgccctccacttacctcaccgagatcacccatgtgtcccaagccctgcttgaggtggagcaactgctgaacgcacctgacctgtgcgcgaaagacttcgaggatctctttaaacaagaagaatcgttgaagaacattaaggattcgctgcagcagtcatcaggacgaattgacatcatccactcgaaaaagaccgccgcgttgcaaagcgcaacccctgtggagcgggtgaaactgcaggaggcactcagccaactggatttccagtgggaaaaagtaaataagatgtacaaagaccggcaaggccgcttcgatcgctccgtggagaaatggagacgctttcattacgacatcaagatcttcaatcaatggctgaccgaagcggaacagttcctcagaaagacccagatccccgagaattgggaacacgctaagtacaaatggtacctcaaggagctgcaggatggcatcgggcagagacagactgttgtacgcactcttaatgcaactggcgaggagatcatccaacagtcatcaaagactgatgcttcgatcctgcaggaaaaattgggatccctgaacttgcgctggcaagaagtgtgtaagcaattgagcgacagaaaaaagagactcgaggaaaccctggaaagacttcaggagctccaggaagccactgatgaactcgatttgaagctgcgccaggccgaggtgatcaagggaagctggcagccggtgggagatcttctgatcgactccctccaagaccatctggaaaaggtcaaggcacttcggggggaaatcgcgccacttaaagaaaatgtcagccatgtgaacgatctggcgagacaactgactactctcggtatccagctgtcgccatacaacctgtcgactctcgaggatctgaatactaggtggaagctcctccaggtggcagtcgaagacagagtccggcagctccacgaggcacaccgcgactttggacctgcgtcacagcacttcctgtcgaccagtgtgcaaggaccgtgggagcgggccatctcgccgaataaagtgccgtactacatcaatcacgagactcaaactacgtgctgggaccacccgaaaatgacggaactgtaccagtcactggccgacctcaacaatgtgcggtttagtgcatataggaccgcgatgaaactgcgacgcctgcaaaaggccctgtgtttggacctcctgtccctgagcgcggcgtgtgacgcgctggaccaacataatctgaagcagaatgaccaaccaatggatatcctgcagatcattaactgccttaccactatctacgacagactcgaacaagagcacaataatctggtcaacgtgccgctgtgcgtggatatgtgtctgaactggctgctgaatgtgtacgacaccgggcgcacgggcaggatccgggtcctgtccttcaaaactggcatcatctcgctgtgcaaggcccacctggaagacaagtaccgctacctgtttaagcaagtggcgtcgagcactggattctgcgaccagcggcggctgggactgctgctgcacgatagcattcagatccctaggcagctcggcgaagtggcctcgttcggaggatcaaatatcgagccatcggtgaggtcgtgctttcagtttgccaacaacaaacccgagatcgaggcggctctctttctggattggatgaggctggaacctcagtctatggtctggttgccagtgctgcaccgggtggcggcagccgaaactgcgaagcatcaggctaagtgcaatatctgcaaagagtgcccgatcatcggtttcaggtaccggagcttgaagcattttaactacgacatttgccaatcttgcttcttctcgggtcgcgtcgcaaagggtcataagatgcactacccgatggtggagtactgcactccgaccaccagcggcgaagatgtcagagatttcgccaaagtcctcaagaacaagttccgcaccaagcgctacttcgccaagcatccgcgcatgggatatctgcctgtgcagaccgtgctggaaggtgacaacatggagactgacacgatg

SEQ ID NO: 251362 - DNA, 3432 bp, Artificial Sequence
  Description of Artificial Sequence: Synthetic coding sequence
atgctctggtgggaagaggtggaggattgttacgaacgcgaagacgttcagaaaaaaacattcaccaagtgggttaatgctcaattcagcaagttcggtaaacaacatattgagaacctcttttcagatttgcaggacggtcggcgtctcctcgatcttttagagggacttaccggacaaaaattgccaaaggagaaaggctctacacgtgtccatgcacttaacaatgtgaataaggcactgagagtcctgcaaaacaacaacgtggatttggtgaatatcggtagcacagatatagttgatgggaatcataagctaacccttgggcttatttggaacataatcttgcattggcaagttaagaacgttatgaagaatatcatggccggcttgcagcaaactaactctgaaaaaattcttttatcttgggtgcggcagtctacacgtaattacccccaagtaaacgtcattaattttaccacatcatggtcagatgggctcgcattgaacgcattgattcattcacataggccagatctattcgactggaacagtgttgtatgtcagcagtctgcaactcagagacttgaacatgcctttaatatcgcacggtaccaacttggcattgagaagctattggatcctgaggatgttgatactacttatcctgataagaagagcatcttgatgtatattacttcattattccaggtgctgccacaacaggtttcaatcgaagcgatccaagaagttgagatgcttccaaggccaccaaaagtgacaaaagaggagcactttcagctacatcaccagatgcattatagccagcagataacagtgagcctggcccaaggttatgaacgcaccagctctccaaagccccgctttaagtcttatgcttatacccaggcagcatatgtaactacttccgatcctacaagaagtcctttcccatctcagcatttagaggcaccagaggataagagttttgggtcctcattgatggaatcggaagttaatctggacaggtaccaaactgctctcgaagaagtgctttcatggttgctgagcgctgaagatacccttcaagcccagggagagatctccaatgacgtcgaagttgttaaggatcaatttcacacccatgaaggttatatgatggatttgacagcgcaccaaggccgagtgggcaacattttgcaactcggttctaagttaattgggacaggtaagctgtccgaggacgaagagacagaggtacaggaacagatgaaccttctcaattctcgctgggaatgtttgcgcgtcgcaagtatggaaaaacaatcaaatcttcatcgggaaatatcgtatgtgccctccacgtacctgacagagattactcatgtctctcaagcattgttagaggtcgaacagttacttaatgctcccgatttatgcgctaaggactttgaagatttgtttaaacaagaagagtctcttaagaatataaaagattcacttcaacagtcctcgggacgcattgatattatccactcaaaaaaaaccgccgctttgcaatcagccacgcctgtggaaagagtaaaacttcaggaggctctaagccagttggatttccagtgggagaaggttaataaaatgtacaaagataggcaaggtcgtttcgatcgttccgtggaaaagtggcggcgttttcactacgatatcaaaatttttaaccaatggctcacagaggctgagcaattccttagaaagacccagattcccgagaattgggaacacgctaagtacaagtggtacttgaaggagttgcaagatggaattgggcagaggcagactgtcgttagaaccttaaatgctactggagaggagattattcaacaatcctctaaaactgatgctagcatccttcaggagaagcttgggtctcttaacctccgttggcaagaggtatgtaagcagctgtcagatcgtaaaaagaggctggaagagactcttgaacgactgcaggaattgcaagaagcgacagatgaactcgatcttaagctgagacaagcagaggtgattaagggttcatggcagccggtaggtgatctattgattgatagtctccaagaccatttagagaaggttaaagctctccgtggagagatcgcacctttgaaggagaatgtctcccatgttaacgatttggcacggcagctaaccaccctaggtattcagctctcaccctacaatctttctaccttggaagacttgaacacacgctggaaattactgcaagttgctgtggaagacagggttaggcaattgcacgaggctcaccgtgacttcggcccagcgtcgcagcatttcctgtccacgtctgtgcagggcccatgggagagagcaatctctcccaacaaagttccgtattatattaaccacgagacacaaaccacttgttgggatcatccgaagatgaccgagctttaccaatcccttgctgatctaaacaacgttagattttctgcttacagaacagctatgaagcttagaagacttcagaaggcattgtgtttggatttattaagtctttcggctgcctgcgatgcgttggatcaacataatctgaagcagaacgaccaaccaatggacatcctccagatcattaactgtcttacaacaatttatgatcgcttggagcaagaacacaataacttagttaatgttcccctatgcgtggatatgtgcctcaactggttactcaatgtgtatgatactggaaggaccggtcgaataagagttctttcctttaaaaccggcataatttctttgtgtaaggctcatcttgaggataagtaccgttatttattcaagcaggtcgcttcttcaaccggattctgtgatcagagaaggctcggactgctattacacgattctattcaaatacctcgacagcttggtgaagtagctagcttcggtgggagtaacattgaaccatcagttcgtagttgcttccaattcgctaataataagcccgagatcgaagccgcgctctttctcgattggatgcgactcgagcctcagtctatggtttggttgccagttctgcatcgggtagctgcagctgaaacagcgaaacaccaagccaaatgtaatatatgtaaggagtgtcccattataggatttcgttatcggagtttaaaacattttaactacgatatttgtcagagctgcttttttagtggtagagtagcaaagggacacaaaatgcattatccaatggttgaatactgtactcctacaacaagtggagaggatgttagggattttgcaaaggtgctaaagaacaagttcaggaccaaaaggtacttcgcaaaacatcctcgtatgggatatctccctgtccaaaccgtgttagaaggggacaatatggagaccgatactatg

SEQ ID NO: 251363 - DNA, 3432 bp, Artificial Sequence
  Description of Artificial Sequence: Synthetic coding sequence
atgttgtggtgggaggaagtggaggactgctatgagcgggaagatgtccagaaaaagacttttaccaagtgggtgaatgcccaattttcgaagtttggtaaacaacatatagaaaacttgttcagcgaccttcaggatggtagacgtctgcttgacctccttgaaggactgactggccaaaaactgcctaaggagaaaggttcgacccgcgtgcatgcactgaacaacgtgaataaggcacttcgcgtcttgcagaacaacaatgtggatctggtgaatattggatcgaccgatattgtggacggaaaccacaagctgaccctgggtctgatatggaacattatcctgcattggcaggtgaaaaacgtgatgaagaacattatggcaggccttcagcaaactaattcggaaaagattcttctgtcatgggtgcgacaatcgactcggaactacccccaagtgaacgtgattaacttcactacctcgtggtctgatggtctggcactgaatgccctcatacactcccataggccagatctgttcgattggaactccgtcgtgtgccaacagtcggcaacgcagcggcttgaacacgcatttaacatagcaagataccaattggggatagaaaagttgctggatccagaagatgtggacacgacttaccctgataagaaatcgatcctgatgtacattacctcacttttccaagtgcttccacagcaggtgtcgatcgaagcaattcaagaagtcgaaatgctgcctaggccacctaaagtgaccaaggaggaacattttcaactgcatcatcagatgcattattctcagcagattactgtgtcgctcgcgcagggatacgaacggacctcgtcacccaagcctagatttaagtcatacgcatacacccaagcggcctacgtcactacttcagaccctacccggtcacccttcccatcacaacatctggaggcgcctgaggataagtcctttggtagttcgcttatggaatcggaagtgaacctggatcggtaccagaccgccctggaagaagtcctctcttggctgctctcagctgaggataccctgcaagcgcaaggcgagatctccaacgacgtcgaggtcgtgaaagaccagtttcacacccatgagggctacatgatggacctgactgcacatcagggaagagtcggtaacattcttcaacttgggtcgaaattgattggaactggtaagctgtctgaggatgaggaaactgaagtgcaagaacagatgaacttgcttaactcccgatgggaatgcctcagagtggcttcaatggagaagcaatcgaatctgcaccgagaaatttcatacgtgccctccacctacctgaccgaaatcacgcatgtctcgcaagcacttctggaggtcgaacagttgttgaatgcacctgacctttgtgcaaaagatttcgaagatcttttcaaacaggaagagagcttgaaaaacatcaaagattcgctccaacaatcctccggaaggatagatatcatccactccaaaaagacggcggcgctgcaatcggcaactccagttgagcgggtgaagctccaggaagcactttcgcagctcgactttcaatgggaaaaggtcaacaagatgtacaaggaccgacagggcagattcgatagatcggtggaaaagtggaggcggttccattacgacattaagatattcaatcagtggcttaccgaagcagagcagtttcttcgcaaaacgcagataccagagaattgggagcatgctaagtataagtggtacttgaaggaacttcaagatgggatcgggcagagacagacggtggtcagaaccctgaatgcaacgggcgaggaaatcattcagcaatcctctaaaactgacgcctcgatcctccaagaaaagctcggaagccttaatctccgctggcaggaggtgtgtaaacaattgtcagatcgcaagaagcggttggaagaaactctcgaaaggcttcaagaattgcaggaggcaactgacgaactggacctgaaactccggcaggcagaagtgataaaggggagctggcaacccgtgggagatcttctgatagacagcctgcaagaccatctcgagaaagtcaaggcgcttagaggagaaatcgcgcctctgaaggaaaatgtttcgcacgtgaacgaccttgcacgtcaacttactaccttgggaatacagctttcgccgtacaacctttccactcttgaagatctgaatactcggtggaaactgctccaagtggccgtagaagatcgtgttagacaattgcacgaagcccatcgagactttgggcctgcatcacaacactttctctcgacgtccgtgcaaggaccatgggaacgcgccatctcgcccaacaaagtcccatactacattaaccacgaaactcagaccacgtgctgggaccatccgaagatgaccgagctctatcaatcgctcgccgaccttaacaatgtcaggttctccgcctacaggaccgctatgaaactcagacggctccaaaaggcgctttgccttgatcttctgtccctttcggcagcttgtgacgcgctcgatcagcataaccttaaacagaacgatcagccgatggatattcttcagatcatcaattgtctgaccactatctacgatcgtctcgagcaggaacacaacaacctggtgaacgttcctctttgtgtggatatgtgtctgaattggcttcttaacgtctacgatactggaagaaccggcagaatccgggtgctttcgtttaagactggcataatcagtctgtgtaaggcccatctggaagataagtacagataccttttcaagcaagtcgcaagtagcacgggtttttgcgaccagcgcaggctgggactgctgcttcatgattcgattcaaattcctcgtcagcttggggaagtggcatcgttcggagggtcgaacattgagccgtcagtgaggtcctgttttcaatttgcgaataacaagcctgaaatagaagcagccctttttctcgattggatgcgcctggagcctcagagcatggtctggctgccagtcttgcaccgcgtggccgcagcagaaaccgctaaacaccaagcaaagtgtaacatttgtaaagaatgtccaatcatcggcttccgctaccgatccctcaagcacttcaattacgacatttgtcagagctgcttcttttctggacgtgtcgccaagggacataagatgcactacccaatggttgaatactgtacgcccaccaccagcggagaggatgtgcgtgactttgccaaagtgcttaagaataagtttcgaaccaaacgatactttgcaaaacaccctcgaatgggatacctgccagtgcagaccgttctcgaaggagataacatggaaaccgataccatg

SEQ ID NO: 251364 - DNA, 3432 bp, Artificial Sequence
  Description of Artificial Sequence: Synthetic coding sequence
atgctatggtgggaggaggtggaggactgttatgagagggaggatgtacaaaaaaagaccttcactaagtgggtcaatgcccagttctcaaagttcggtaagcagcacattgaaaacctcttctctgacctacaggatggacggaggcttctagaccttcttgaaggcctgacagggcaaaagctgcctaaggaaaagggatccactcgcgtccatgccttaaacaacgtaaacaaggccctgcgcgtgctgcagaataacaatgtcgacctagtgaatatcggctccactgatattgtggacggaaatcataagttaactctcggattgatatggaatattatcctacattggcaggttaagaacgttatgaaaaatatcatggcaggtttgcagcaaactaacagtgagaaaatcctgctgagttgggtccgacagtcaacgagaaactatccacaggtcaatgtcattaattttactacatcgtggtctgatggcctagccttgaacgccctcatacacagtcatagaccagacctctttgactggaactctgtggtgtgtcagcagagtgctacccagcgactcgagcacgcgtttaacatcgccaggtaccagctgggaattgagaagcttttggaccccgaggatgtggacactacttaccctgacaaaaagagtattctgatgtatatcacatccctgtttcaagtgctgccacagcaggtctctattgaggctatccaagaggtggaaatgttgcccagacctccgaaggttacgaaggaggaacattttcagttgcaccaccagatgcattattcccagcagatcacagtttccctcgcccagggctacgagcggacctcctcacccaaaccccggtttaagtcctatgcatatactcaggctgcatatgtgactacaagtgaccctacaaggagtcccttcccatctcagcatctggaggctcccgaggataagtcttttgggtctagtctcatggagtccgaggtaaaccttgatcgttaccagaccgctctggaggaggtgctgagctggctgctttcagctgaagatactctgcaggcccagggcgagatcagcaatgatgttgaagtggtgaaggaccaatttcatactcacgaggggtacatgatggacctcaccgctcaccaagggcgcgtgggtaatatcctgcaattaggcagcaagcttatagggactggcaaacttagcgaggacgaagaaactgaggtgcaggagcaaatgaatctacttaactcaaggtgggagtgtctcagagtggcctctatggagaagcagtcaaatctgcacagggaaataagttacgtgccaagcacatacctgaccgagatcacccacgtcagccaagcccttctcgaagtggagcagctgctgaacgcgcccgatctgtgcgctaaagattttgaggacctttttaaacaggaggagtcattaaagaacattaaagactcattacagcagtcttccgggaggatcgacatcatccattccaagaagacagccgctcttcagagtgccacccctgtggagagagtaaagctgcaggaagcactaagccagctggatttccaatgggaaaaggtgaacaagatgtataaagatcggcaggggagattcgatcgcagcgtcgagaagtggcgcaggttccattacgacatcaagatcttcaatcaatggctgacggaggcagagcagttcctccgcaagacccagatcccggagaactgggaacacgcaaagtacaaatggtatctgaaagaactacaggacggcattggtcaacggcagaccgtggtacgtaccttgaacgcaactggcgaggagataattcagcagtctagcaagaccgatgctagcattctgcaagagaaattgggttctctgaatttaagatggcaagaggtgtgcaaacaactcagtgataggaaaaagcgactggaagagaccctcgaacgtctgcaggagctgcaagaggccactgatgaactggacttgaaactccgtcaggcggaggtaataaaagggtcttggcagccagtgggggatctgctcatcgactccttacaagatcacctcgagaaggtaaaagctctaaggggggaaattgcccccttgaaggagaatgtttcccatgtgaatgacctggcacgacagctcaccacgctgggcattcaactgtccccctataatctgtctactttggaagatctaaacaccaggtggaaactacttcaagtggctgtcgaagaccgggtgaggcagcttcatgaggcccatcgagattttgggcccgcttcccagcacttcctgagcacctccgtgcagggtccatgggaaagggcgatctcccctaacaaggtgccctactacatcaatcacgagacacagacgacgtgttgggaccaccctaaaatgactgaactataccaatccctggccgatctcaataacgtcaggtttagcgcgtaccgcacagcaatgaaacttagacggctacaaaaagctctgtgcctggatttgctctcactatctgccgcttgtgatgccttggatcagcacaacctcaagcagaacgaccagcctatggacatcttgcaaatcatcaactgccttacgactatctatgatcgcctggagcaggagcataataacttggtgaatgtgcccctttgcgtggacatgtgcttaaactggctgttgaacgtgtacgacaccgggcgaacaggccgcattcgtgtgcttagctttaagaccgggattattagtttatgtaaggcccacctggaagacaaatacaggtatctcttcaaacaggtcgcctcatctactggtttttgtgatcagaggaggctcgggctcctacttcatgatagtatccagattccaagacagctgggagaagtggcatcatttggggggtctaacattgagccctcagtgagatcctgcttccagttcgccaataacaagccggaaatcgaggccgctctgtttttggactggatgaggctcgaaccacaatccatggtgtggctccctgtgctccatcgggtggccgcggccgagaccgccaagcatcaggcaaaatgcaatatttgcaaggagtgtcctataatagggttccggtacaggtctttgaagcacttcaactacgacatttgtcagtcatgcttcttctcaggccgtgtagcgaaggggcacaaaatgcactaccctatggtggagtactgtacacctacaacgtccggcgaggatgtgcgcgacttcgctaaagtgctgaaaaacaagttccggacgaagcggtactttgcgaaacacccacggatggggtacctgcctgtccaaacagtcctcgagggggacaatatggagactgacacaatg

SEQ ID NO: 251365 - DNA, 3432 bp, Artificial Sequence
  Description of Artificial Sequence: Synthetic coding sequence
atgctgtggtgggaggaagtggaagattgctacgagagggaagacgtgcagaaaaaaacgtttacaaagtgggttaacgcccagttttcgaagttcggaaaacagcacatcgagaacctgttctccgacctacaggacggaagaagactgctcgacttgctggaagggctaactgggcagaagctccccaaggagaagggctccacccgagtccacgctctgaataatgtgaataaagcactgcgcgtcttgcaaaataacaacgtggatctagtgaatataggatctacggacatcgtagacggcaatcacaagctcactttgggcctgatatggaatatcatattgcattggcaggtgaagaacgttatgaaaaacatcatggccggcctgcagcagacgaactccgaaaagatcttgcttagctgggtcagacagtccacacgaaactaccctcaggtcaatgtaatcaattttacaacatcttggtcagacggtctcgccctgaacgcacttatccatagccatcggccagatctttttgattggaattctgtcgtgtgccagcagagcgctacccaacgactggaacatgccttcaacattgcaagataccagttagggatcgagaaactgcttgacccagaggacgtcgatactacttaccctgataagaagagcatcctgatgtacataacgagcctgttccaggtgctgccccaacaggtttcaatcgaggcgattcaagaggttgaaatgttgcccaggccaccaaaggtgactaaagaggagcatttccagcttcatcatcagatgcactacagccagcagattacagttagcctggctcagggttacgagaggacatcaagcccaaagcctaggtttaagtcctacgcctatacccaggccgcctatgtgactacgtcagatcccaccaggtccccatttccaagccagcatctggaagctccggaagacaaatcttttggaagctcactgatggagtctgaagtgaatctggataggtatcagaccgcactggaggaggtactctcttggttgctgagtgcggaggacaccctgcaggcccagggagagatctccaacgatgtagaggtagtgaaggatcagttccatacacacgaagggtatatgatggatctcacagcccatcaggggcgcgtgggcaacatcctgcagcttgggtccaagctgatcggcaccggaaaactctctgaggacgaggagaccgaggtccaggaacagatgaacctgttaaactcccgttgggagtgccttcgcgtggcctccatggagaaacaatctaatctccaccgggagattagttacgtgccatcaacttatctaacggagatcactcacgtatctcaggcactactggaagtggagcagctcctgaacgcccccgacctttgtgccaaggatttcgaggatctgtttaaacaggaggaatccctgaagaacatcaaggattccctgcagcagtcctctgggagaatcgacatcatccactccaaaaagaccgccgcccttcagagcgcaacccccgtagagcgggtcaaactccaagaggcacttagccagctggattttcagtgggaaaaagtaaacaagatgtacaaggatagacagggcagatttgatcgcagcgtggagaagtggaggcgtttccactacgacataaaaatcttcaatcaatggctgacagaggctgagcagttcctaagaaaaacgcagattcccgagaactgggagcatgctaagtacaaatggtatctgaaggagctgcaagatggtattggtcaacggcagactgtggtccgaaccctgaacgctacaggtgaagaaatcattcagcaaagctctaaaactgacgcaagcatcctgcaggagaaacttggatccttgaaccttcgctggcaggaggtgtgtaagcagctttccgaccgaaaaaagcgcttagaggagacattagagcgtctgcaggaactgcaggaggcaacagacgagctggacttgaaattacggcaggctgaggtgattaagggtagctggcaacctgtcggcgaccttcttatcgacagtctacaagaccacctggaaaaggtgaaggccctgcgaggtgagattgcacccctgaaggagaacgtgagccatgtcaatgatcttgcacggcagcttacaaccttggggatccagctgtccccctataacctgtcgaccctggaggatctcaacacacgatggaaactgttgcaagtggccgtggaagatagggtgaggcaactgcacgaagctcatcgcgactttggcccggccagtcaacactttttatctaccagtgtccaggggccatgggaaagagctattagccctaataaggtaccctattacattaaccacgagacccagaccacatgttgggaccatccaaagatgactgagttgtatcagtccttggcggatttaaacaacgtgagattttcggcttatagaaccgcgatgaagctcagaagacttcagaaagctttgtgcctggatctcctatccctgtcggcagcatgtgacgctctcgatcagcacaacctaaagcagaatgaccagccaatggatatcctgcagatcatcaattgtctgaccactatctacgacaggctcgaacaagaacacaataatctcgtgaatgttcccctctgcgtggacatgtgcctgaattggctcctgaatgtctatgataccgggaggactggccgaattcgcgtgctgtcatttaagacaggcataatttccctgtgcaaggcacacctggaggataaatatcgctatttgttcaagcaggtcgcttcgagcactggattctgcgatcagcgaaggcttggtctgctcctccatgactctatccaaatccctcgccagctgggtgaggtcgcatcttttggtgggagcaatatcgaaccaagcgtgcgctcttgtttccaattcgcgaacaacaagcctgaaatcgaggcagccctctttctcgattggatgagactggagccccagtccatggtgtggctccctgtcttacaccgggtggcagccgctgagaccgcaaagcatcaggcgaagtgcaacatctgcaaggagtgccccatcatagggtttaggtatagatctctgaagcatttcaactacgacatttgccagtcctgcttcttctccgggagagtagccaaaggacataagatgcactatcctatggtcgaatactgcacacctacaacctcaggtgaagacgtccgcgacttcgcaaaagtcttgaaaaacaaatttcggacgaagcgatatttcgcgaaacacccccggatgggatacctgcccgtgcaaacggtgcttgagggggacaatatggaaaccgacacaatg

SEQ ID NO: 251366 - DNA, 3432 bp, Artificial Sequence
  Description of Artificial Sequence: Synthetic coding sequence
atgctctggtgggaagaggtggaggattgctacgaacgggaagacgtccagaagaagactttcaccaagtgggtgaacgcgcagtttagtaagtttggaaaacagcatattgagaatctgttttccgatcttcaggatgggcgccggctactcgatctgttagaaggcttgacaggtcagaagctgcctaaagaaaagggcagcaccagggttcatgcgttaaataatgtgaacaaggctctacgagtcttgcagaataacaatgtggacctcgtgaatattggatccactgatatagtagacgggaaccataagttgactctgggcttgatttggaacataattttgcactggcaggttaaaaatgtcatgaaaaacattatggctgggctacaacagacgaactccgagaagatattactgagctgggtgcgtcaaagcaccaggaattaccctcaggtgaacgtgattaacttcactacgtcatggagcgacggtttggcacttaatgcgttgatccactcgcacagaccggacctattcgattggaattcagtggtgtgccagcagtctgctacacagagactggagcatgccttcaacatcgctcggtatcagctggggatcgaaaagttgctcgatcccgaggacgtcgacacaacctatcccgataagaagagcatacttatgtacattacctccctcttccaggtgctcccacagcaggtgagcatcgaagcaatccaagaggtcgaaatgttgcctcgccctccgaaagtgactaaagaggagcacttccagctgcatcaccagatgcactacagccagcaaattacagtctcactcgcccagggttatgaaagaacatcgtcccccaagcctaggttcaagagctacgcgtacactcaggctgcatacgtcaccacctccgatcccactagatcgccgtttccgtctcagcaccttgaggcacctgaagataaatcctttgggtcatcactgatggagtctgaagtgaacctcgatcgttatcagactgctctcgaagaggtactcagctggctgttgagtgctgaagacactctgcaggcccaaggcgagattagcaatgatgtggaagtggtaaaggaccaatttcatacccatgagggctatatgatggatctaacagcacaccaaggccgagtgggaaacatcctccagctgggctctaaactgattggtaccggtaaactaagtgaggacgaagagacggaagtccaggagcaaatgaatctgctcaacagccgttgggagtgtctacgagtcgcttccatggaaaagcagagcaatttacatcgcgagatctcctacgtgcccagcacatatcttaccgaaatcacacatgtgtcgcaggcgctgttggaggtggaacagctcctgaacgccccggacttgtgtgccaaggatttcgaagacttatttaagcaggaggaaagcttgaaaaatataaaagatagcctccagcagagttccgggcgaattgacattatacattcaaaaaagactgctgcacttcagtctgctacacccgtggagagagtcaaattgcaggaagcgctctcccaactcgacttccagtgggagaaagtgaacaagatgtataaggaccgacagggacggttcgaccggtccgtcgaaaagtggcggcgattccactacgacattaaaatcttcaaccagtggttgacagaagccgagcagtttctgcgaaagacacagatccctgaaaattgggaacacgccaaatataaatggtacctgaaggaactgcaggatggtattgggcagcgtcagacagttgtgaggacactaaatgctaccggggaggaaatcatacagcagtctagcaagacggatgcgtcaatcttgcaagaaaaactgggatctctgaatctgagatggcaggaggtgtgtaagcagctttctgataggaagaaacgtctggaagagactctcgagagactgcaggagctccaagaagcaaccgacgagttggatctgaaactaagacaggccgaggttatcaagggcagttggcaaccagtaggcgatcttttgattgactccttgcaggaccacctcgagaaggtcaaggccctgcgtggggagatagcccctctcaaggaaaacgtgagtcacgttaacgatctggccagacagctgactaccctgggcattcaattgtcaccctacaacctgagcaccctggaggacctcaatactcgatggaagctccttcaggtcgctgtggaggatagggtgagacagcttcacgaggcccatcgcgactttggtcccgcctcacagcattttttatctaccagtgtccagggaccatgggaacgggccattagtcccaataaagtaccctattatattaatcacgaaacacagactacttgctgggaccacccaaaaatgacagagctttaccagtcacttgcagacctcaataatgttcggttcagcgcctaccgcactgccatgaagctccggcggctccaaaaggcgctttgccttgaccttctgagtctgtcagccgcctgtgacgcactggatcagcacaacttgaaacagaacgaccagcctatggatatactgcagatcattaattgcctaacgacaatctatgacagactagaacaggagcataacaatctggtgaatgtgccactgtgcgtggatatgtgtctcaattggcttctcaacgtgtacgacaccggcagaacagggcggataagggttctttcttttaaaaccgggattataagcctctgtaaggctcacctggaggataagtatagatacctgttcaaacaggttgcaagctcaacggggttttgtgatcagcgtagactcggcttactgttacatgattccattcagatccccagacaactcggagaagtggcatcattcggcggctctaatatcgaaccatccgtcaggtcttgcttccagttcgccaataacaagcctgagattgaggctgctctcttcctcgactggatgaggttagagccacagagcatggtttggttgcctgtccttcatagggttgcagcggccgaaactgccaagcaccaggccaagtgtaacatatgcaaagaatgtccgattattgggttcaggtataggagtctaaaacattttaactatgacatctgccaaagctgttttttctctggaagggttgcaaaaggccacaagatgcactaccccatggtggagtattgcaccccaacaacctctggtgaggacgtccgggacttcgcaaaagttctgaagaataagttcaggacaaaacggtatttcgccaagcaccctaggatggggtacttgcccgtccagactgtgctggaaggggataacatggagacggacaccatg

SEQ ID NO: 251367 - DNA, 3432 bp, Artificial Sequence
  Description of Artificial Sequence: Synthetic coding sequence
atgctgtggtgggaggaagtcgaggattgttatgagagagaagacgtccagaaaaagaccttcaccaagtgggttaatgcccagttttcgaaattcggcaagcagcatatcgaaaacctgttctctgatctccaggatggccgtcggttgctcgatctactggaaggcctgaccggccaaaagttaccaaaggaaaagggatctacccgtgtccatgctcttaacaacgtcaataaggccctccgcgtcttgcaaaataacaacgtggacctggtgaatattggtagcaccgatatcgttgatggcaaccacaagttgaccttaggcctcatctggaacattatcctccactggcaagtcaaaaatgtaatgaaaaacatcatggccggactccagcagactaattccgagaagatcctgctgtcgtgggtgcgtcagagtacacggaattacccgcaagtaaacgtaataaacttcaccacgtcctggagcgatggcctggccctgaacgcgttgattcactcgcaccgcccagatctgtttgattggaactcggttgtttgccagcaatccgccacgcagcgcctcgagcacgcttttaacatcgctcggtaccagctcggcatcgagaagcttctggatccagaagacgttgacacgacctacccggacaagaaatccatcctgatgtacattacgagtctgtttcaagtcctgccccagcaggtttcgatcgaggccattcaagaagtggagatgctacctcgcccaccaaaggtgacaaaagaggagcatttccagctacatcaccagatgcattactcccaacagattactgtgtccttggctcagggctacgagaggaccagttcgcctaaaccacgcttcaaatcatacgcctatacccaggcggcttacgtcacgacctccgacccaacgcggtccccattccccagccagcatctggaggctccggaggataagagtttcggctcgagtctgatggagtccgaagtgaacctggatcgataccaaaccgccctagaggaagtcctgtcttggctgctctccgcagaggacacattgcaagcccaaggagagatctcgaacgatgtcgaggttgttaaagaccagttccatacccacgaagggtacatgatggacttgaccgcacatcagggacgtgtgggcaacatcctgcaactcggaagcaagctgattggtacagggaagttaagcgaggacgaggagaccgaggtgcaggaacaaatgaatttgttgaattcacgctgggagtgcctgagggtggcctccatggaaaagcagtctaacttgcatagagagatcagttatgtcccatccacctacctcacggaaatcacacatgtttcccaggctcttctggaggtggagcagctgttgaacgcccccgacttgtgcgcgaaggattttgaagatctattcaagcaggaggagagcctgaaaaatattaaggatagcctgcagcagtcctcagggcgaattgatatcatccactcaaagaagacagcagcgcttcagtccgcgacgccggtggagagggtgaagctgcaggaggctctaagtcagctggacttccaatgggagaaggtgaacaagatgtacaaggaccgtcagggacgcttcgacaggagcgtcgagaagtggcgtagattccactacgacattaagatttttaaccagtggctgactgaggcggagcaatttttgaggaaaacccagatccccgagaactgggagcatgccaagtataagtggtatttgaaggaactgcaggatggaataggacagcgccagaccgtggtgaggacattgaacgccacgggagaagagattattcaacagagctcaaaaactgatgcgtcaattctgcaagagaagttgggcagcctgaacctgcgatggcaagaggtttgcaagcagctgtccgaccgcaagaagcgactggaggaaaccttggagcgtcttcaagaattacaggaagcaacggacgagcttgatctgaagctgcggcaggccgaagtgattaagggtagctggcagccagtgggtgaccttttgattgactctctgcaggatcacctagagaaggtcaaggcgttgcggggtgagatcgcacctctgaaggaaaacgtttcccatgtcaatgaccttgccagacaattaactaccctaggtattcagttaagcccgtataatctgtccaccttagaggatctgaacacccgctggaagctgttgcaggtggccgttgaggatcgggtgcgccaactgcacgaggctcacagagattttggcccggccagccagcacttcctaagcacgagtgttcagggaccctgggaaagggctatctccccgaataaggtaccgtattacataaatcatgagacgcagaccacctgctgggatcatcctaagatgaccgaactataccaatccctggcggatttgaacaatgttaggtttagcgcctatcgcactgccatgaagctgcgccggctgcagaaagccttgtgtttggatttgctgtccctctccgctgcctgcgacgcactggaccaacacaacttgaagcagaatgatcaacccatggacattttgcagatcatcaactgcctgaccactatctacgaccggctcgaacaggagcacaataacctggtgaatgtgcccctgtgcgtagacatgtgtctgaactggttgttgaatgtttatgatactggtagaaccggccgcatcagggtgctgagctttaaaacgggaatcatctccctgtgcaaggcgcatctagaggataagtaccgctacctgttcaagcaggtagcttctagcactggtttttgcgaccagcgtcgactgggcttgctgttacacgatagtattcagataccgcgccagctcggagaagttgcttccttcggtgggtccaacatagagccctcggtgcgttcctgcttccagttcgccaacaacaagcccgagatcgaggccgctctattcctagattggatgaggttggagccccagagtatggtctggctgcccgtactacatcgcgtggccgccgccgagactgccaaacaccaggctaagtgcaacatctgtaaggagtgcccgatcattggattccggtaccggtccctgaagcactttaactatgatatatgtcaatcgtgctttttctccggccgtgtggcaaaaggccacaaaatgcactatcctatggtggaatactgcactcctacaacctcgggcgaggatgtcagggatttcgcaaaggtgcttaagaacaagttccggaccaaacggtactttgccaaacaccctcgcatgggatacttgccggtgcagaccgtgttagagggcgataatatggagactgatacgatg

SEQ ID NO: 251368 - DNA, 3432 bp, Artificial Sequence
  Description of Artificial Sequence: Synthetic coding sequence
atgctatggtgggaagaggtggaagactgttatgaacgggaggatgtgcagaagaaaacatttactaaatgggtcaacgctcagttctctaaatttgggaaacagcacatcgagaaccttttctccgacctgcaagacggaagacgtttactagatttgttggagggcctcaccggtcagaaactgccaaaagagaagggctccacaagagtgcatgcactaaacaacgtaaataaggcactgcgcgtattgcagaataataatgtggatctggttaatataggctccactgatattgttgatggtaaccataagctgacactgggcctgatttggaacataatcttacattggcaggtgaaaaacgtaatgaagaacatcatggcgggattgcagcagactaacagtgaaaaaattctcctgagttgggttcgtcaatccaccagaaattacccccaggttaatgttatcaactttacaactagttggtctgatggcttggccctgaatgccctgatacattcacaccgtcccgacctttttgactggaacagcgtggtgtgccaacagagcgcgacgcagcggttagagcatgcgttcaacattgcccgctatcaactcggcatcgagaagttgctggatccggaggacgttgacacaacctacccagacaagaagtccattctgatgtatattacttctctgtttcaggtgctgccccagcaggtgtctattgaggccattcaggaggtcgaaatgctgccacgcccacccaaagttacaaaagaagaacatttccagctgcaccaccagatgcactattcacagcagatcacagtaagcctagctcaggggtacgagagaaccagctcaccgaagcctaggttcaaaagttatgcctatacccaagctgcttatgtgactacttcagatcctacaagatctccttttcccagccaacacctcgaagcacctgaggataagtccttcggcagctccctcatggagagcgaagtcaatctcgacagataccagacagctttagaggaggtgctgtcctggctgcttagcgcggaggatactctgcaggcgcagggagagatttccaacgatgttgaagtggtcaaagatcaattccacacccatgaggggtatatgatggatctgactgcgcaccagggaagagtggggaatattctgcaactcggttcaaagttgattgggaccggcaagctgtccgaagacgaggaaactgaagttcaggaacagatgaacctgcttaacagtcggtgggaatgtctgcgcgttgccagtatggagaaacaaagcaacctgcacagagagattagttatgtgccttccacctaccttacagagattacacacgtttcgcaggccctgctggaggtagaacagctgctgaatgctccagacctgtgtgcaaaagatttcgaagatctgttcaagcaggaggagtctctgaagaacattaaggattccctgcagcagagcagcggccggatcgatattattcattccaaaaagaccgcagccctacaatccgccacaccagtagagagggtgaagctgcaggaggctctgagtcagctggactttcaatgggaaaaggtgaataagatgtacaaggatcggcaaggccgattcgatcgctctgtggaaaagtggaggcgcttccattacgacattaagatcttcaatcagtggctcaccgaggccgaacaatttctgcggaagacccaaattcccgagaattgggagcacgctaaatacaagtggtaccttaaagaactgcaggatgggattggacagaggcagaccgtggtccgaacactaaatgcaaccggggaggaaatcattcagcaaagctcaaagacagacgccagcattttacaggagaagctgggaagcttaaatctgagatggcaagaggtgtgtaaacaactctccgacagaaagaagcgattggaagagactctggagaggctccaagagttgcaggaagcgactgacgagcttgatctgaaacttcggcaagcagaggtgattaagggaagctggcagcctgtgggagacctgttaatcgattccctgcaagaccatcttgaaaaggtaaaagccctgcggggcgagatcgcaccacttaaagaaaatgtcagccatgtgaatgacctggcccggcaactaacgaccctcggcattcagttatctccatacaatctctctacactggaagacttgaacacccggtggaagctgctgcaggtggccgtggaggatcgggtgagacagctgcacgaagcccatcgcgattttgggcccgcctcccaacactttctaagcacctcagttcagggcccttgggaacgggccatcagtccgaacaaggtgccttattacatcaatcacgaaacccagaccacttgttgggaccaccccaaaatgactgaactgtaccaaagcctggcagacctgaataatgtacgattctcagcttatagaaccgctatgaaactgcgacggctccaaaaagcactgtgtctggaccttctgtctctgtccgcagcctgcgacgcactggaccagcacaacttgaagcagaacgaccaaccgatggacattctgcaaattatcaattgtcttacgactatctatgatagactggaacaagaacacaacaacctcgtgaatgtgcctctgtgcgtagatatgtgcctcaattggctccttaacgtctatgatactggtagaacagggcggatcagggtcctctctttcaaaaccggaataatcagcttgtgtaaggctcatctggaagacaaatatcggtacctgtttaagcaggtagcttcgagtaccggtttttgcgatcagcgacggctgggtctgctgctgcacgactctatacagattccacggcagctgggcgaggtcgctagtttcggagggtccaatatagaaccatccgttagaagctgctttcaattcgcaaacaataagccggagattgaggctgctctgttcctggattggatgaggctcgaaccgcagagcatggtgtggctcccggtcctgcaccgtgtggctgcagctgaaaccgccaaacaccaggctaagtgcaatatctgtaaagagtgccccatcattggatttcgctatcgctctctgaaacactttaactatgatatatgccagagctgctttttttccggcagagtcgcaaagggccacaagatgcactatcccatggtcgagtactgtaccccaactaccagtggcgaggacgtgcgagacttcgctaaggtacttaaaaacaagttccgaaccaagcggtacttcgctaagcatcccaggatgggctatcttcctgtgcagaccgtattagagggtgataacatggagaccgatacaatg

SEQ ID NO: 251369 - DNA, 3432 bp, Artificial Sequence
  Description of Artificial Sequence: Synthetic coding sequence
atgctgtggtgggaggaagtggaagattgttacgagagagaggacgtgcagaagaaaactttcactaagtgggtgaacgctcagttctcaaagtttggaaagcagcacattgaaaacctcttcagcgacctgcaggacggacgccgcctccttgacttgctggaaggcctgactggacagaagctcccgaaagagaagggatccactagggtgcacgccttgaataatgtgaataaggcgttgcgcgtcctgcaaaacaacaacgtcgaccttgtcaacatcggaagcactgacatcgtggacggcaatcataaactgaccctgggcctcatctggaatatcatcctgcactggcaagtgaagaatgtaatgaagaacattatggctggcctccagcagaccaattcggagaagattttgctgtcgtgggttagacagtcaactagaaattaccctcaagtcaatgtgatcaacttcactacttcctggtcggatggactcgccctcaacgcacttatccatagccatcggcctgacctgtttgattggaattcagtggtgtgccagcagtccgccactcagaggctggagcacgctttcaacatcgcaagataccagctcgggatcgaaaagttgctggaccctgaagatgtggacactacctaccctgataagaagtccattctgatgtacattacgtcgttgttccaagtgctccctcaacaagtctcgatcgaggccatccaggaagtcgagatgctccccagaccgcccaaggtgaccaaagaggaacacttccagctccaccatcagatgcattactcgcaacagatcactgtgtccctcgctcagggatacgagcgcacctccagccccaagccgcgctttaagagctatgcatacactcaggcggcatacgtcacgacttcggacccaactagatcgcctttcccgagccaacacctggaagcacctgaggacaagagctttgggagctccctgatggagtcggaggtgaatctggaccgctaccaaactgcgctcgaagaagtcctgtcctggctcctgtctgccgaggacaccctgcaggcacaaggagagatcagcaacgacgtggaagtggtcaaggatcagttccacactcacgagggatacatgatggatcttaccgcgcatcagggacgagtgggaaacatcctgcaactgggctcaaaactcatcggaaccggcaagctctcggaggatgaagaaactgaggtgcaagaacaaatgaaccttctcaactcccgctgggagtgtctgagggtcgcgtcgatggaaaagcaatcgaacctgcatcgggagatttcctacgtcccatccacttacttgaccgaaataacccacgtttcccaggccctgctggaagtcgagcagctgctgaacgcacctgacctgtgtgcaaaagacttcgaggatctgttcaagcaagaagaatcgctgaagaatatcaaggactcgctccagcagagctccggacggatcgacattatccactcgaaaaagactgctgccctgcagtcggccactcccgtggaacgagtgaagctccaggaagcgctgtctcaactggatttccagtgggaaaaagttaacaagatgtacaaggacagacagggcagatttgacaggtcagtggaaaaatggcggagatttcactatgacatcaagattttcaaccagtggctgactgaagcggaacagttcctgcgaaagactcagattcctgaaaactgggagcacgccaagtacaagtggtatttgaaagagctgcaggatggcatcggacaaagacaaaccgtggtgagaaccctgaacgccactggtgaggagattattcagcagtcctccaagactgatgccagcatcctgcaggagaagctcggatcactcaatttgcgctggcaggaagtgtgcaagcagctgtcagaccggaaaaagcgcctcgaagaaaccctcgagcgtctccaagagctgcaagaagcaaccgatgagctggatctgaaacttcgacaagctgaagtcatcaagggatcgtggcagccggtgggcgatcttctgatcgactcattgcaagatcatctcgaaaaggtgaaggccctccggggagagattgcgccactcaaggaaaacgtgtcccatgtgaacgatcttgctagacagcttactactctcggaatccagcttagcccctataatcttagcaccctggaggatctcaataccaggtggaagctgttgcaggtggccgtggaggaccgggtcaggcagctgcatgaggcacacagagattttgggccggcaagccagcatttcttgagcacttctgtgcagggaccttgggagcgcgcgatctccccaaacaaagtgccgtactacatcaaccacgaaacccagacgacttgctgggatcacccgaagatgaccgagctctaccagtcactggcggatctgaataacgtgcggttctcagcgtaccggaccgcaatgaagttgcggcgcctgcagaaggccctgtgcctggacctgttgtccttgtcggctgcctgcgatgccctggaccaacacaaccttaagcagaacgatcagccgatggatatactccaaatcattaactgcctgactactatctatgaccggctggagcaagagcacaataacctggtgaacgtgccgctttgtgtggacatgtgcttgaactggctgctgaacgtgtacgataccgggcggactggcagaatcagagtcctctcgtttaagaccggtatcatttcgttgtgtaaggcccatctcgaggacaagtaccgctacctgttcaaacaggtcgcctcctctactggtttttgcgatcagaggcgcctgggtctgctcctgcacgactcaatccagatccctcgacagcttggagaggtggcctcatttggaggcagcaatatcgaaccgtcagtccgcagctgcttccaattcgccaataacaagccggaaatcgaagccgccctgttcctcgattggatgcggctggaaccacagtccatggtgtggcttccggtgctccaccgggtcgcggccgcagaaaccgctaagcaccaggcgaagtgcaatatctgcaaggaatgtcctatcattggatttcgttaccgctccttgaagcatttcaactacgatatctgccagtcatgtttcttttccggccgcgtggcaaagggacataagatgcactacccgatggtggagtattgcaccccgactacttccggtgaggacgttcgcgatttcgcgaaggtgctcaagaacaaattccgcactaagcgctacttcgcaaaacacccgcgcatgggatacttgccagtccagaccgtgttggagggtgacaacatggagactgataccatg

SEQ ID NO: 251370 - DNA, 3432 bp, Artificial Sequence
  Description of Artificial Sequence: Synthetic coding sequence
atgctgtggtgggaggaggtcgaggactgctatgagcgagaggatgtgcaaaaaaagactttcacaaaatgggtgaatgcccagttcagcaagttcggtaagcagcatatcgaaaatctgttctctgatcttcaggacgggcgtaggctccttgacctgctcgagggactgactgggcagaagctccccaaagaaaaagggagtacaagagttcatgcactgaataacgtgaacaaggcattaagagttcttcagaataacaatgtagacctggttaacatagggagcactgatatcgtggacggaaaccataagcttaccctcggactcatttggaacatcattctgcactggcaagttaaaaatgtgatgaagaatatcatggccggcctccagcagaccaacagcgaaaaaatcctgctgtcttgggtccgtcaatccactcggaactacccccaggtcaacgtcatcaacttcacaacatcttggagcgacggactggccttgaatgccctgatccactcgcacaggcccgacttattcgattggaattccgtggtttgtcagcaaagcgctacacagcgactggaacatgcttttaacatcgcccgctaccagctgggtattgaaaagctgctggaccctgaagatgtggatacaacctaccctgataaaaaaagtattcttatgtatatcacctccctgttccaagtactgccacaacaggttagcatcgaggcaatacaggaggttgaaatgttaccgcgccccccaaaagtgaccaaggaggaacacttccagctgcaccaccagatgcactactctcagcaaatcaccgtgtccctggcccagggctatgagagaacttcctcccccaaaccccggtttaaatcttatgcctacacccaggcggcctatgtgacgacttccgaccccacacggtctccgttcccaagccagcatctagaggctcccgaggacaagagttttggctcttccttaatggagagcgaagtgaatcttgaccggtaccagacagcactggaagaggtgcttagttggttactatccgccgaagacacattgcaagcccagggcgagatttctaacgacgtggaagtggtgaaagaccagtttcacacccatgaagggtacatgatggacctgacagcccaccaaggacgggttggcaacattctgcagctaggaagcaaacttataggcacagggaaactgtcggaagacgaggagactgaggtgcaggagcagatgaacctgttaaatagcaggtgggaatgtctcagagttgcgagcatggagaaacaatcaaacctgcacagggagattagttatgtacccagtacgtacctgactgaaatcacgcatgtatctcaggccctgctcgaagtagaacagctgcttaacgcaccggacctatgcgcgaaggattttgaagatttgttcaagcaagaggaaagccttaaaaatataaaggattctttgcaacagtcctccgggaggatcgacatcattcactcaaagaaaacggctgctctccagagcgctaccccggttgagagggttaagcttcaggaagccctgagccagcttgacttccagtgggagaaagtgaacaaaatgtataaggaccgacagggcaggttcgataggagcgtcgagaagtggcgccgcttccactatgatatcaaaattttcaaccaatggctgaccgaggctgagcagttcctgaggaagacacagattcctgaaaattgggagcacgccaagtacaagtggtacctgaaggaattacaggacgggatcggccaaagacagaccgttgtccgtacactaaacgcaactggcgaggagatcattcagcagtccagcaaaaccgacgcttccattctacaagagaaactaggcagcctcaacttaaggtggcaggaggtctgtaagcagctgtccgacagaaagaagaggctagaggagacgctcgagcgccttcaggaactacaagaagctactgacgaactggatctaaagcttcgccaggccgaggttatcaagggatcttggcagcccgtcggcgacctgttgatagactcactgcaggatcacctggaaaaggtgaaagctctacggggagagatagcccctctgaaagagaatgtgagccatgtcaatgatctggcaagacagctcaccactctgggaattcagctaagcccgtataacttgagtactctggaggatttgaatactcggtggaaattgctgcaagtcgccgtggaagacagggtgaggcaacttcacgaagcccatcgagacttcggcccagccagccagcattttctctctaccagtgtccaaggcccctgggagagagcgatctcacctaacaaggtgccctactacattaaccatgaaacacagaccacgtgttgggatcatccaaagatgacagaactgtaccaaagcctggccgacttgaacaatgtccgtttctctgcataccggaccgcaatgaagctaagacggcttcagaaggccctgtgtctggatctgctcagcttatcggccgcctgtgacgcactcgatcagcataatctcaagcagaacgaccagccaatggatattctccagataatcaactgtctcacaaccatttacgatcgactcgagcaggaacacaacaaccttgtaaacgtacctttatgcgttgacatgtgcctgaactggctcctgaacgtctacgatacaggacgcacaggcagaatcagagttctgtcctttaagaccggcattatttctctgtgcaaggctcacttagaagacaaataccgctatttgttcaagcaggtggcctccagcactgggttttgtgatcaacgaagattgggacttctgctccatgatagtattcagatcccaagacagttgggcgaggttgcttcatttggagggtctaatattgagccatcagtgagatcctgtttccaattcgctaacaacaaaccggagatcgaggcagcattatttctagattggatgcgtctcgaacctcagagtatggtctggttgcctgtcctgcatcgcgtggcggccgccgagacggctaaacaccaggcaaagtgcaatatttgcaaggagtgccccattattggcttccgctaccgttcattgaagcattttaactacgacatctgccagtcatgtttctttagtgggcgcgtcgccaagggacataagatgcattaccctatggtcgagtactgtaccccaaccacatcgggggaggatgtgcgcgattttgccaaggtgctcaaaaataaatttcgcactaaacgctatttcgcaaagcatccaagaatgggctatctcccagtgcagaccgtgctggagggcgataatatggagacagataccatg

SEQ ID NO: 251371 - DNA, 3432 bp, Artificial Sequence
  Description of Artificial Sequence: Synthetic coding sequence
atgctgtggtgggaggaagtcgaagactgttacgagcgcgaggacgttcaaaagaaaacgtttaccaagtgggtcaacgcacagttttccaagttcgggaagcagcatatcgagaacttgttcagcgacttacaagatggtagacgcttactggatctactcgagggtctgaccgggcagaaactgcctaaggagaagggaagcacaagagtccacgcgctaaataatgtcaataaggctcttcgggtcctccaaaataacaacgtggacctggtcaatatcggctccaccgatatcgtggacggaaaccacaagctcacgttgggccttatttggaacatcatcttacactggcaggtgaagaacgtgatgaagaatataatggccggtcttcagcagaccaatagcgaaaaaatcctcctgtcctgggtaaggcagagcacacgaaactacccccaagtaaatgttattaatttcacgacctcctggtcggacgggctcgccctgaacgccctgatccactcacacaggcccgatctgttcgactggaactccgtggtatgtcagcagagtgcgacacagagattagagcatgctttcaacatcgcccggtaccagcttggaatcgagaagctcttagatcccgaggacgtggacaccacttatcccgacaagaaatccattttgatgtacatcacttcacttttccaggtgctgccacaacaagtcagcattgaagcaatccaggaagtcgaaatgctaccaagaccacccaaggttactaaggaggagcacttccagctccaccaccagatgcactattcgcaacagatcacagtcagtttggctcagggctacgagcgaacctcttcgcccaaaccaaggtttaaatcctacgcctatactcaggcagcatacgtgactacatcagaccccacccggagtcctttccctagccagcatctggaggcccctgaggataagtcttttggcagttccctgatggaatccgaagtgaatcttgacaggtaccagaccgccctggaggaggtcctgtcttggctcttgagcgctgaggataccctacaagcccagggggagatatccaatgatgtggaggttgtcaaggaccagtttcatacccatgaggggtatatgatggatctgaccgctcaccaaggacgggtgggtaacatactgcaactggggtctaaactcattggtaccggcaagttgagtgaggatgaggaaactgaagttcaggaacagatgaatctgttgaattctcgctgggagtgcctgcgcgtagccagtatggagaagcaaagcaatttgcatagggagatctcttatgtcccatcgacctatctgactgaaattactcacgtttctcaggcgctcctggaggtggagcagctgcttaacgcacccgatctgtgtgcaaaagattttgaagacctttttaagcaggaggaaagtctgaagaatattaaagatagtctgcaacagagctctgggaggatcgacataatccactctaaaaagaccgctgctctgcagagcgcgactccggtagaacgtgttaagcttcaggaggctctatcacagttggactttcaatgggagaaagtgaataagatgtataaggatcgccaaggccggttcgaccggtctgtggaaaaatggcgaagatttcactacgatatcaaaattttcaaccagtggctaacggaagctgagcagtttctgagaaagacacagataccagagaactgggagcatgccaagtataaatggtacttgaaggagctgcaagacgggattggccagcgccaaaccgtcgtccggacactgaatgcaaccggcgaggaaataatccagcagtccagcaagaccgacgctagcatacttcaagaaaaattggggtccctgaacttgcgctggcaggaggtatgcaaacaattgtcagatagaaagaaacgccttgaagaaaccctggagcgcctgcaggagctgcaggaggcaactgatgaactcgacttgaagctccggcaagctgaggtgatcaagggatcttggcagcccgttggcgacctcctgattgattccctgcaggatcacctcgagaaggtgaaggcactgaggggcgagatagcaccactcaaggagaacgtcagccacgtgaacgatctagccaggcagttgactacacttggcattcagctgtctccttacaatctctcaaccctggaggatctgaatacacggtggaagttgctccaggtcgcggtcgaggatcgggtacggcagctacatgaggctcacagagactttggccctgcctctcaacacttcctgagcacctccgttcagggaccttgggagcgagcgatctcccccaacaaagtgccgtactacattaaccacgaaactcaaacaacatgctgggaccaccctaagatgaccgagctatatcagtcccttgccgatctcaacaatgtccgcttctctgcataccgcactgccatgaagctcagaagactccagaaggccctgtgcttggacctgcttagcctaagcgcagcttgcgatgccctcgatcagcataatctgaaacaaaacgatcagcccatggatatccttcagattatcaactgcctcacaacaatctacgatcgccttgaacaagaacacaataatctcgtgaacgtgccgttatgtgtagacatgtgtctcaactggctgctcaatgtgtacgacaccggccggacaggcagaataagggtgcttagcttcaaaacaggtattatatcgctttgtaaggctcacttggaagataaataccgctatctgtttaaacaggtcgcatcaagtaccggattctgtgaccagcgcagattgggactactgttgcatgatagtatccagattccacggcagctgggcgaagtggcctcctttggaggttcaaacatagagccgtctgtccgatcctgcttccagttcgccaataataaaccagagattgaagccgctctcttcctggattggatgaggctggaacctcagagtatggtgtggcttccagtactgcaccgggtggccgctgctgaaaccgcaaagcatcaagccaaatgcaacatctgcaaagagtgtcctatcatcgggttccgctataggtcattgaagcacttcaactatgacatctgtcagagttgtttcttctctggcagggtagccaaaggccacaaaatgcactatcccatggtggaatactgtacccctactacatctggggaggacgtgagagacttcgccaaggtcttgaagaataagtttagaacaaagcgatacttcgctaagcaccctcgtatgggataccttcccgtgcagactgtattggagggggataatatggaaaccgataccatg

SEQ ID NO: 251372 - DNA, 3432 bp, Artificial Sequence
  Description of Artificial Sequence: Synthetic coding sequence
atgctctggtgggaagaagtggaagattgctatgagcgggaggacgtgcagaagaaaactttcaccaagtgggtcaacgcgcagttctctaagttcggaaagcaacacattgaaaatctgttctctgacctccaagacggaagaaggctgttggacctgctggaaggactcaccggacaaaagctgccgaaagagaaaggatcaacccgcgtgcacgcacttaacaatgtgaacaaagccctgagagtgctgcaaaacaacaacgtggacctcgtcaacattggatccactgacatcgtggatggcaatcacaagctgacgctcggtttgatctggaacattatcctgcactggcaggtgaagaacgtcatgaagaacattatggccggacttcaacagacgaattcggagaaaatcctcttgagctgggtccggcaatccacccgcaattacccacaggtgaacgtcatcaactttactaccagctggtccgacggactcgcgcttaatgctctgatccacagccataggccggatctgttcgattggaactccgtggtgtgccaacagtcggccactcaacggcttgagcacgccttcaacattgcgcggtaccagcttggaatcgagaaactcctggatccagaggacgtagacacgacctaccccgataagaagtcgatcctgatgtacattaccagcctgtttcaggtgctgccacaacaggtcagcatagaagcgattcaagaagtcgaaatgctcccgcgcccgccgaaagtcactaaggaggagcattttcagcttcatcatcaaatgcactattcccaacaaataactgtgtctctcgcgcagggatacgaaaggacttcgtcgccaaaacctagattcaaatcatacgcatacactcaggccgcctatgtgactactagtgaccctacccgctcgccattccccagccagcatctggaagccccggaggataagtcgttcggtagctctttgatggaatcggaagtgaacctggacagataccagacggccctggaggaggtgctgagctggcttctgagcgccgaagatacgctgcaggcacagggtgaaatctccaacgacgtggaggtcgtgaaggatcagttccacacgcatgaaggatacatgatggatctgactgcacaccaagggcgcgtgggcaatatcctgcagctcggatcgaagctgatcggaactggaaagctgtccgaagatgaggaaactgaagtccaggaacagatgaatctgctgaattcccgctgggagtgcctgcgtgtggcaagcatggaaaagcagtccaatctgcatcgcgaaatctcctacgtcccgtcaacctacctcactgaaatcactcacgtgtcacaggctctgttggaagtggaacagcttctgaacgcgccagatctgtgtgcaaaggactttgaggacctgtttaagcaggaagagtcactcaagaacatcaaagacagcctgcaacagtcctccggccggatcgacattattcattcgaagaaaaccgcggcccttcagtccgctactccggtcgagcgggtgaaacttcaggaggcactgagccagttggacttccaatgggagaaggtcaataagatgtacaaagataggcagggaaggttcgaccggagcgtggagaagtggagacgcttccactacgacattaagatctttaaccaatggctgacggaggctgaacagtttctgcgaaagactcaaattccagaaaactgggaacatgcgaagtacaagtggtaccttaaagaactccaggacggaatcggccagagacagaccgtcgtccgcaccctgaacgctaccggcgaagaaatcatccagcagtcctcgaaaaccgatgcgtccattctgcaggagaaactcggatccctgaatcttcgctggcaggaagtgtgcaaacagctgagcgaccggaagaagcggctcgaagaaacccttgagcgcctccaagaactgcaggaggcaactgacgaactggacctcaagttgcggcaggccgaggtcatcaaggggtcttggcagccggtcggcgacctgttgatcgattcactgcaggaccacttggagaaggtgaaggccctgcgcggcgaaatcgccccactcaaggaaaacgtgtcacatgtgaatgatctggctcggcaactgaccactttgggaatccagctgtcgccctacaatctgtcaacgctggaggacctgaatacccgctggaagttgctccaagtcgcagtcgaggaccgcgtgcgccaactccacgaagctcatagggattttggacctgcgagccagcatttcctctcaaccagcgtgcaagggccatgggagcgggcgatttccccgaacaaggtcccgtactacatcaatcacgaaacccagaccacctgttgggaccacccaaaaatgactgagctctaccagtcactggccgacttgaataacgtccgcttttcagcttaccgcaccgccatgaagctccgccgcctgcaaaaggccctttgcctggatctgcttagcctctccgcagcctgcgatgcgctcgatcagcacaacctgaaacagaacgatcaacccatggacatactgcaaatcatcaattgtcttactaccatctacgatcgactcgaacaggaacacaataacctggtgaatgttcccctgtgtgttgacatgtgcctgaactggctgctgaacgtgtatgacactgggcggaccggcagaatccgcgtcctctcctttaagactggaatcatctcactctgcaaggcgcacctggaagataagtaccgctacctctttaagcaagttgcgagctctaccggattctgtgaccaaaggagactgggactgctgctgcacgacagcatccagattccacgccagctcggagaagtggcctccttcggaggatcaaatatcgagccctccgtgcgctcttgcttccagttcgccaacaataagccggaaatcgaggcggcgcttttcctcgattggatgcgccttgagccgcaatccatggtgtggctcccggtgctgcatagagtggctgccgcggagactgccaaacatcaagcaaagtgtaacatctgcaaggaatgtccaatcatcggatttagataccgctcactcaaacactttaactatgacatctgccaaagctgctttttcagcggccgggtcgcgaagggacacaaaatgcattacccaatggtggagtactgcactcctaccacgtccggcgaggatgtgcgcgatttcgcaaaggtgttgaagaacaagtttagaactaaacggtacttcgccaaacatccacgcatgggttacctcccagtgcagactgtgcttgagggggacaatatggaaaccgacactatg

SEQ ID NO: 251373 - DNA, 3432 bp, Artificial Sequence
  Description of Artificial Sequence: Synthetic coding sequence
atgctgtggtgggaagaagttgaggattgctacgaacgcgaggacgtgcagaagaaaacctttaccaagtgggtgaatgcgcaattttcgaagtttggaaaacagcatatcgaaaacctcttcagcgacctgcaggacggacggcggctgttggacctgctcgaagggctgactgggcagaaactccctaaggagaagggctcgacccgggtgcatgcactcaataatgtgaacaaggctctcagagttctccaaaacaataatgtcgaccttgtgaacatcggttctactgatatcgtggatggcaaccataagttgaccctgggactcatctggaacatcattctgcactggcaggtgaaaaacgtgatgaagaacatcatggctggccttcagcaaaccaacagcgagaagatacttctcagctgggtgcgccagtccacccgcaattacccacaggtgaatgtcatcaatttcaccacctcctggtcagatggactggcacttaatgccctcatccatagccatcgcccagatctgtttgattggaactctgtggtgtgccaacagtccgccactcagagattggaacacgcattcaacatcgcacggtaccagcttggcatcgaaaaactcctggacccggaggatgtcgatactacctaccccgataagaagagcattttgatgtatatcacttccctcttccaggttctgcctcaacaagtctccatcgaagccatacaggaagtggagatgctgccacggccaccgaaggtcaccaaggaggaacatttccagctgcaccaccaaatgcattactcccaacaaatcactgtgtctctggcccaaggatacgagagaactagcagccctaaacctcgcttcaaatcatacgcatatacccaggccgcatacgtcactacctcggacccgactagatctcctttcccttcacagcacctggaggccccggaagataagtcgttcggaagcagcctcatggagagcgaagtgaacctggacaggtaccagacggcactggaggaggtcctgtcgtggctgctctccgccgaggacaccctgcaggcccagggagagatttcaaacgatgtagaagtcgtgaaggatcagtttcacacccatgaaggatacatgatggatctgacggcccaccagggccgagtgggaaacatactgcaattggggtccaagctcatcggaaccggtaaactttctgaggacgaagaaaccgaggttcaagagcagatgaacctgctgaattcgaggtgggagtgcctgcgggtggcctcaatggagaaacaatcgaaccttcacagagagatctcgtacgtgccgtcgacgtacctgaccgaaatcactcatgtgagccaggcactgctggaagtggaacaactcctgaatgcaccggacctgtgcgcaaaggactttgaggacctgttcaagcaggaagaatcactgaagaatatcaaagacagcctgcagcagtcatcgggacgcatcgacatcatccattccaaaaagacggctgccctgcagagcgccactcccgtggaacgggtgaaactgcaggaagccctctcacaactggactttcagtgggagaaagtcaataagatgtacaaggaccgccagggacggttcgaccgatcagtcgaaaagtggcggcgcttccattacgacattaagatctttaaccagtggcttaccgaagcggagcagtttttgcgtaaaacccaaattccggagaattgggagcacgcaaaatacaagtggtacctgaaagaattgcaagacggaattggacagcgccagacggtcgtccgcaccctgaatgccaccggtgaagagatcattcagcaatcatccaagaccgacgcctcaatcctccaagaaaagctggggagcctgaacctgcgctggcaggaagtgtgcaagcagctcagcgatagaaaaaagagacttgaagaaactttggagcgcttgcaggagctccaagaggccaccgatgaactcgacctgaaactgcggcaggcggaggtgataaagggctcctggcagccggtgggagatctgcttatcgactccctgcaagatcacttggaaaaggtcaaggcgctgcgcggggaaatcgctccgctcaaggaaaacgtgtcccatgtcaatgatctggcacgccagctgactactttgggaatccagctctcaccttacaacctgtccaccctggaggacctcaacactagatggaagctccttcaggtggctgtggaggatagagtgagacagctgcacgaggcacaccgggacttcggaccggcttcgcaacacttcttgtccacctcggtgcaaggcccttgggaaagggccatctcaccgaataaggtgccgtattacatcaaccatgaaacgcagactacttgctgggatcatccgaagatgactgaactgtaccagagcctggctgacctcaataacgtccgcttctcagcgtaccggacggctatgaagctgagacggctgcaaaaagctctctgtctcgacttgctgagtctctcagctgcgtgcgacgccttggaccaacacaacctgaaacaaaacgaccagccgatggacattctgcaaatcatcaactgtctcaccaccatctacgaccgcctggaacaagaacacaacaacctggtcaacgtgccgctgtgcgtcgacatgtgtttgaactggctgctgaatgtgtacgataccgggcgcaccggacgaatccgcgtgctctcattcaagaccggcatcatctcactttgcaaagcgcatttggaggacaaataccgctacttgttcaaacaggtggcctcaagtaccggattttgcgaccagaggcggctgggattgctcctgcacgactccattcaaatcccgagacagctgggagaggtggcctcgttcggaggatcgaatattgagcctagcgtgagatcgtgcttccagttcgcaaacaacaagccggaaatcgaggccgctttgttcttggattggatgagacttgaaccacagagcatggtgtggctcccggtactccaccgcgtggccgctgctgagactgctaaacatcaggccaagtgtaacatttgcaaggagtgtcctatcataggtttccggtacaggtcgctcaaacactttaactatgatatctgccaatcgtgctttttctcaggtcgggtggcaaaaggccacaagatgcactacccaatggtggagtattgcaccccaaccacttcgggagaggatgtgcgcgacttcgcaaaagtgttgaagaacaagttccgcaccaagaggtacttcgcgaagcacccaagaatgggctacctgcctgtgcagacggtgctggagggcgacaatatggaaaccgatactatg

SEQ ID NO: 251374 - DNA, 3432 bp, Artificial Sequence
  Description of Artificial Sequence: Synthetic coding sequence
atgctgtggtgggaagaggtcgaggattgctacgagcgagaagatgttcagaaaaagacattcactaaatgggtcaacgctcagttttctaaattcggtaaacagcacatcgaaaatctgttcagcgaccttcaggacggtaggcgtctgctggatctgctcgaaggattgaccggtcagaaactacctaaagagaagggaagtacacgggtgcatgcactgaacaatgtcaacaaggcgctgagagtcctgcagaacaataatgtcgatttggtgaacataggttctacagacatcgtggacggcaaccacaagctcactttaggcctgatatggaatatcatcttgcactggcaggtgaaaaacgttatgaaaaacattatggctggcctacagcagacaaactcagaaaagattcttctgtcatgggtgcgacaaagcacgcgtaactaccctcaggtcaacgtgatcaacttcactacatcctggagtgacggacttgctttgaatgccttaatccattctcaccgacctgacctcttcgactggaactccgtggtgtgccagcagtcggccacccagagattggaacatgcatttaacatcgcaagataccagctgggtatagagaaacttctggaccccgaagacgtggatactacgtaccccgacaagaaatcaatcctgatgtatattacgagtttattccaggtgcttccccaacaagtgtcaattgaagcaattcaagaagtcgagatgctacctagacctcccaaagtgacaaaagaggaacattttcaactccaccatcagatgcattatagtcagcaaatcacagtgagtctcgctcaagggtacgaaagaacttctagtcctaagccgaggtttaaatcatatgcttatactcaagcagcctatgtgaccacgagtgatccgacccgatctcccttcccatcacaacacttagaagctccggaagacaagtccttcggatccagcctgatggaaagcgaggtcaatctggataggtatcagacagcacttgaagaggtactctcgtggttactgtccgctgaagatactctgcaggcgcagggggagataagtaatgacgttgaggttgtgaaggaccagtttcacactcatgagggctatatgatggatctgacagcccatcagggcagagtgggcaatatacttcagttagggtccaaactgatagggaccggtaagcttagcgaggatgaggagactgaagtccaggaacagatgaatctgcttaacagccgatgggaatgcctgagggtcgccagcatggaaaagcagagtaacttgcatcgagagatcagctatgttcctagcacttatctaaccgaaataactcatgtctctcaggcactactcgaagtagagcagcttttaaacgctccagatctctgcgctaaagacttcgaagatttgttcaagcaggaagagtcccttaagaacatcaaagactccctccagcagtcaagcggccgaatagacattatccactcaaagaaaacagcagccctccagtctgccaccccagtggagcgggtaaaactacaggaggctttgtctcagttagacttccagtgggagaaggtaaataagatgtacaaagataggcagggcaggttcgatagatcagtcgaaaagtggaggaggtttcactacgatattaagatatttaatcagtggcttaccgaagccgaacagttcctccgaaagacacagattccagaaaattgggaacatgcgaagtacaagtggtacctgaaggagctacaggacggtatcggccagaggcagaccgtggttcgaactctgaatgctactggggaagaaataattcaacaatccagcaagacggacgcaagcatactacaggagaaactcgggagccttaatctgagatggcaggaagtctgcaagcagctctcggataggaaaaaacgacttgaggaaaccttggagcgccttcaggagctccaggaggctactgacgaactcgacctgaaactgaggcaggccgaggtcattaagggatcttggcagccagtgggggacctcctgatagatagcctgcaggatcacctggagaaagtaaaagccctgcgtggcgaaattgccccacttaaggagaacgtctcacacgtgaatgatctggcaagacagctgactactctgggcatccagctgagcccgtataacctgagcacattagaggacttaaataccaggtggaaactcttacaggtggctgttgaggaccgagtacgacagctccacgaggcccatagggacttcggtccagcttcccaacattttctgagtacgtccgtccaggggccctgggaaagggcaatcagccccaacaaggtgccttactacatcaatcacgaaacccaaacaacctgctgggatcatcccaagatgactgagctataccagtccctggctgatctgaataatgtgaggttttcggcttatcgaactgccatgaagctcaggcggcttcaaaaggctctatgtctggatctgctatctctaagcgccgcctgtgacgcgctcgaccaacacaatctgaagcagaatgaccagcctatggacatcctgcagatcattaattgcctcacgactatctatgacagactggaacaagagcacaataacttggttaatgttcccttgtgtgtggacatgtgtttgaactggctgctgaacgtttacgatactggaaggacaggcaggattagggtgctgtctttcaagactgggataatctctctatgcaaagcgcatctcgaggataagtacaggtacctgttcaagcaagtcgcgagcagcacaggcttctgtgaccaacgaagactgggtctcctcctccatgactctatccagattccacgacagctcggcgaggtggcttcgtttggcgggtctaacatagagccctctgtcagatcttgtttccagtttgcaaataataaacctgagattgaagcggccctgtttctcgactggatgcggcttgagccacagtccatggtttggctccccgtgttacaccgtgtggccgcagcggagacagccaagcaccaggcaaaatgcaatatctgcaaagagtgccctataatcggcttccgttacaggtcactaaagcactttaattacgatatctgtcagagttgcttttttagtgggcgggtcgccaagggacacaaaatgcattaccccatggtggaatactgtacccctacgactagtggggaggacgttcgagacttcgcaaaggttctgaagaacaaatttaggactaaaagatattttgctaagcatccccgcatgggttaccttccggttcagaccgtattggaaggcgataacatggaaacagatacaatg

SEQ ID NO: 251375 - DNA, 3432 bp, Artificial Sequence
  Description of Artificial Sequence: Synthetic coding sequence
atgctctggtgggaggaagttgaggattgttacgaaagggaagatgttcagaagaaaacgttcaccaagtgggtgaacgcccaattcagcaaatttggaaagcagcatattgagaatctgtttagcgatctgcaggatggacgcagacttcttgaccttcttgaaggcctcactggccaaaaacttccaaaagaaaaggggtcgactagggtgcatgcacttaacaacgtcaacaaggcgctccgggtgctccagaataacaacgtggacctggtgaacattggctccaccgatatcgtggatggaaatcacaaattgactcttggtctgatttggaacattatcctgcattggcaagtgaaaaacgtgatgaaaaacataatggcaggtctgcaacagactaactcggaaaagattttgctttcttgggtgcgccaatccacccgaaactacccccaagtgaatgtcataaacttcaccacttcctggtcggatggcttggcattgaatgcccttattcatagccatagacctgatctctttgattggaactcggtcgtgtgtcagcagtcagccactcaacgactcgaacatgcgttcaacatcgctcgttaccagcttgggatcgagaagctgctggatccagaagatgtggacactacctacccagataagaaatcaatccttatgtatatcacctcactgtttcaagtgctgccacagcaggtcagtatagaagcaattcaagaagtggagatgcttcctagaccccccaaggtcactaaagaggaacactttcagctgcatcaccagatgcactactcccagcagatcaccgtctcactcgcccagggttatgagcgcacctctagtcctaaaccaaggtttaagagctacgcctacactcaggcagcatacgtgaccacctcagaccccacgcgttcgccttttccctcacagcatcttgaagcccctgaagataagtcgtttggatcatccctcatggaatcggaagtgaatctggaccggtaccaaaccgcgctcgaagaagtcctgtcctggttgctgtcggcagaggacaccctgcaagcccagggcgaaatcagcaacgatgtggaggtcgtcaaggaccagtttcatactcatgaagggtacatgatggacctcacggcacaccagggtcgggtgggaaatatcctgcagctggggtccaagctgatcggaaccgggaaactctcagaagatgaagagactgaagtgcaggagcaaatgaatctgctgaactctaggtgggagtgtctgagagtcgcctcgatggagaagcaatccaacctgcacagagagatatcctacgtgccaagcacctacctgacggaaattactcacgtgtcgcaggcactgctggaagtggaacaactgctgaacgcaccggatctgtgtgctaaagacttcgaggatcttttcaagcaagaggaatcgctgaaaaacattaaagattccctgcagcaatcttctggccgcatagacatcatccacagtaagaaaactgcggcacttcagtccgcaactccggtggagagggtcaagctccaggaagccctctcgcaacttgattttcagtgggagaaggtcaataagatgtataaggataggcaaggtagatttgatcgttcagtggaaaagtggagaagatttcattatgacatcaagatattcaaccagtggctcaccgaagcagagcaatttctgcgaaagactcagattcccgagaactgggagcatgccaagtacaagtggtacctgaaggaactgcaagatggtattgggcaaagacaaaccgtcgttcgcactctgaatgccactggggaggagatcattcaacaatcctcgaaaaccgacgcttctattcttcaagaaaagctgggatcgcttaatctgaggtggcaagaagtgtgtaagcagctttcggatagaaagaagagacttgaggagactctcgaaagattgcaagaacttcaggaagccaccgatgagctggacctcaagctgcgtcaagctgaggtcataaagggaagctggcaaccagtcggagatttgctcattgacagcctgcaagaccatctggaaaaagtcaaagcccttcggggcgaaatcgcaccacttaaggaaaacgtctctcacgtgaatgatttggctcgccaactgacgacgcttggtatccagctctccccctacaacctttcaaccctggaagatcttaacactagatggaaacttctccaagtggcggtcgaagatcgcgtgcgtcagctgcatgaggcacatagggatttcggaccagcctcgcagcatttccttagcaccagcgtgcaaggtccttgggagcgcgcaattagccccaacaaagtaccctactacattaatcatgaaactcagactacgtgttgggatcatcctaagatgactgaactgtaccaatccctcgccgatctgaacaacgtccggttcagcgcctacaggaccgcgatgaagttgagacggctccagaaggcactttgtcttgatcttctcagcctttcggcagcatgcgacgctcttgatcagcataatcttaaacaaaatgaccaaccaatggatatcctccagattatcaattgccttactacgatttatgaccggcttgaacaagaacataacaatctcgtcaacgttccactgtgcgtcgatatgtgcttgaactggctccttaacgtgtacgacactggaagaacgggaagaattagagtcttgagctttaagaccggaattatcagcctctgcaaagcgcacctggaggacaagtaccgctacttgtttaagcaagtggcatcatcaaccggattttgtgaccagcggaggcttggactcttgctccacgattccattcaaatcccaaggcagcttggagaagtcgcctcatttggaggatccaatattgaaccttcggtcagatcgtgcttccaatttgcaaacaacaagcccgaaattgaggccgccctgtttcttgactggatgagactggagccacagtctatggtgtggctcccagtgctccatagagtcgcagcagcggaaaccgcaaagcatcaggcaaagtgtaacatttgtaaggagtgtccgataataggattccgctacaggtcccttaagcacttcaattacgacatttgtcagtcgtgctttttctctgggagagtggccaaaggacataagatgcattaccctatggtcgaatactgcactcctaccacttcaggagaagatgtgcgtgatttcgcgaaggtgcttaagaataagttcaggaccaagaggtactttgctaagcaccctagaatgggatacctccctgtgcagaccgtgcttgagggggacaacatggaaaccgacaccatg

SEQ ID NO: 251376 - DNA, 3432 bp, Artificial Sequence
  Description of Artificial Sequence: Synthetic coding sequence
atgctctggtgggaggaggttgaggactgctacgagcgcgaagatgtgcagaaaaagacatttactaaatgggtgaacgcccaatttagcaaattcggaaaacagcacatcgaaaatctatttagtgacctccaggacggaagaaggcttcttgacctcttagagggccttaccggccagaaattaccgaaggagaaaggcagcaccagagtgcatgccctaaataatgtgaacaaggccctgcgcgtgctgcagaataataatgtggatctggttaatatagggtctactgacattgtggatggcaaccacaaactgacattgggactgatctggaatataatcttgcactggcaggtgaagaatgtgatgaagaatattatggccggcctgcagcaaaccaattctgaaaaaattctgctctcttgggtgcgccaaagcaccaggaactacccacaggtcaacgttattaacttcactacttcttggagtgatgggctcgcattgaatgccctgatccattcacatagacctgatctttttgactggaactcagtggtgtgtcaacagagtgctacccagcgtcttgaacatgcgttcaacattgccagatatcagctaggcatcgagaagctgctggatccggaggatgtcgatacaacttaccccgacaagaagtctatcctcatgtacattacgtcgttgtttcaggtgctacctcaacaggtgagcattgaggctattcaggaagtggagatgctgcccaggccgcccaaagtaacaaaagaggagcactttcaactccaccaccagatgcactactcccagcagattacagtgtccctggctcagggctacgaacgaacgtcaagtcctaagcccagatttaagtcttatgcatatacccaagccgcttatgtgacaacgtccgacccgacccgctctccatttccctctcagcacctggaggcaccagaggacaaaagctttggtagcagtctcatggagtcggaggttaatctggaccggtatcagacagctctggaggaagtattgagctggctactaagcgccgaagacacgctccaggctcagggcgaaatctcgaatgatgttgaggtcgtgaaggatcagttccatacccacgaggggtatatgatggatctcacagcccatcagggccgtgtgggtaatatcctccagctcggcagcaaactcattgggacaggtaaactctccgaagacgaggaaaccgaagtacaggagcagatgaatctcttgaactcccggtgggaatgtctgcgcgtggcttctatggagaagcagagcaatctgcatagagaaatctcctacgtcccaagcacatatctcactgaaatcacacacgtctcccaggccctgttggaagtggaacagctgctgaacgcgcccgatttgtgcgccaaagacttcgaagacctgttcaagcaggaagaaagtctgaaaaacattaaggactctctgcagcagagttctggacggatcgatataattcacagtaaaaaaactgcagctctccagtccgccaccccagttgagcgagtgaagctgcaggaagctctcagccaactggacttccaatgggaaaaggtgaacaagatgtataaggatagacagggacgattcgatcggtccgtcgagaaatggcgccgattccactatgacattaaaattttcaatcaatggctaaccgaggcagagcagttccttaggaagacccagatccccgagaactgggaacatgctaagtacaagtggtacctcaaggagctccaggatgggatcggacagcgacagactgtggtacgcaccttaaacgctactggggaggagatcattcaacagagttccaagaccgacgctagcatcctacaggaaaaactgggctctctgaacctgcggtggcaagaagtgtgtaagcaactgagcgacaggaagaagcggctggaggaaactttagagagactgcaggagctgcaggaggcgaccgatgaattggatctcaagctgcggcaggcggaagtgattaagggatcttggcagcccgttggcgacctgctgatcgactctctgcaagatcacctggagaaagtgaaggctctccgaggtgagattgcgcccctgaaggagaatgtttcacacgttaatgacctggccaggcagttgacaacgctaggcatacagttgtccccctataatttgagtaccctggaagatctaaacacacggtggaagctgctgcaggttgcagtggaagatagagtacggcagcttcacgaagcccatagagattttggcccggcttcccagcatttcctgtctacaagcgtgcagggtccctgggagcgtgccatcagtccaaacaaggtgccttattatataaaccatgagacccaaaccacctgctgggaccatcctaaaatgactgaactgtaccagagtttggccgacctgaacaatgtgagattcagtgcctacagaaccgccatgaagctccggcggcttcagaaagccctttgtctggacctccttagcctgagtgctgcatgtgacgcactggatcagcacaacttgaaacagaatgatcagcccatggacattcttcagataataaactgtctcacgacaatttacgatagactggagcaggagcataataacttggtgaacgtgcctttatgtgttgacatgtgcctgaattggttgctgaatgtgtatgacactggccgcaccggcagaatcagggtgctgtcattcaagacgggaattatctccctatgtaaggcccatcttgaggataaatatcggtaccttttcaaacaggtcgcatcatccacaggtttttgcgatcaaagacgactgggcctgttactacacgatagtattcagataccgaggcagctgggagaagtagcgtctttcggagggagcaatatcgagcctagcgtccgcagttgtttccagtttgccaacaacaagcccgaaatcgaggccgccctgttcttggactggatgcgcttggaaccccagtcaatggtctggctgccagtgttgcatcgtgtcgctgcagctgagactgccaagcatcaggcgaagtgcaatatttgtaaggagtgtcctatcatcgggtttaggtaccgatctttaaaacactttaattatgatatctgtcagtcttgctttttctcgggtcgggtggcgaagggccacaagatgcactatcccatggtcgagtattgcacaccaaccacctccggggaggacgtcagagattttgctaaggtcctgaaaaataagttccgcaccaagagatactttgctaagcacccccgaatgggctacctgccggtacagaccgtgctcgagggtgacaatatggagactgacaccatg

SEQ ID NO: 251377 - DNA, 3432 bp, Artificial Sequence
  Description of Artificial Sequence: Synthetic coding sequence
atgctctggtgggaagaagtggaagattgttacgaacgggaagatgtccagaaaaagacgtttactaaatgggtcaacgcacagttttcgaagttcggaaagcagcacatcgagaacctgttctccgatctgcaagacggccggagactgctggacctgctggaaggactgactgggcagaaactgccaaaggaaaagggatccacccgggtgcacgcgctgaataacgtcaataaggctcttcgcgtgctgcagaacaacaacgtggacctcgtgaacatcggatcgaccgacatcgttgacggaaatcacaagctcacgcttggccttatctggaatatcattctgcactggcaggtgaaaaatgtcatgaaaaacatcatggctggccttcagcagaccaattccgagaagattttgctctcctgggtccggcaatcgacccgcaattaccctcaagttaatgttatcaatttcaccacctcgtggtcagacggactggcactgaacgccctgattcacagccaccgcccggatctgttcgactggaactcagtcgtgtgccaacagtcagcgacccagcgcctggaacatgcgttcaacatcgcccgttaccaactgggaatcgaaaagctgctggacccagaggatgtcgacactacctacccagacaaaaagagcatcttgatgtacataacttccttgttccaggtcttgccccaacaggtgagcatcgaggccatccaagaggtggaaatgttgcccagaccaccgaaggtgactaaggaagagcattttcagctgcatcatcaaatgcattactcgcagcaaattacggtgtcactggctcagggatatgagcgcacttcctcgcctaagccaagattcaaatcctacgcgtacacccaggcggcttacgtcacgaccagcgaccccacccggtccccgttcccgtctcagcatctcgaagccccggaggacaaatccttcgggagctcacttatggagtccgaggtgaacctcgacagatatcagactgcgctggaggaggtgttgtcgtggctcctgtcagctgaggacacgctgcaagcacaaggcgagatttcaaatgatgtggaggtcgtgaaggaccaattccatactcatgagggatatatgatggatttgaccgcccaccaaggaagggtggggaatatcctgcaattgggctccaagctcatcggaactggtaagctctcagaggatgaagagactgaagttcaagaacagatgaacctgctgaacagccggtgggaatgccttcgagtggcctcaatggaaaagcaaagcaacctgcatagagaaatttcatacgtcccgtcaacctacctcactgaaatcactcatgtgtcccaggcattgctcgaggtggaacagctgctgaacgcgccagatctgtgcgccaaagacttcgaagatctgttcaaacaggaagagtcgttgaagaatatcaaagactcacttcaacagtcgagcgggagaatcgatatcatccactcgaagaaaaccgccgccctgcagtctgcgactccggttgagcgagtgaagctgcaagaagctctctcgcagcttgacttccaatgggaaaaggtgaacaagatgtacaaggaccggcagggacgcttcgatagatcagttgaaaaatggcggcggttccactacgacatcaaaatctttaaccagtggctcactgaagctgaacagtttctgcggaaaacccaaatcccggaaaactgggagcatgcgaagtacaagtggtatctgaaagaactgcaggatggaatcggtcaaaggcaaaccgtggtccgcactttgaatgccactggcgaagagatcatccaacagtccagcaagactgatgccagcatattgcaggaaaagctcggaagcctcaaccttcgctggcaggaagtgtgcaaacagttgtctgatcggaagaagcgcctcgaggagacgcttgaacggttgcaagagctgcaggaagccacggatgagctcgatctcaagttgagacaggccgaagtgatcaaaggcagctggcaacccgtcggcgatctgcttatcgacagccttcaagaccacttggaaaaggttaaggccctcagaggggaaatcgcaccactcaaggaaaacgtgtcacacgtgaacgacctggcgagacagctgaccactctcggaatccaactctcaccgtacaatctgtccacgctggaggacctgaacacccgctggaagctgctccaggtggctgtggaagatcgggtgaggcagctgcacgaagcacaccgcgattttggacctgcctcgcagcacttcctgtcgactagcgtgcagggaccgtgggagcgggctatctcaccgaacaaggtgccgtactatatcaaccatgaaacgcagaccacctgctgggatcatccgaaaatgacggaactgtaccaatcacttgctgatctgaacaacgtgagattcagcgcataccgcactgcgatgaagctgaggcggctgcaaaaggccctttgtctggatctccttagcctgtccgccgcgtgcgacgccctcgaccaacataatctcaagcagaacgaccagccgatggacatccttcagatcattaactgccttaccactatctacgaccgtctcgagcaagagcacaataacctcgtcaatgtgccgctttgcgtcgacatgtgcctgaattggctcctgaacgtgtacgacaccggaaggaccgggaggatcagggtcctgtccttcaagaccggaatcatttcgctgtgcaaggcccatttggaggataagtaccggtacctcttcaaacaagtggcatcatcaactggattttgcgaccagagaagattgggactcctgctccacgatagcattcagattccacggcaactgggtgaggtggcttcgttcggtggaagcaatattgagccgtccgtgcggtcatgtttccagttcgcaaacaataagccggaaatcgaagcggcgctgttcctcgactggatgaggcttgagccgcaatcgatggtgtggctgcctgttctgcatcgggtggcggccgcggaaacggcaaaacaccaggcaaagtgcaacatctgcaaggagtgcccgattatcggatttaggtaccgctccctgaagcacttcaattacgatatctgtcagagctgtttcttctccggccgagtggccaagggccacaagatgcactaccctatggtggaatactgtactccaaccacctctggtgaggacgtccgtgattttgccaaagtccttaagaacaagttccgcaccaagcggtattttgcaaagcaccccagaatgggttacttgcctgtgcagaccgtccttgaaggggataacatggaaaccgacactatg

SEQ ID NO: 251378 - DNA, 3432 bp, Artificial Sequence; identical to SEQ ID NO: 251348
  Description of Artificial Sequence: Synthetic coding sequence

SEQ ID NO: 251379 - DNA, 3432 bp, Artificial Sequence
  Description of Artificial Sequence: Synthetic coding sequence
atgctgtggtgggaggaagtggaggactgctacgagcgcgaggatgttcagaaaaagactttcaccaaatgggtgaacgcacagttttcgaaattcggaaagcaacacatcgagaacctctttagcgacctccaagacggtcggcgacttctggacctgctggaaggactgaccggacagaaactcccaaaggagaagggatccactcgggtccatgccctcaacaacgtcaacaaagccctcagagtcctccaaaacaacaatgtcgatctggtgaacatcggatcgaccgatatcgtggacggtaatcacaagctgactctcggcctgatctggaatatcattctgcattggcaagtcaaaaacgtgatgaagaacattatggcgggactgcagcagactaatagcgaaaagatcttgctttcttgggttagacaatcaacgagaaactatccgcaagtcaatgtgatcaactttaccacctcgtggtcggacggactcgccttgaacgcactgatccactcacaccggccagatctgttcgactggaactcagtggtgtgccagcagtccgcaactcagcgcctggagcacgccttcaacatcgcccggtaccagctcggtatcgagaagctgctggacccggaagatgtggataccacctacccggacaagaagtctatactgatgtacattacgtcactgtttcaagtgctgccacagcaggtttccatcgaagccattcaggaggtggaaatgctccctcggccgccgaaagtgacgaaggaagaacactttcagctccatcaccagatgcactattcgcagcaaatcactgtctcactcgctcagggatacgaacggacctcgagcccaaagccccgctttaagtcttacgcgtacactcaggccgcgtatgtcactacctccgacccaactagaagcccgttcccgtcgcagcaccttgaagctcccgaagataagtcattcggaagctccctgatggagtcagaagtgaacctcgacagataccaaaccgcactggaagaagtgctctcgtggctgcttagcgccgaggacacccttcaagctcagggtgaaatcagcaatgacgtcgaggtcgtcaaagaccagtttcacacgcatgagggctacatgatggatctgaccgctcaccaaggccgggtcggaaatatcctgcagctgggaagcaagctcatcggcacgggcaagttgtcggaagatgaagagactgaggtccaggagcagatgaacctgctgaattcacgctgggaatgtctgcgcgtggcctctatggaaaaacagagcaatctgcacagggagatcagctacgtgccatcgacctacctgactgagatcacccatgtcagccaggcccttctggaagtggagcaacttctcaatgcaccggatctgtgcgccaaggatttcgaggacctcttcaaacaagaagaatcactcaaaaacatcaaggattccctgcagcagagcagcggaagaatcgacatcatccactccaagaaaaccgcagccctgcaatcagctactccggtggagcgagtgaagctgcaagaagccctctcacagctcgacttccagtgggaaaaagtgaataagatgtacaaggaccgacagggcaggttcgaccgcagcgtggaaaagtggaggagatttcactacgacattaagattttcaatcaatggctgactgaggcagagcagtttctgagaaagacccagatccccgaaaactgggagcacgcgaagtataagtggtatctgaaggagttgcaggacggaatcggacagcggcagaccgtcgtccggaccctgaacgctactggagaggagattattcaacagtcgtccaagacggacgcgtcaatactccaggaaaagttgggttccctgaatctccgctggcaagaggtttgcaagcagctgagcgatcgcaagaaacgccttgaagagactttggaacggctgcaagagctccaggaggcgacggatgagctggacctgaagctgagacaagcagaagtgatcaagggcagctggcagccagttggagatttgttgatcgattcgctgcaggaccatctggagaaagttaaggctttgaggggcgaaatcgcgccgcttaaggaaaatgtgtcgcacgtgaatgacctggcacggcagctgacgactctggggatccagctttccccgtacaacctctccacgctcgaagatctcaacacccgctggaaactccttcaagtggctgtggaagatcgcgttcggcaattgcatgaggcccacagagacttcggacctgcttctcagcactttctctcgacttcggtgcaggggccgtgggagagagcaatcagcccaaacaaagtcccatactacatcaaccacgagactcaaaccacctgctgggaccatcctaaaatgactgagctgtaccagagcctggcggatttgaacaacgtgcgattctcggcttaccgcactgcgatgaagctcagacgtctgcagaaagcactctgcctcgacctcctttctctctcggcggcgtgcgatgccctggaccaacacaatctcaagcagaatgaccagccgatggacatcctccagatcatcaactgcctgaccaccatttatgatcggctcgagcaggaacacaacaatctggtgaatgtgccactctgtgtcgacatgtgcctgaactggctgctgaacgtctacgataccggtcgcaccggccgcatccgggtgctcagcttcaagaccggtattatctctctgtgcaaggcccatctcgaagataagtaccggtaccttttcaagcaggtggcgtcgtcgactggcttttgcgaccagcggagacttggactgctgctccatgactcaattcaaatcccgcgccagctgggagaggtggcgagcttcggggggtccaatatcgagccgtcagtgcgctcctgttttcaattcgctaacaataagcctgaaatcgaagccgccctcttcctggattggatgcggctggaaccgcagtcgatggtgtggctgcctgtgcttcatagggtggcggctgcggaaaccgccaagcaccaagcgaagtgcaacatctgcaaggaatgccccatcatcggcttccggtacaggtcgctgaagcacttcaactacgatatctgtcagagctgtttcttctctggcagggtggccaagggacataagatgcattacccgatggtggagtactgcactccaactacctccggggaggatgtccgggatttcgcgaaggtgcttaagaacaagttccggactaagcgctacttcgcgaaacatcctagaatgggttacttgccggtgcaaactgtgttggaaggtgacaacatggagactgacacgatg

SEQ ID NO: 251380 - DNA, 3432 bp, Artificial Sequence
  Description of Artificial Sequence: Synthetic coding sequence
atgttatggtgggaagaggtagaggattgttacgaaagggaggatgtgcagaaaaaaacgttcacaaagtgggtaaatgcacagttctcgaaattcggaaaacagcacatcgaaaatctcttttctgatcttcaggatgggcggagactccttgatcttctggaagggctaactggacagaaactccctaaagaaaaggggtctacacgggtccacgcacttaataatgtcaacaaggcattacgcgtattgcagaataataatgtagatctggttaacattgggagtacagatatagtggatggaaatcataaactgactttggggttaatttggaatataattctgcattggcaggtcaagaatgttatgaagaacatcatggcgggattacaacagacgaattccgaaaaaattttgctctcatgggtgagacagtctactcgcaactatccacaggttaacgtcattaatttcacaactagttggtcagatggactcgccctcaatgcgctcatacattcccatcgccctgatctatttgattggaactctgtagtgtgccagcagagtgctacacagaggctggagcatgcattcaacattgcccgataccagcttggaatagagaaactgctagatcctgaagatgtggatactacttatcccgataaaaaatcaatcttgatgtatatcactagtctttttcaggtgctcccacaacaggtctcaatagaagccatacaggaagtcgaaatgcttccacgcccacccaaagtaactaaggaggaacactttcagcttcatcaccagatgcactactcccagcagataacggtttccctcgctcagggatatgaaaggacgagttcccccaaaccaaggttcaaaagttatgcttatactcaagcagcttatgtgactacaagtgacccaactaggtctcccttcccttcccagcacttagaggcccctgaagataaatcgtttggatcatccctcatggaaagtgaggttaatctagacaggtatcagacagcactcgaagaggtattatcttggcttctgtcagccgaagatactcttcaggctcagggggaaatttccaacgatgtggaagtagtcaaagaccagtttcatactcatgaagggtacatgatggatcttacggcacaccagggaagagtaggaaatattctgcagctcggatctaagctgattggaacaggaaagttatctgaagatgaagagacagaggttcaggagcagatgaacctgctaaattcgcgatgggaatgtctccgggtggcctcaatggaaaaacagagtaatctccatagagaaatctcatatgttccctcaacatatcttactgagataacacacgtgagtcaggcactgcttgaggtggaacaactgttaaacgctcctgatctctgtgctaaagatttcgaagatctattcaaacaggaagaatctctcaaaaatattaaagattcactacagcagtcttccggacgaatagatataatacattcgaagaaaactgccgctcttcagtccgcaactcccgtggaaagagtgaaacttcaggaagcattgtctcagctggattttcagtgggaaaaagtcaacaagatgtacaaagatagacaggggcgattcgatagatcagtggaaaaatggcgacggttccactatgacataaaaatatttaaccaatggttaactgaggctgagcagttcctcagaaaaacacagatacctgagaattgggaacatgcaaaatataaatggtatcttaaagaactgcaggatggaatcggacagaggcaaactgtggtgaggactctcaatgccacaggggaagagataattcagcagtcctctaaaacagatgcctcaatccttcaagaaaagcttgggagtctcaatcttaggtggcaggaagtctgtaaacagctcagtgatcgcaaaaaacggctggaagaaacattagaaagactccaggaattgcaggaggcaactgatgaactagatctcaaactaaggcaggcagaagtaataaaggggagttggcagcccgtcggagatcttctcatagatagtctccaggaccaccttgagaaagtcaaggccttgaggggggaaatcgcccccttaaaagaaaatgtcagtcatgtgaatgatttagcaaggcagctcacaacactcggaattcagttgtctccatataacctgtctactctggaggatctcaacacaaggtggaaactattgcaggtcgctgtggaagatcgggttcgacagctccatgaagcccatagagatttcgggcccgcaagtcaacacttcctgtcaacttctgtgcagggaccttgggaacgggctatctcacctaataaagtaccctactacatcaatcatgaaacacagacaacttgttgggatcatcccaaaatgacggaactataccagtccctagcagatctaaacaacgtcagattctcagcatatcgaactgccatgaaactgcggcgcttacaaaaagccttatgtctggatctcttatctctgagtgccgcatgtgatgcattagatcagcacaatctgaaacagaacgatcagcctatggacatcctgcagataatcaactgcctcactactatatatgaccgcctcgaacaggaacataacaatttggtgaatgtccctctctgcgtggatatgtgtctcaattggctgttaaacgtctatgacactggacgaacggggcgaattcgagtactgagtttcaagacagggattatatcactctgcaaagcccaccttgaggataagtaccggtacctgtttaaacaggttgcttcatctacaggattctgtgatcagcggcgactcgggcttctcctacatgattctatccagattcctaggcagttaggggaagttgcttctttcggagggtccaatattgagcccagtgtccgcagttgcttccagtttgccaacaacaaacctgagatcgaagccgccctctttctcgattggatgaggctagagccccagtctatggtgtggttaccagtactacatagggttgcagccgctgaaactgccaaacatcaggctaaatgcaacatttgcaaagaatgccctatcatcggatttcggtaccggtcacttaaacactttaattatgatatttgtcagtcatgttttttttctgggagagtggctaaaggacataaaatgcattatcctatggttgaatattgcacacctactacatctggagaagatgtccgtgatttcgctaaggtactgaaaaataagtttcgcactaaacgatattttgccaaacatccccggatggggtatctcccagtgcagactgtccttgaaggggataatatggaaactgatacaatg

SEQ ID NO: 251381 - DNA, 3432 bp, Artificial Sequence
  Description of Artificial Sequence: Synthetic coding sequence
atgttgtggtgggaggaagtggaagactgttatgagcgtgaagatgtccagaagaaaacattcactaaatgggttaacgctcaattctccaaatttggaaagcaacatatcgagaaccttttttcagatttgcaggacggacgacgactgctggatctattggaaggccttactggacagaaactgccaaaggagaaagggtcaacaagggttcacgctctgaacaacgtcaataaggctctgcgcgtactgcagaataacaacgtagacctggtcaacattggatctacagatatagttgatggaaaccacaagctgacccttggccttatttggaatatcatcctgcattggcaggttaagaatgtgatgaaaaacatcatggccggtttgcagcaaactaacagcgagaaaattctcctttcttgggtacggcaaagcaccagaaattatccgcaggtgaacgtgatcaacttcaccacgagctggagcgacgggcttgcgctgaacgccctgatacacagccacagacctgatctattcgactggaactccgtggtgtgccaacagtctgcgacacagagactcgagcatgccttcaatatagcacgctaccaattgggaatcgagaaactcctggatcctgaagacgttgatactacatacccagataagaaatccatcctgatgtacatcaccagcctgttccaggtcctgccacaacaggtctctatcgaagcaatccaagaggtggagatgctgccccgaccccctaaggtgacgaaagaggagcactttcagctccatcaccagatgcattactcccagcaaatcaccgtgagcttagctcagggctatgaaaggacctcctctccgaaacctcgctttaagtcatacgcgtacacccaggctgcttatgtcaccacctcagatcctactagatctccctttcctagccagcatctggaagctccagaggacaagagctttggctcctcactgatggaatctgaagtcaatctggaccgatatcaaactgcactggaagaggtgttaagttggcttctcagtgcagaagacactttacaagcacagggtgaaatcagcaatgacgttgaagtcgtgaaagaccaattccatactcatgaaggatacatgatggatctcacagctcaccagggtagagtcgggaacatcctgcagttgggatccaaattgatcggaaccggtaaactgtctgaggacgaggagaccgaggtgcaagagcagatgaacttgctgaattcaagatgggaatgcctccgggtggctagcatggagaagcagtctaacctgcatcgagagataagttatgtaccatcaacataccttacagagattacccacgtttctcaagctctgctggaagtcgaacagctcctgaacgcacccgacctgtgcgctaaagactttgaagaccttttcaagcaggaggaatcgcttaaaaatatcaaggattccctccagcagtcctctgggaggattgatattattcatagcaagaagactgccgcccttcaatctgcaacacccgtcgagagagtcaagttgcaggaagcactgagccaactggatttccagtgggagaaagttaacaaaatgtataaggacaggcaggggcgcttcgatcgcagcgtggagaagtggaggcgcttccattatgatataaaaatctttaaccaatggttgacagaggcagaacagttcctccggaagacccagattccagagaattgggaacatgctaagtataagtggtacctgaaggagctccaggacggaatcggccaacggcaaacagtcgtgagaaccctcaatgccaccggcgaagaaattatccaacagagtagcaaaaccgatgccagcatccttcaagagaaattgggcagcctgaacctgagatggcaggaagtgtgcaaacagttgagtgaccgcaaaaaaaggctcgaggagacccttgaacgactccaagaactgcaggaggctactgacgaactggatctgaagcttaggcaagcggaagtgattaagggcagctggcagccagtgggagatctgttgatcgactctctgcaagaccacttagaaaaggtgaaagctctgcgtggagagatcgccccgctgaaggagaatgtgagtcatgtaaacgacctcgcacggcagctcacgacactgggcatccagcttagcccctacaacctttccaccctcgaagaccttaacacaaggtggaaactcttacaagtggccgtagaagatcgggtgaggcagttgcatgaagctcacagggacttcggtcccgcttcacagcattttctttcgaccagcgtgcagggcccttgggagagagctatcagtccgaacaaagttccatattacattaaccacgagacccagaccacctgttgggaccaccccaagatgacagagctgtaccagagtctggccgacctgaacaatgtgcgcttttctgcatacaggactgctatgaaactgcgacgcctccaaaaggcgttgtgcctcgacctgttgtctctctctgccgcttgcgacgccttggatcaacacaacctgaagcagaacgatcagccaatggacatcctccagatcattaactgcctgactacaatatacgacaggcttgaacaagaacacaacaacctggtgaatgtcccactgtgtgtggatatgtgtctgaactggctgctgaacgtgtacgacaccggacgcacaggcagaatacgcgtgctaagctttaagactggcataatcagcctgtgtaaggcccatctcgaagacaaatatagataccttttcaaacaggttgcttcatccaccggtttctgtgaccagaggcggttgggattgcttctccatgatagcatccagattccaaggcagctgggagaggttgcgagcttcggaggatccaatattgagcctagcgtcaggagctgtttccagttcgccaataataagccagagatcgaggctgccctgtttctcgattggatgcgactggagccccagtctatggtttggcttccagtgctccacagagtggcagcagcagagaccgcaaagcatcaagcaaaatgtaatatttgcaaggagtgcccaatcatcgggtttcgctacagaagcctcaagcattttaactacgacatttgccaatcttgcttcttctctggaagggtggcaaaaggccacaaaatgcattaccctatggtggaatattgcactccaaccacgtccggcgaggatgttagagatttcgcaaaggtgctgaagaacaagtttagaacaaagagatactttgccaagcacccacgcatgggatatcttcctgtccagactgtcctagagggcgataacatggagaccgataccatg

SEQ ID NO: 251382 - DNA, 3432 bp, Artificial Sequence
  Description of Artificial Sequence: Synthetic coding sequence
atgctgtggtgggaagaggtggaggattgttacgagagggaggatgtccaaaagaagaccttcaccaagtgggtgaacgctcagttcagcaagtttggaaagcagcacattgagaacctgtttagcgatctgcaggacgggcgacggctgctcgaccttctagagggccttactgggcagaaactgcccaaggagaaagggagcacgcgggtgcatgccctgaacaacgtgaacaaagccttgagagtgctccagaacaacaatgtggacttggttaacatagggtccacggatatcgtcgacggtaatcacaaattgaccttgggattgatttggaacataattcttcattggcaagtcaaaaacgtgatgaagaatattatggccggtttgcagcaaactaattccgagaaaattttgctgtcttgggtgagacagtccacacgcaactatccacaggtaaatgtcattaactttacaacctcttggagcgatggactagccctgaatgccttgatacacagccacagacccgacctattcgattggaattccgttgtgtgccaacagagtgcaacacagaggcttgaacatgccttcaacattgctcgttaccagctgggtattgaaaaactgttggaccccgaggatgtcgacaccacctatcctgataaaaagtcaatcttgatgtacatcacttctttgttccaggtgttgccacagcaagtgtccatcgaggctattcaggaggtggaaatgctgcccaggcctcccaaggtgaccaaagaggagcattttcaactgcatcaccagatgcactacagccagcagattaccgtgagcttggcccagggctatgagagaactagttcccccaagccccgcttcaagtcgtatgcttatactcaggcagcctacgtaacaacgtctgacccgacacgcagcccttttccctcacaacatctcgaggctcctgaagacaaatcatttggatcctctctaatggagagtgaagtgaatctggaccggtaccagacagctttggaggaggtattgtcttggctgctgagcgccgaagacaccctccaggctcagggagaaatcagtaacgatgtggaagtcgtcaaagaccagttccacacacacgagggttacatgatggacttgacggcacaccaggggcgggtgggtaatatcttgcaactgggttccaagctgatcgggacaggcaagttgtccgaggacgaggaaacagaagtccaggagcagatgaatttgctgaactctagatgggaatgcctgcgtgttgccagcatggagaaacaatctaatttacatagagagattagttacgtaccatcaacttatctgacggaaatcactcacgtatcccaggcactgctagaggtggagcaactattaaacgctcctgatctgtgcgcgaaagatttcgaggatctctttaagcaagaggagtccctgaaaaacatcaaggactcgctgcaacagagctctgggagaatcgacattatccactccaagaagaccgccgcactgcagtcagccacacctgttgaacgcgtcaagctgcaagaagcattatctcaactagatttccagtgggaaaaggtgaataaaatgtacaaagacagacagggacgcttcgatcggtcggtggagaagtggcggaggttccactacgatatcaaaattttcaaccagtggttgaccgaggccgagcagtttctcagaaaaacccagatccccgagaattgggagcacgccaagtataagtggtacttgaaggaactccaggacggcattggccagcgtcagaccgtcgtgagaacactcaatgccactggggaggagataattcagcaatccagcaagaccgatgcgtctattctccaggagaaacttgggtctctcaatttgcgctggcaggaagtttgcaagcagctgtccgatagaaaaaaaagactggaagagacactggaacgactgcaggaactccaggaggcaactgatgaactagatctgaagcttcgccaggccgaggttatcaaaggcagctggcagccagttggtgacctgttgattgacagtttgcaggatcacctggagaaagtcaaggccttgagaggggaaatcgcccccctgaaggaaaacgtgtcacacgtcaacgatcttgctcgccaattgaccacccttggcattcagctaagcccttataaccttagcactttggaggaccttaataccaggtggaagctgctacaagttgctgtcgaggacagagtgcgccagctccatgaggctcacagggattttggacccgccagtcagcatttcctcagtacaagcgttcagggaccatgggaaagagcaatttctcccaataaagtaccctactatattaatcatgagacgcagacgacatgttgggatcaccctaaaatgacagagctgtaccaatcactagcggacctaaataacgtacgattcagtgcctaccgaactgccatgaagctacggcgacttcagaaggcactgtgtctggacctcctgtctctgagcgcagcctgtgatgccctggaccagcataatctcaaacagaatgatcagcccatggatattttacaaattatcaactgtctaacaacgatctacgaccgactcgagcaggagcataacaacttagtgaacgtccctttatgcgttgatatgtgcctgaattggctgctaaacgtttacgacacggggaggactggccgaatcagggtgctgtcattcaagaccgggatcatctctctatgcaaggcacaccttgaagacaagtataggtatctgtttaagcaggtagcctccagcaccggtttctgcgaccagaggaggctgggtctcctgctgcacgattcgatccagatcccaagacagctcggtgaagtggcaagctttggggggagcaacatagaaccctcggtcagaagttgtttccaatttgccaataacaaacccgagattgaagccgccctttttcttgattggatgcgcctggagccccagtctatggtttggctgcccgtactccacagggttgccgcggcagaaaccgcaaagcaccaggcgaagtgtaacatctgtaaggagtgcccaatcatcggattcagatacagatcactgaagcattttaattatgatatttgccaatcatgtttctttagtggccgcgtagccaaagggcacaagatgcattatccaatggttgaatactgcacacctacaacttctggtgaggatgtaagggattttgctaaggtgctgaaaaataaattccggaccaagaggtattttgcgaaacaccctcgtatgggatacttgccagtgcaaaccgtcctggagggcgacaacatggagaccgacaccatg

SEQ ID NO: 251383 - DNA, 3432 bp, Artificial Sequence
  Description of Artificial Sequence: Synthetic coding sequence
atgctgtggtgggaagaggtggaggattgttacgagagggaggacgttcagaagaaaactttcaccaagtgggtcaacgcccagttttctaagtttggaaaacaacacatcgagaacctgttctccgacctgcaggacggtcgccgcctgctcgatctgctggaaggactgaccggccagaaactccccaaggagaaaggatcaactcgggtgcatgcgctgaataacgtcaataaagccctgagagtgcttcaaaacaacaatgttgacttggtcaacattggaagcactgacatcgtggacggtaatcataaactgaccctgggtcttatctggaacatcatcttgcactggcaggtgaagaacgtgatgaagaacattatggctgggcttcagcagacgaactccgagaagatcctgctctcgtgggtgcgccaatccacccggaactacccgcaagtgaacgtgatcaacttcaccacttcctggtcagacggactggcactcaacgcactcattcattcgcacaggccggatttgttcgattggaactcagtggtctgccagcaaagcgcaactcaacggctcgagcacgccttcaacattgcgaggtaccagttgggaatcgaaaaactgctcgaccccgaagatgtggacactacttacccagataagaagtcgatccttatgtacattaccagcctgttccaagtcttgccgcagcaagtgtcgatcgaggcgatccaagaagtggaaatgctgccgcggcctccgaaagtgactaaggaagagcacttccagttgcatcaccagatgcactacagccaacaaatcaccgtctcactcgcccagggatacgagcggacttcgagccctaaaccacggttcaaatcgtatgcatacacgcaggcagcttacgtgactacctcagatccaactcgatccccgtttccaagccagcacctcgaagctcctgaggacaagtcctttggttcgtcactgatggaatccgaagtcaatctggacagataccaaactgccctcgaagaagtgctgtcatggctcctctcggcggaagatactctgcaagcgcagggagagatcagcaacgatgtggaagtggtcaaggaccagttccatacgcatgaaggttatatgatggacctgacggctcatcaaggccgagtcgggaacatcttgcaactcggttccaaacttattggtaccggaaagctgtcagaggacgaggaaaccgaagtgcaagaacagatgaacctgcttaattcgcggtgggaatgtctgcgcgtcgcttccatggaaaaacaatcaaacctgcaccgggaaatctcctacgtgccgtccacctacttgactgagatcactcatgtctcgcaggcacttctggaagttgaacagctcctgaatgcacctgacctgtgcgccaaggacttcgaagatctgttcaaacaggaagaaagccttaagaatatcaaggattcgctccagcagtcgtcgggacggattgatatcattcacagcaagaaaacggccgcactgcagtccgccactccggtggaacgagtgaaactccaagaagcgctgtcccagctggactttcaatgggaaaaggtgaacaagatgtacaaagaccgccagggccgcttcgacagatccgtggaaaaatggcgccggtttcattacgacatcaagatctttaatcaatggctgaccgaagcagaacagttcctcagaaagactcaaataccggagaactgggaacatgcgaaatacaagtggtatctcaaagaactgcaagacggtatcggccaacgccaaacggtcgtccggaccctgaacgccaccggggaagaaatcatacagcaatcaagcaagactgatgcatccatcttgcaggaaaagttgggatcactcaatcttaggtggcaagaggtctgcaagcaactgtcagatagaaagaagagactcgaagagactctggaacggcttcaagagcttcaggaggccactgacgaactggatctcaagctccgccaggcagaggtgatcaaggggagctggcagcccgtcggagatctcctcatcgactcgctgcaagaccatttggaaaaagtcaaggcacttcgcggcgagattgctccgctgaaggaaaacgtgtcacacgtgaatgatctggctaggcaactgacgacgctgggcatacagttgtcgccatacaatctctccactctggaggacctgaacacccgctggaagctgctgcaagtcgcggtggaggaccgagtcagacagctgcacgaagcgcatcgggactttggacctgccagccagcacttcctgtccacttcggtccagggtccatgggagcgcgcaatttccccgaacaaggtcccatactacattaaccacgagactcagacgacctgctgggatcatccgaaaatgaccgagctgtaccagtcgctcgctgacctcaataacgtgcgctttagcgcgtacagaactgccatgaaactcagacgcctgcagaaagctctgtgcctggatctcttgtcgctttcggccgcttgcgatgctctggaccagcataacctgaaacaaaacgaccagccgatggacatcctgcaaatcatcaactgtctgactactatttacgatcgcctggaacaggagcacaacaacttggtcaacgtgccactctgcgtggatatgtgcctgaattggctcctgaacgtgtacgacaccggaaggactgggaggattcgcgtgttgtcgttcaaaactgggattatcagcctctgcaaggcgcatctcgaggataagtacaggtatctgttcaagcaggtggcatcgtccaccggcttctgcgatcagagacgtctggggctcttgctgcatgactcgatccagatcccgcggcagctgggcgaggtggcttcctttgggggctccaacatcgagccatcggtgcgcagctgcttccagttcgcaaacaataagccagaaatcgaggccgcgctgttcctggactggatgcgcctggaacctcagtcgatggtgtggctgcccgtgctgcaccgggtggcggcagcggaaactgcgaaacaccaggcgaagtgcaatatctgtaaggaatgtccaatcatcggtttccggtacagaagcctgaagcatttcaattacgatatctgtcaaagctgcttcttctccggaagagtggcaaaaggacacaagatgcactaccctatggtggaatactgcacgccgacgacctcgggcgaagatgtccgcgatttcgcaaaggtccttaagaacaaattccggaccaagaggtactttgcaaagcatccacgcatgggttacctcccggttcagacggtgctggagggagataacatggaaaccgacactatg

SEQ ID NO: 251384 - DNA, 3432 bp, Artificial Sequence
  Description of Artificial Sequence: Synthetic coding sequence
atgctttggtgggaggaagtggaagattgttacgagagagaggacgtgcagaagaaaactttcactaaatgggtcaacgcacaattttcaaaattcggaaagcagcatattgagaatttgtttagcgatcttcaagatggtcgtaggctcttggatctgttggaaggactgaccggacaaaaacttccaaaggaaaaaggtagcactcgtgtgcatgctcttaacaacgttaacaaagcgctgcgggtccttcagaacaataacgtcgaccttgttaacatcggttccacggatattgtggacggtaatcacaaactgactttgggactcatctggaacataatccttcactggcaagtgaagaatgttatgaagaacattatggccggtctgcagcagaccaacagcgaaaagatcctcctgtcatgggtccgccagtcaactcggaactaccctcaggtgaacgtgatcaactttaccacgtcgtggtcagatggacttgcactgaacgccctgatccatagccatagaccggacttgtttgattggaacagcgtggtgtgtcagcaatcggccacccagagactcgaacacgctttcaacatcgcacgctaccaactcggcattgaaaaacttctggaccccgaagatgtggataccacttatcccgacaagaaatcaatcctgatgtacataacttcactgttccaggtgcttccccagcaagtgtccattgaggcaatacaagaagttgagatgctcccacgtccacccaaagtgaccaaggaagagcattttcagcttcatcatcaaatgcattactcccaacaaattaccgtctcccttgcccaaggctacgagagaacttcctcgcccaagccccgcttcaaatcatacgcctacacccaagcagcatacgtgactacctcggatcctacccgctcgccctttcctagccagcatcttgaggctcccgaggacaaatcgttcggttccagcttgatggaatccgaagtcaaccttgatagataccaaaccgcgctcgaggaggtgctgtcctggctcctgtcagctgaagatactctgcaggcccaaggagaaattagcaatgacgtggaggtggtgaaggatcagttccatacccacgagggttacatgatggaccttaccgcccaccagggacgggtcggcaacatccttcaactgggatccaagctcattggaactggaaagttgtccgaagatgaggaaaccgaagtgcaggaacagatgaatcttctgaactcaagatgggaatgcctgagggtggctagcatggaaaagcaaagtaacctgcaccgcgaaatttcgtatgtgccttcgacctacctgactgaaattactcatgtgtcgcaagcactgcttgaggtggaacagctgctcaacgcgcccgatctttgtgcaaaagattttgaagatctgtttaaacaagaagaatccctgaagaacatcaaggactctctgcagcaaagctcgggtaggattgacatcattcactcgaagaaaaccgcagccctccagtcggccactccagtggaacgggtgaaacttcaagaggccctctcgcaactggatttccagtgggaaaaggtgaataagatgtacaaggatcgacagggtcgatttgacaggtccgtggagaaatggaggagatttcattacgacattaagattttcaatcagtggctgactgaagcggaacaattccttagaaagactcaaattcccgaaaactgggagcatgcaaagtacaagtggtacctgaaggaactgcaagacggaatcggacaaagacagactgtggtgcgaaccctgaacgcaacgggagaggagattatacagcaatcgtccaagaccgatgcttcaattcttcaggagaagctgggttcgcttaatctcaggtggcaagaggtgtgtaagcagctgtccgacaggaagaagagattggaggaaactcttgagagactccaggaactgcaggaagcaactgacgaactcgacttgaaacttcgacaggccgaagtcattaagggttcctggcaacctgtgggagacttgctgatcgattcattgcaggatcatcttgagaaggtcaaggcacttcggggggagatcgcgccactgaaagagaatgtgagccacgtgaacgacctggctcgtcagcttactacccttggaattcagctttctccgtacaacttgtcgacgttggaagatcttaatactaggtggaagctgttgcaagtggccgtggaagatagggtcagacaacttcacgaagcgcatcgagattttgggcctgcctcacaacattttctgtccacgagcgtccagggaccctgggagagggcaatttcccccaataaggtcccatactacataaaccatgaaacgcaaactacctgctgggatcatccgaagatgaccgagttgtatcagtcgctcgcagacttgaacaatgtgcggtttagcgcgtataggactgcaatgaaactgaggcgcctgcagaaagcactctgtctggacctcctgagcctttcggcagcatgtgacgcacttgatcaacataatctgaaacagaacgatcagcctatggatatactccagattatcaactgtctgaccactatctacgataggctcgaacaggaacataacaaccttgtgaacgtccctctgtgcgtggatatgtgtctcaactggcttcttaatgtgtacgacaccggtagaaccggaagaatacgtgtgctgtcgttcaaaaccggcattatctccttgtgcaaggcacacctggaagataagtaccgatatttgtttaagcaagtggcaagctcaactgggttttgtgatcagcggcgcctgggactccttcttcacgattcgattcaaatcccacggcaacttggtgaagttgctagcttcggagggtcaaacatcgagccaagcgtgcgatcatgtttccaatttgcaaacaacaagcctgagattgaagcagccctttttctcgattggatgagactcgaaccacagtccatggtgtggttgcctgtgcttcatagagtcgcagcagcggaaaccgcaaagcaccaggcgaaatgtaacatttgcaaggagtgccctatcattggtttccgttatcgttcgctcaaacacttcaactacgatatttgtcaatcgtgcttcttttccggtagagtggcgaaaggacacaagatgcattatcccatggtggaatactgcacccctacgacgtccggagaagatgtgcgggactttgcaaaggttctgaagaataagttccggaccaagcgctactttgcgaagcatccacgtatgggatacctgcctgtgcagaccgtattggagggcgacaacatggaaaccgatacgatg

SEQ ID NO: 251385 - DNA, 3432 bp, Artificial Sequence
  Description of Artificial Sequence: Synthetic coding sequence
atgctgtggtgggaagaggtggaagactgctatgagagagaggacgtgcagaaaaaaacgtttacgaagtgggttaatgctcagtttagcaaattcggtaagcagcacattgagaatctttttagcgacctgcaagatgggcgccggctcctggatcttctcgagggattgaccgggcagaagctgcccaaggagaaaggtagtacgagggtgcatgccctcaacaatgtaaacaaggcccttcgggttttacaaaacaataatgtcgacctcgtaaacattggatcaactgatattgtggatggcaaccataaactgaccttaggactgatctggaatatcatcctacattggcaggtgaaaaacgtgatgaagaatattatggcaggactgcagcagaccaactcagaaaaaatactgctgtcttgggtgaggcagtctaccagaaactaccctcaggtgaatgtaattaattttacgactagctggagtgacggactggcattaaacgcactcatacactctcatcgacccgacctgtttgattggaacagtgttgtatgccagcagagtgctactcaaaggctcgaacatgcttttaacattgccagatatcaactgggcatcgagaagctgttggatcctgaggatgtggatactacgtatcctgacaagaaatctatcctcatgtacattacttccctattccaggttctgcctcaacaggtgtccattgaagccatccaagaagtggagatgctgcccaggcctcctaaagttaccaaagaagaacatttccagttgcatcaccagatgcactactctcagcaaattactgtcagtctagcccagggatacgagaggacatcaagccccaaaccgagattcaagtcatacgcctacacgcaggccgcctacgtgactacctcagacccgaccaggagtcccttcccctcccaacatctcgaagctccagaggataagtcattcgggtcatccttgatggagtctgaagtgaatctggaccgttaccaaacggctctggaggaagttctgtcctggctgctgtcggccgaggatactctgcaggcccagggagaaatcagcaacgatgtcgaagtagtgaaggaccaattccatacccatgaggggtatatgatggatcttactgcgcaccagggaagggtgggcaacatcctgcagcttgggagtaagcttatagggacgggaaagcttagtgaagacgaagaaaccgaggtgcaggagcagatgaatctgcttaactcacggtgggagtgcttgagagtggccagcatggaaaagcaaagtaatctgcatagagaaatcagctacgtccctagtacgtacctgaccgagatcactcacgtttcccaggcgcttctcgaggtagagcagctgctgaatgcaccggatctttgcgctaaggactttgaagatctcttcaaacaagaggagagcctcaaaaatatcaaggactccttacagcagtcatccggaaggatcgatattatccattctaaaaagaccgcagctctgcagagcgcgacaccagtcgagagggtgaaactgcaagaggccctttcccagctggactttcaatgggaaaaggtcaacaaaatgtacaaggatagacagggccggtttgacaggagcgtggaaaagtggagacgttttcactatgatattaagatattcaaccagtggctgaccgaagccgagcagttcctgcggaaaacccagatcccagaaaactgggagcacgccaagtataaatggtatctgaaggaactccaggacggcattgggcaacgtcagaccgtcgtgagaacactcaacgccacgggagaggaaatcattcagcagtcgtctaagactgatgctagtatcctgcaggaaaaacttggatccttgaatctgcgctggcaggaggtgtgtaaacagctgagtgaccgaaagaaacgactggaagagactctagagcgcctgcaggagttgcaggaggcgactgatgaattagacctaaaactgcggcaggccgaagtaatcaaaggatcttggcagccagttggggacctgctgatcgattctctgcaggatcatctcgagaaggtgaaggcattgcgcggcgagatcgccccactgaaagagaatgttagtcatgtgaacgatctggccagacagttgactaccctcgggattcagctgagcccttataatctgagtactttggaggatctcaatactaggtggaaactactgcaggtggcggtcgaagatcgtgtgagacagctccatgaggcgcaccgtgactttgggcccgcaagccaacattttctgtccactagtgtccagggtccatgggaaagggccatcagcccgaataaggtcccttactatattaatcatgagactcaaacaacctgttgggaccaccctaagatgacagaactttaccagagcttagccgatcttaataacgtccgcttttcagcctaccgaacagccatgaagctgaggagattacagaaggccctctgcctggacttgctaagtctgtcagcagcgtgtgacgccttagatcagcacaacctgaaacagaatgaccagcctatggacattctacagatcatcaactgcctcaccaccatctacgaccgtctagagcaggagcacaacaacttggtgaacgtccctctatgtgtggatatgtgcctcaactggcttctgaacgtctacgatacggggcgtaccggccgcatcagagtgctctcattcaagaccggaatcatctctctttgcaaggctcacctggaggacaaatacagatacctttttaagcaggtggcaagctccacaggattttgcgaccaacggcgtctgggtttactcctgcacgactctattcagatacccagacagttaggtgaagttgcatcctttgggggtagtaatattgagccatccgtgagatcttgcttccagttcgccaacaataaacccgaaatcgaggcggccttgttcttagactggatgcgcttagagcctcagagcatggtgtggttgcctgtgctgcacagagtggcagcagcggagactgcaaaacaccaagcaaaatgcaacatttgcaaagagtgccccatcataggattcaggtacaggtcactgaagcactttaattacgatatctgccagagctgtttctttagcggaagggtggctaagggccacaagatgcactacccaatggttgagtattgcacaccaacaacttctggagaagatgtccgcgattttgccaaggtgttgaaaaacaaattcagaacaaaaaggtattttgctaagcatccccgcatggggtatctgccagtgcaaaccgtgctggaaggggacaatatggagacggacacgatg

SEQ ID NO: 251386 - DNA, 3432 bp, Artificial Sequence
  Description of Artificial Sequence: Synthetic coding sequence
atgctctggtgggaggaggttgaagactgctacgaaagagaggatgtccagaaaaaaaccttcacgaagtgggtgaatgcgcaattctccaagtttggcaaacagcatatcgagaatctgtttagtgacctgcaggatggacggagactgctggatctgttggaaggcctcactggtcaaaagcttccaaaagagaagggaagcacacgggtccatgccctgaacaacgtgaacaaggctctccgggttcttcaaaacaacaatgtcgacctggtgaatattggcagcactgacatcgtggatggaaaccacaaactgacactcgggctgatttggaacatcatcctccattggcaagttaaaaacgtgatgaagaatatcatggctggattgcagcaaacaaatagtgagaagatactcttatcgtgggtgagacaatccacacggaactatcctcaggtgaatgtgatcaattttaccaccagctggagcgatggcttagcactgaacgcactaattcattctcatcgaccagatttatttgactggaactccgttgtatgtcagcaaagtgccactcagaggcttgagcacgcctttaacatagctagatatcagttgggaatcgagaaactcctcgatcctgaagacgtagacacaacttatcccgacaagaagtcaattctgatgtatattacttctctatttcaggtgctccctcagcaggtcagtatcgaggctatccaagaggttgagatgctgccccggccacccaaggtgacaaaggaggagcactttcagctacaccaccagatgcattatagccagcagatcactgtgtcattggcccaaggatatgaaagaaccagcagcccaaaaccgcgctttaagagctatgcctacacccaggctgcctacgtgacaacatccgacccaacaaggtcaccctttccttcgcagcaccttgaggctcccgaggataagtccttcggatctagcctgatggaaagcgaggtgaatctggaccgctatcagacggcactcgaggaggtactgtcctggctgctcagcgccgaggatacactccaagcgcaaggcgagatctccaatgatgtggaagttgtcaaggaccagttccatacccatgaggggtacatgatggatctgaccgcccaccagggtcgggtaggaaatatcctccagctgggctctaagttgatcgggaccgggaaactgtctgaggacgaggagaccgaggtgcaggaacagatgaatcttctgaattcccgctgggagtgcttacgggttgcctctatggagaagcagtctaatctgcaccgggagatatcgtatgtgcctagtacttatctgacagagatcacacatgtcagccaggctctgctcgaggtggaacaattgctgaatgctccagacctctgtgccaaggattttgaggacttattcaaacaagaggagtcccttaagaacatcaaagattccctccagcagagctctggccgcattgatatcattcacagcaagaagactgccgccctgcagtctgcgacccccgtggaaagagttaaactccaggaagctctgtcccagctagatttccagtgggagaaggtgaacaagatgtacaaagatcgccaagggcggtttgatcggagcgtggaaaagtggcgacgtttccattatgacatcaaaatttttaatcagtggttgaccgaagcagaacagttcctgcgaaaaactcagatcccagagaattgggaacacgccaagtacaagtggtatttgaaggagcttcaggatgggattggtcagaggcagacagtggtgagaactttgaatgcaacgggggaggagattattcagcagtcgtctaagacagatgcctcaatcctccaggaaaaactgggaagcctgaacctccggtggcaggaggtctgtaaacagctaagcgataggaaaaagcgtctcgaggagacactggagcggctgcaggagcttcaggaggccactgatgagctagacctgaaattgaggcaagcagaggtgatcaaaggatcatggcagcccgtcggtgacctgctgattgactccttacaggaccacctggagaaggtgaaggcactgcggggggaaattgctccactgaaggaaaacgtatcccacgttaacgacctcgcaagacaactgactactttgggtatacaactctctccatacaacctgagcacgctagaggacctgaatacacgatggaagctccttcaggtggcagtggaggatagggtgcggcaactgcatgaggcacatagggacttcggcccagccagtcagcactttctcagcaccagcgtacagggaccttgggaacgcgccatttccccaaacaaggttccttattacattaaccatgaaacccagactacttgttgggaccacccaaagatgaccgagttgtatcagtcactggccgacctgaacaacgtgcgattctccgcatacagaacagccatgaagttgaggcgcctgcagaaggcactgtgcctggacctactctccctgagcgcagcatgtgatgctttggaccagcataacctgaaacaaaatgatcaaccgatggatatactgcaaatcattaattgtctgacgactatatacgatcgcttagaacaggagcataacaacctcgttaatgtccctctgtgtgtcgatatgtgtttaaactggcttctgaacgtatatgatacagggcgaaccggccggataagggtcctgagctttaagaccggaattatttcgctttgtaaggcgcacctggaggataaataccggtacctgtttaagcaggtggccagctcaacgggtttctgtgaccagcgccggctgggccttttactgcatgatagtatccagattccaagacagctgggcgaagtggcctctttcgggggatctaatatcgagccctctgttcggtcctgcttccagttcgctaacaacaagcccgaaatcgaggcagccctcttcttggattggatgaggctggagccccagagcatggtctggctgccagtgctccatcgggtggctgcggctgagacagctaaacaccaagccaagtgtaatatttgcaaggagtgccccatcattgggtttcggtacaggtccctgaaacacttcaactacgacatctgccaatcttgcttctttagcggtagagtggccaagggccataagatgcactaccctatggttgagtattgcactcccacgacaagtggagaagacgtgcgagattttgccaaagttctgaagaacaaattccgaactaaaagatacttcgctaaacacccgcgaatgggctatctgccagttcagaccgtgctggagggcgacaacatggaaactgataccatg

SEQ ID NO: 251387 - DNA, 3432 bp, Artificial Sequence
  Description of Artificial Sequence: Synthetic coding sequence
atgctgtggtgggaggaagttgaggactgttatgaacgagaagacgtccagaaaaagacgtttacaaaatgggtaaatgctcagttcagtaaatttgggaagcagcacattgaaaatctttttagtgatttgcaggatggtagaagattactggatctgttggagggattgactggtcaaaaattacccaaggagaagggatcaacccgtgttcacgctctgaataatgtgaataaagctcttcgtgttctacagaataacaacgtcgatttagtcaatattgggtccacggatattgttgacggaaatcacaaattaactcttggactcatctggaacataattctacactggcaggtaaaaaatgtgatgaaaaacattatggctggattacagcaaactaactctgaaaaaattttgttaagttgggtaagacagtcaacgcgaaattacccacaagttaatgtcatcaattttactacatcctggtcagatggtttggcactcaatgctttaattcatagccatagaccagatttgtttgattggaactcggtcgtctgtcaacaatcagccacacagcggctcgagcatgcatttaacattgctcgttatcaattaggaattgagaagctactcgaccctgaagatgtagatacgacatatcctgacaaaaagtcaatactcatgtacatcacctcacttttccaggtactcccacaacaagtgtctatcgaagccatccaagaagtagaaatgttgccacgaccgccaaaagtaacaaaagaagagcatttccaactacaccaccaaatgcactatagtcaacagattactgtatctcttgctcaaggatatgaacgtacgtcatcgcctaagccccgctttaagtcttatgcatacactcaagctgcttatgttaccacgtcagatccgacccgtagtccattcccatcacagcatttggaagcccctgaagataagtcatttggatcaagtttaatggagtcggaggtgaacctcgatcgttatcagactgcacttgaggaagtgctttcttggctacttagtgctgaggacacccttcaagcacagggagagatctctaacgatgtggaagtcgttaaagatcaattccatacacacgaaggctatatgatggatttgaccgcccaccaaggacgggtgggtaacatacttcaacttggaagtaaattaattggaactggaaagctctcagaagatgaggaaacagaagtgcaagaacagatgaatttgctaaactccagatgggaatgtcttcgagtcgcgtcgatggagaaacaatctaacttacaccgtgaaattagttacgtcccaagtacatatcttacagaaatcacacacgtttctcaagcccttctcgaagtcgagcaattgctcaatgcaccggatttgtgtgctaaggattttgaggacctttttaaacaagaagaatcgctaaagaatattaaagattcactacaacaatcgtcgggacgaatagatataattcattcaaagaagactgcagcgctccaatctgcaactccagttgaacgcgttaagttacaagaagcactaagtcagctagatttccagtgggaaaaagtcaataaaatgtacaaagatagacaaggaagatttgatcgttctgttgaaaaatggagaagatttcattatgatatcaaaatattcaatcaatggttaactgaggctgagcaattccttagaaagacacaaatacctgagaattgggagcacgcaaagtataaatggtacctcaaggagctccaggatggaataggacagaggcaaacagtggttcgaacccttaacgcaacaggagaagaaattatccagcaatctagcaagacggatgcaagtattttacaagaaaagcttggttctcttaatctcagatggcaagaagtttgtaaacagctctctgatcgtaagaaaagacttgaagaaacgcttgaacgtctgcaggaattgcaggaggcaacagatgaactcgacctgaaattgagacaagctgaggttattaaaggttcctggcaacctgttggtgacctccttatcgacagtcttcaagaccatttagagaaagttaaggcgctccgtggagagattgctccactgaaagagaatgtttcacacgtaaatgacttggctagacaactaactacacttggtattcaattatccccatataatctgtcaacattagaggatctcaatactcgatggaaactcttgcaggtggccgttgaggacagagttcgtcaacttcacgaggcacatcgagatttcggaccagcttcgcagcattttcttagcacgtcagtgcaaggaccatgggagcgagctataagtccaaataaggtgccatactacattaatcatgagacgcaaaccacctgttgggatcacccaaagatgactgaactatatcaatctcttgctgatttaaacaacgttcgattcagtgcatatcgtactgccatgaaacttagacgcctacagaaagcattatgtcttgacttgttgtcactctcagcggcctgtgacgctcttgatcaacataatttaaaacaaaacgatcaaccgatggacatcctacagattatcaactgcctaactacgatatacgatagacttgaacaagaacataataaccttgttaatgttccattatgtgtagatatgtgtctgaactggctactaaatgtgtacgacactggacgaacaggccgtatccgcgtgctgtcgtttaaaactggtatcatttcactctgcaaggctcatctagaagataagtaccgatatctatttaagcaagttgcttcgtcaacaggtttctgtgaccaacgacgtttaggattactcctccatgattctatacaaattccacggcaattgggagaagtagcctccttcggtggttctaacatagaaccatccgttcgttcgtgctttcaatttgcaaacaataagccagagattgaggctgccttattcctggactggatgcgactggagccacagtccatggtttggcttcccgtgcttcatagagtagcagcggcggaaacagcaaaacatcaggctaaatgtaatatttgtaaggagtgtcccataatcggatttcgatatagatctttgaagcacttcaattatgatatttgtcaaagttgcttcttctccggaagagtggctaaaggacataaaatgcattaccccatggtggaatattgcactcctactactagcggcgaagacgtaagagatttcgctaaggtcctcaagaacaagttcagaacaaagcgctatttcgctaaacatccacgtatgggatatcttccggttcagactgtgttggagggagataacatggagactgatacaatg

SEQ ID NO: 251388 - DNA, 3432 bp, Artificial Sequence
  Description of Artificial Sequence: Synthetic coding sequence
atgttatggtgggaggaggtggaggactgctacgagagggaggacgttcaaaagaagacattcactaagtgggtcaatgcccagttctcaaaatttggaaagcagcatatcgagaaccttttcagtgatctgcaagatggccgaaggcttcttgacctgctcgaagggctgaccgggcaaaagcttccgaaggaaaaagggagcacccgcgtccacgccttgaataatgtcaataaggcgttgagagtcttgcagaacaataacgttgacctcgtcaatatcggctccacggatatcgtggatggcaatcacaaactcaccctcggtctcatttggaatattatactccactggcaggtgaaaaatgtgatgaagaacattatggcagggctgcagcaaactaatagtgaaaagatacttctttcatgggtgcggcaaagtacaagaaactatccccaggttaacgttatcaatttcactacctcatggtccgatggtctcgccttgaatgccctgatacacagccatcggccggatctgttcgattggaactccgttgtctgtcagcagtcagccacacagagacttgagcatgcttttaatatcgccaggtatcagttggggatcgagaaactactggatcctgaggatgttgacacaacttatcctgataaaaagtcaatattgatgtacattacatcactcttccaggtgcttcctcagcaggtgtcaatcgaagccatccaggaggtggagatgttgccaagacctccaaaagtcaccaaggaagagcactttcagcttcaccatcagatgcactattctcagcagattaccgtgagcctggcccagggatacgaaagaaccagcagcccgaagccaagattcaagtcttacgcttatactcaagccgcatatgtgactacctccgatccaacccggagtccattcccaagtcagcatcttgaagcaccagaggacaagtccttcggtagcagcctcatggaaagcgaggtgaatctggatcgctaccagacagccttggaggaagtactatcctggctgttgagtgctgaggatacgctacaggctcaaggcgaaatttccaacgatgtggaagtcgtgaaggatcaattccacacccatgaaggctatatgatggacttgactgcacatcagggcagggttgggaatatactccaactgggcagtaagttgataggtacaggcaagctttctgaagacgaagagaccgaagtgcaggagcaaatgaacctgctaaattcacggtgggagtgtctgcgggtggcctctatggagaaacaatccaatttgcacagagagatttcctacgtacctagcacttatcttacagagataacccatgtttcacaggctctcctggaggtggaacagctgctaaatgccccagacctttgcgccaaagactttgaggacttattcaaacaggaggaaagcctcaagaacattaaggatagtcttcagcagtcatctgggagaattgatataattcattccaaaaaaacggccgctctccagtccgcgaccccggttgagagagtcaagctgcaggaggccctgagccagcttgacttccagtgggagaaggttaacaagatgtacaaggatcgccagggcaggttcgacagatcagttgagaagtggaggcgctttcattacgatatcaagatatttaatcagtggctcactgaggccgagcagttcctgagaaagacacagattcctgagaactgggagcatgctaagtataagtggtatctgaaagaactgcaggacggaataggacagaggcagacggtcgttcgaacgctcaacgcgacgggcgaggaaatcattcagcagtcttcaaagacagacgcctccattttacaagaaaagctgggatcattaaacctcaggtggcaagaagtgtgtaagcaattatcagataggaagaaacgactggaagaaaccttggaaaggctgcaggagctccaggaggcgacggacgagctagatttgaagctgaggcaggctgaggtgattaaaggaagctggcagccggtgggcgacctacttatcgacagcctccaggatcatctggagaaagttaaagctcttcgaggagaaattgctcccctgaaggagaacgtgagccatgttaacgacctcgcaaggcagctgacaacactgggcattcagcttagtccatacaacctctcaactctggaggatctcaataccaggtggaaacttctccaggtggcagtcgaagacagggtgcgtcaactgcacgaggcgcacagggattttggccccgcttctcagcatttcctgtccacaagcgttcagggaccgtgggaacgagcgattagtcctaacaaggtgccgtattatatcaatcacgaaactcagaccacgtgctgggaccatccaaagatgactgaactgtaccagtcgctggctgatctgaataatgtgcggttttcagcctaccgcacagctatgaagctccgccgactgcaaaaagcactctgtctggatctgttgtccctcagtgccgcttgtgacgcactggaccaacataatctcaaacaaaacgaccagccgatggatattctgcagataattaattgcctgacaacaatctacgatagattagaacaagagcacaataacctggttaacgtaccattgtgtgtcgacatgtgcctaaactggctcttaaacgtatatgacaccggcagaaccggccgtatccgcgtgttatctttcaaaaccggtattatctctctctgtaaggctcatctcgaggacaaatatcggtatctgttcaagcaggtcgcaagttcaaccggattttgcgaccagaggaggctggggctcctcctgcacgactccatccagatcccccggcagctcggcgaggtcgcctccttcggagggtccaatatcgaaccctctgtccgttcttgttttcaattcgctaacaacaagcctgaaattgaagccgccctcttcctagactggatgcgcctggagccccagagcatggtatggctcccggtactccaccgagtcgctgctgccgagaccgcaaagcaccaggccaagtgcaatatctgtaaggagtgccctatcataggttttcgataccgctcactgaagcacttcaactatgatatttgtcaatcttgctttttctcaggacgcgtcgctaaaggacataaaatgcactatccaatggtggagtactgcacccctacaacctcaggtgaagacgttcgcgatttcgctaaagtgttgaagaacaaattcaggacgaagcgttatttcgcaaaacaccccaggatgggatatctgcccgtccagaccgtgctcgagggtgataatatggagacagatacgatg

SEQ ID NO: 251389 - DNA, 3432 bp, Artificial Sequence
  Description of Artificial Sequence: Synthetic coding sequence
atgctgtggtgggaggaggtggaggactgctacgaacgggaggacgttcaaaagaaaaccttcactaagtgggtgaacgcacaattctcaaagtttggaaaacagcacatcgagaaccttttcagcgacctgcaagacggccgaaggctcctggatcttctggagggattgactggccagaagttgcctaaggagaaaggatccacccgggtgcatgctttgaacaatgtgaacaaggcgctgcgggtcctccagaacaataatgtggatctggtgaacatcggctccaccgacatcgtggacggaaaccacaagctcaccctcggacttatctggaacatcatcctgcactggcaggtgaagaacgtgatgaagaatatcatggctggacttcaacagacgaactccgaaaagatcctcctgtcatgggtgagacagtcgactcggaattacccccaggtgaacgtgatcaacttcactacttcatggtcggacggactggctctgaacgccctcatccacagccaccgccccgacctgttcgactggaactcagtggtgtgccagcagagcgcaacccaacggctcgagcatgcatttaacatcgcccggtaccaactgggaatcgaaaagctgctggacccagaggatgtagacactacctacccggataagaagtccattctcatgtacattacttccctgttccaagtattgccacaacaagtctcgattgaggccatccaggaggtcgaaatgctgccacgcccgccgaaggtcacgaaggaagaacacttccagctgcaccaccaaatgcattacagccaacagatcaccgtgagtctggcccaaggctacgaacggacctcctcaccgaagcctcggtttaagtcctacgcatatactcaggcagcctacgtcactacctcggaccctactaggtccccgttcccttcccagcatctggaagctccagaagataagtcctttggatcgtcgctcatggaatcggaggtgaatctcgaccgctatcagaccgcgcttgaagaagtgctgtcctggcttctctccgcggaggacactttgcaggcacagggagaaatcagcaatgacgtggaagtggtgaaagatcagtttcacacccatgaggggtatatgatggacctcaccgcacatcagggacgggtgggaaacattctccagttgggttctaaactgatcggaactggtaagctgtcagaggatgaagaaaccgaagtgcaggagcagatgaatctccttaattcgaggtgggaatgcttgagagtcgccagcatggagaagcagtcaaatctccaccgcgaaatctcctacgttccatcgacttatctgaccgaaatcacccacgtcagccaagcccttctcgaagttgagcaattgcttaatgcccctgatctctgtgccaaggatttcgaagatctcttcaagcaggaagagtcacttaagaacatcaaggatagcttgcagcagtcgtctgggcgcatagacatcattcactcaaaaaagaccgcggccctgcaatcagcgaccccagtcgaacgcgtgaagctccaagaagcgctgagccagctcgacttccagtgggaaaaagtgaacaagatgtacaaggatagacaaggacggttcgacaggtcggtggagaaatggagacgcttccactacgacatcaagatcttcaatcagtggctcactgaggcggaacagttcctgcgcaagacccagatcccggaaaactgggagcacgccaagtacaagtggtacctcaaagaactgcaagatggaatcgggcaacggcagactgtcgtgcggactctgaacgccactggagaggaaatcatccaacagagctctaagaccgacgcctccatcctccaggagaagctgggttccctgaacctgcggtggcaggaagtgtgcaaacagctctccgacaggaagaaacgcctggaagaaaccctcgagcggttgcaggagctccaagaggccaccgacgagctggacctgaagctgagacaggcggaggtgatcaaggggtcgtggcaaccagtcggtgacctgctgatcgattcactgcaggatcatttggagaaggtcaaggccctccgtggagaaatcgccccgcttaaggaaaatgtgagccacgtgaatgaccttgcacggcaactcaccactctcggaatccaattgtcgccatataacctgtcaactcttgaggatctgaataccaggtggaagctgctgcaagtcgcggtggaggaccgggtccggcaactgcacgaagctcaccgcgactttggacctgcgtcccagcattttctgtcaacttcagtgcagggaccatgggaaagggcaatctccccaaacaaggtgccgtactacatcaatcacgaaacccagaccacctgctgggaccatccgaagatgactgagctgtaccagtccctcgcagatcttaacaacgtgaggttcagcgcttaccgcactgccatgaaactgcggcggctgcagaaggcactgtgtttggatcttctctcgctctccgcggcttgtgatgcactggatcagcataacctgaagcagaacgaccagccgatggacatcctgcagatcattaactgcttgaccaccatctacgatcgcctggagcaggaacacaataacctggtgaatgtgccgctgtgcgtcgatatgtgtctcaactggctgttgaacgtctacgataccgggcggactggacgtattcgcgtcctgtcgttcaagaccggaatcatttccctttgcaaggcccacctcgaggacaaatatcgctacctctttaagcaggtggcatcttcgaccggattctgtgaccaacgccggctgggattgttgctgcacgatagcatccagatcccgcggcaactgggggaggtggcgtcctttggaggctcgaacatagaaccttctgtgcgctcgtgcttccaatttgcaaacaacaaaccagagatcgaagctgccctgtttctcgattggatgagactggagccgcagtcaatggtgtggctcccagtgttgcatagagtggcagccgcagagactgctaaacaccaagccaagtgtaacatttgcaaggagtgcccgattatcggtttccggtacaggtcactgaagcactttaactacgatatctgccaatcgtgcttcttttcaggccgggtggcgaagggtcacaagatgcattaccctatggtggaatactgtacgccgactacctctggagaagatgtgagagatttcgccaaagtgctgaagaacaagttcagaaccaagcgctactttgccaagcatcccagaatgggatacctgcccgtgcaaacggtgcttgaaggagacaacatggaaaccgacactatg

SEQ ID NO: 251390 - DNA, 3432 bp, Artificial Sequence
  Description of Artificial Sequence: Synthetic coding sequence
atgctttggtgggaggaggtggaagattgttacgaacgcgaagatgtgcaaaagaaaacttttaccaagtgggtgaacgcccaattctccaagttcggtaagcagcacatagaaaatctcttctcggatcttcaggacggacgccgactcctggatctccttgaagggctgactggacaaaaactgcctaaagaaaaaggatctaccagagtgcacgcgctcaataatgtgaacaaggcactgagagtgcttcagaataacaacgtcgacctggtgaacattgggtcgactgatatcgtcgacggcaaccataagctgactctcgggctgatctggaacattatactgcattggcaagtcaaaaacgtcatgaagaacataatggcaggactgcaacaaactaactccgagaagatccttctttcatgggtccgccaatcgacccggaattaccctcaagtgaatgtgatcaactttactacttcctggtccgatggtcttgcgctgaacgccctgattcattcccacagaccagaccttttcgattggaatagcgtcgtgtgtcaacagtcagcaacgcaacgccttgagcacgccttcaatatcgcacggtaccaactcggaattgagaagttgctcgacccagaagatgtggacaccacttaccccgacaagaaatcaatcttgatgtacataacttcgctttttcaggttctcccacagcaagtctcgattgaagcaattcaagaagtggaaatgcttcctagacccccaaaagtaaccaaggaagaacactttcagctgcatcatcaaatgcactactcccaacagatcaccgtctcgctggcccagggatacgagaggacctcgtccccaaaacccagatttaagtcatacgcatacactcaagcagcctacgtcactacctcggaccctaccagatcgccttttccttctcagcacctggaagcacctgaggataagagcttcggttcgtcgctcatggaatcagaagtgaacctggacaggtaccaaaccgcactggaagaggtgctttcgtggcttctcagcgcagaggatacgttgcaagcccaaggggagatctcgaacgacgttgaggtggtcaaggaccagttccacactcatgagggatacatgatggatttgaccgcacatcagggtagagtgggaaacattctccaacttggcagcaagctgattggtactggtaaactctcggaagatgaagagactgaagtccaagaacaaatgaatctcctgaactccagatgggaatgtctgcgggtcgcgtccatggaaaagcaatccaacctgcaccgtgaaatttcatacgtgccatcgacttacctcaccgagatcacgcatgttagccaggccctcctggaggtggagcaattgttgaacgcacccgatctgtgtgctaaggattttgaggaccttttcaagcaggaagagtcactgaagaatatcaaggactcgctgcaacaatcgtcaggacggattgatatcattcattcgaagaaaaccgctgcgcttcaatcggccaccccggtcgaacgggtgaaattgcaggaggccctgagccagctggacttccaatgggaaaaggttaacaaaatgtacaaggatcgccaaggccgatttgatcgatccgtggaaaagtggcgcaggtttcattatgacatcaaaatctttaatcaatggctcaccgaggcagaacaatttctcagaaagacgcagataccagaaaattgggagcacgccaagtacaaatggtacctgaaagaactccaagatgggatcggtcaacgccaaaccgttgtgagaaccctgaacgcaaccggagaagagattatccaacaatcaagcaagacggacgcctcaatcttgcaggaaaaacttggttcactcaatctgcgctggcaagaggtctgcaagcaactctccgacagaaagaagaggcttgaggaaaccctggagcggctgcaagaactgcaagaagcaactgacgaactcgaccttaaactgagacaagccgaggtcataaagggatcgtggcaacctgtgggagacttgctcatagacagccttcaagatcacctggagaaggtaaaagccctgcggggtgagatcgcaccactgaaggaaaacgtgtcacacgtcaacgatcttgcacggcagctgactaccctgggcattcagctttcgccatataacttgtcgactctggaagatctgaacacgcggtggaagctgttgcaagtggcggtggaggaccgcgtgagacaactgcatgaagcacaccgcgatttcggtcctgcaagtcaacattttctttccacctccgtgcagggtccttgggagagagccatctcacctaacaaagtgccctattacattaatcatgagactcagaccacttgctgggaccatccaaaaatgaccgagctgtatcaatcgcttgctgatcttaacaacgtgagatttagcgcatatagaaccgcaatgaagctcagaaggcttcagaaggccctctgccttgatctcctgtcgctttcagccgcatgtgatgcacttgatcagcacaaccttaagcaaaacgatcaacctatggacatcctccagataatcaactgtctcactactatctacgatcgcctggaacaggagcataacaatcttgtcaacgtgcccctgtgcgtggatatgtgtctgaattggctgcttaacgtctacgacaccggtcgtactggaagaattagagtgctctccttcaagactggcattatctcgctttgtaaggctcatctcgaagataagtatcggtacctgtttaagcaagtggcttcctcgactggattttgtgatcagcggaggctcggacttcttctgcatgattccatacaaatacctagacagctgggagaagtcgcatcgtttggcggatccaatatagaaccatcggttagatcgtgctttcaattcgctaacaacaagccggaaatagaagcagcgctttttctggactggatgcgtctggaaccccaatctatggtgtggttgcctgtgctgcacagggttgcagcagcagaaaccgccaagcatcaggcgaagtgcaatatctgcaaagaatgtcccattatcggatttagatacagatcgctcaaacatttcaactacgacatttgtcagtcgtgcttcttttcaggacgcgtcgctaagggacacaaaatgcactaccctatggtcgaatactgtaccccgaccacctccggcgaggatgtccgtgacttcgcaaaagtgcttaagaacaagtttagaaccaagcggtactttgcgaaacatcccaggatggggtatctgccggtgcagaccgtgctggagggggataacatggagactgacaccatg

SEQ ID NO: 251391 - DNA, 3432 bp, Artificial Sequence
  Description of Artificial Sequence: Synthetic coding sequence
atgctgtggtgggaggaggtagaggactgctacgaaagggaagacgtccaaaagaagactttcactaaatgggtgaatgctcaattctcgaagtttggtaagcagcacatcgagaatctgtttagcgatctccaagatggaagacggctgctggatctcttagagggcttgactgggcagaagctcccaaaagaaaaaggatccacacgcgtgcacgcattgaacaacgtcaataaggccctccgtgtgcttcagaataataatgtagatctggtgaacatcggcagcaccgacatcgtcgatggcaaccacaaacttacgctcggcctcatttggaacattatcctgcactggcaggtaaaaaatgtcatgaaaaacatcatggccgggctacaacagaccaactcagagaaaatcctcctttcctgggttcggcagtccactaggaattacccccaggtgaacgtgattaacttcactacgtcatggtctgacggtctcgccctgaacgccctgattcattcacatagacctgatctgttcgattggaattcagtggtatgtcagcagagtgccacacagcgattggaacacgcgtttaacatcgctcgttatcagcttggaatcgagaaactcctggacccagaagatgtagacacaacataccccgacaagaagagcattcttatgtacatcacaagtctgttccaggtcttgccacaacaggtatcaatcgaggcaattcaggaagtggagatgctcccgcgccctccaaaggtgactaaggaggagcacttccagctccatcatcagatgcattactcccaacagattaccgtctcactggcccaggggtatgagaggacctcatctccaaaaccccggttcaaatcctatgcatacacccaggcagcctacgtgactacatcagacccgactcgtagcccattcccttcacagcacctggaggcgcccgaagacaagtccttcggatcatccctgatggagagcgaagtcaacctggatcgctaccagactgccctggaggaggtgctgagctggctgctgtcagccgaagatacgttacaggctcagggcgaaatatctaacgacgttgaggtggtcaaagatcagtttcatactcacgagggttacatgatggacctgacggcacatcagggtcgagtgggcaacatccttcagctgggaagcaagctgattggtaccgggaaactgtcagaggatgaagagaccgaagtccaggagcagatgaatctattgaatagtagatgggaatgtctgcgggtagctagcatggaaaagcagtctaacctacacagagagataagttatgtgccaagcacttacctgaccgaaatcacgcatgtgtctcaggcgctgttagaggtggagcagttattgaacgcgccagatctgtgcgctaaagattttgaggacctgtttaaacaggaagaatctctcaagaacattaaggatagcttgcagcagtcatcagggaggattgacatcatccacagcaaaaaaacggccgcccttcagagcgcgacacccgtcgagagggttaagctgcaagaggccttgtcacaactagatttccagtgggaaaaggtcaataagatgtataaggaccgccaagggcggttcgaccgaagtgtcgaaaaatggagacgattccactacgacatcaagatatttaaccaatggctgactgaagctgagcagttcttaaggaagacgcagatccctgagaactgggagcacgccaagtataagtggtatctgaaggagctgcaagacgggatcggacaaagacagactgtggtgcggaccctgaatgctactggggaagagatcatccagcagtcctccaagaccgatgcatccatcttgcaggaaaaactaggatccctaaatctccgctggcaggaagtctgcaagcaactttcagaccggaagaagaggcttgaggaaacactagagaggctgcaagagctgcaggaggccactgacgaattggacttaaagctccgacaggcagaggtcatcaaaggaagctggcaaccagtgggggaccttctaatagattccctgcaggatcatctagaaaaggtaaaggccctccggggggaaatcgcacctctcaaagaaaatgtgagccatgtaaatgacttggcccgacagctgacaactctcggaatccagctgtcgccatataatctgtcaacgcttgaggatctgaacacgcgctggaagcttctgcaggtggcggtggaagatcgggtgcggcagctgcacgaggcacaccgagatttcgggccagcctcacagcatttcctgtcaacttctgtccagggaccttgggagagggccattagcccaaacaaagtaccctattatatcaaccacgagacacaaaccacatgctgggaccatccgaagatgactgaactgtatcagtccctcgctgacctaaataacgtaagattcagcgcttatcggacggcgatgaagctgagacgcttacaaaaggcactgtgcctggacctgctcagcctgtccgctgcctgcgacgccctcgatcagcataatctgaagcagaacgaccagcccatggacattctgcagattatcaactgcttgaccaccatctatgatagactggaacaagagcacaataacctcgttaatgtccccttgtgcgtggacatgtgcctcaactggctcctgaacgtgtatgatactggtcggaccggccggatcagagtattgtctttcaaaacaggcatcatttctctctgcaaagcccacctcgaagataaataccggtatctctttaagcaggttgcgtcctcaactggattctgtgaccagcggagactcggtctgctgcttcacgactctattcagattccaaggcagctcggggaggtggcatcatttggcggctctaacatagaaccatcagttcggagctgcttccagtttgccaacaacaagccggagatcgaggccgcactgttcctggattggatgaggcttgaaccacagtcaatggtgtggcttccagttctgcacagagtggctgcagctgagaccgctaaacatcaggcaaaatgtaatatctgtaaagagtgtccaataatcggatttaggtacaggtccctcaaacatttcaattatgatatttgtcagtcctgtttcttctcagggagggtggcaaaaggtcataaaatgcattacccgatggttgagtattgtacccccactacttccggcgaggatgtgagggactttgccaaggttctgaagaacaaatttaggacgaagaggtactttgccaaacacccgcggatgggctacctgccggtccagacagtcctggagggagataatatggagaccgacaccatg

SEQ ID NO: 251392 - DNA, 3432 bp, Artificial Sequence
  Description of Artificial Sequence: Synthetic coding sequence
atgctgtggtgggaagaagtggaggattgctatgaacgggaagacgttcagaaaaaaacgttcacaaaatgggtcaacgcccagttctcaaagttcggcaagcagcatatcgaaaacctattcagcgacttgcaggatggaagacgcctcctagatctccttgagggcttgaccggacagaagctgccgaaggaaaagggtagcacaagggtgcatgcacttaacaatgtcaataaggccctgcgggtactgcagaataataatgtggacttggtgaacataggcagtactgatattgtggacggcaaccataaattgaccctcggattgatttggaatataatattgcactggcaggttaagaacgtgatgaaaaatataatggcaggactccagcagacaaacagcgaaaaaattctgctaagctgggtccggcagtcaacgcggaactatccccaggtgaatgtgattaactttacaactagttggtccgatgggctagccctcaacgctttgattcacagccaccgaccggacctgtttgactggaatagcgtggtgtgtcaacagtctgctacgcaacgtctggaacacgccttcaacatagcacggtatcagctgggcatagagaaacttctggacccagaggatgttgataccacataccccgataagaagtctatcctgatgtatatcacgtctctgttccaggttctgccacaacaggttagtatcgaagccattcaagaggttgaaatgcttccacgaccccccaaagttacgaaagaagaacattttcagctgcatcaccaaatgcactacagtcagcagataaccgtgagcttagcgcagggctacgagaggacctcgagccccaagccccgattcaagtcttatgcctatacacaagccgcttatgtgacaacctcagaccccacacgcagcccatttccaagccagcacttggaagcccccgaggacaaatcgttcggtagtagcctgatggagagtgaggtcaatctggataggtaccagacggctttagaggaagtgctgtcttggttgctgtccgcggaggacaccttacaggcccagggtgagatttctaatgatgtggaagtggtcaaggaccagtttcacacgcacgaggggtacatgatggatctgacagcgcatcagggacgggtcgggaacatcctacaactcggctccaaactgatcggcaccggcaaactatcagaggatgaggaaaccgaagttcaggagcagatgaatttgttgaactccagatgggagtgtttgcgtgtggccagcatggaaaagcaatctaaccttcaccgcgagatatcctatgtcccttcaacctacctcactgaaataacccatgtctcccaggccctactggaagtcgagcaactcctgaatgcccccgacctgtgcgcaaaagatttcgaagatctgtttaagcaggaggagtccctcaagaacatcaaagatagtctccagcagtcttctggtaggattgatattatccatagcaaaaagacagccgccttacagtctgccacccctgtggagagagtcaaacttcaggaagctctgtctcagttagatttccagtgggagaaagtgaataagatgtacaaggataggcaaggcagatttgatcgtagcgtggaaaaatggaggagatttcactatgacattaagatttttaaccagtggcttactgaggctgagcaattcctccgaaagacacagatccccgagaactgggagcacgctaaatacaagtggtatctcaaggagttgcaggacggcatcggccagaggcaaaccgtggtcaggaccctcaatgctaccggcgaggagatcatacagcagtcaagtaagacagacgcaagcatattgcaagagaagctgggttccctgaacctgcgttggcaggaggtgtgtaaacagctcagtgatcggaagaaaagactggaggagaccctggaacggctgcaggagttgcaggaggcgaccgatgagctggacttgaagctgcgccaggccgaagtgattaaaggtagctggcagcctgtaggcgacctgttaatcgatagccttcaggatcatctagaaaaggtaaaagctttgcgcggcgaaatcgctccactaaaggaaaatgtatctcacgtgaacgacctcgcaaggcagctaactaccctgggcatccagcttagcccatataacctcagcacactggaagaccttaacacccgctggaaactgctccaagtcgccgttgaagacagagtacggcagcttcacgaagcccaccgagatttcggtccagccagtcaacattttctgtctaccagcgtccagggaccttgggaaagggcaatatctcctaacaaggtgccatactatatcaatcacgagacccagactacatgttgggaccaccccaagatgactgagctgtatcagtctctggccgatctgaacaatgtgagattcagtgcataccgcacagctatgaagctgcggcgattacaaaaggccctgtgtctggatctgctctcactctcagcagcctgcgatgctttggatcaacataatcttaagcaaaatgaccagccgatggatatactccaaataattaactgtttaacgacaatttacgatcgcctggaacaggagcataataaccttgtcaacgtccctctctgtgtagacatgtgtctaaactggctgcttaatgtttacgacaccgggaggacgggccgcatccgagtcctgtcgttcaagactggcataatctctctgtgcaaggctcatctcgaggacaaatatagatatctgtttaagcaggtcgcctctagcaccggcttttgtgaccagagaagactcggccttcttcttcacgacagcattcaaatccctaggcagcttggcgaggtcgcaagctttggcgggtcaaatatcgagccttctgtgagatcctgttttcagttcgctaacaataaacccgagatcgaggccgcccttttcctagattggatgaggcttgagccccagtccatggtgtggctcccggttttacatcgagtcgcggcagcggagaccgcaaaacaccaggctaagtgtaatatctgcaaggaatgtcccatcataggatttaggtacaggagcttgaagcacttcaactacgacatctgccagagctgtttcttttctggaagggtggccaaggggcacaagatgcactatcctatggtcgagtactgtaccccaacaaccagcggcgaggatgttcgcgactttgcgaaggtactcaaaaataagtttaggacaaaaagatatttcgccaaacaccccaggatgggatatttgcccgtacagaccgttctagaaggggataatatggaaactgacacaatg

SEQ ID NO: 251393 - DNA, 3432 bp, Artificial Sequence
  Description of Artificial Sequence: Synthetic coding sequence
atgctgtggtgggaagaagtcgaggactgttacgagcgcgaagatgtgcagaaaaagacttttactaagtgggtgaatgcgcagttctcaaaattcggaaaacagcatattgagaacctcttcagcgacctgcaggacggcagacgcctcctcgacctgcttgagggtcttacgggacagaaactgccgaaggagaaagggtctacccgcgttcacgcgctgaacaacgtgaataaggcacttcgcgtgttgcagaacaataacgtcgacctggttaacatcggttcaaccgatatcgtggacggaaaccataagctgactctggggctcatctggaacatcatcctccattggcaagtgaagaacgtgatgaagaacatcatggctggactgcagcagactaattccgagaagatcctgctcagttgggtccgccaaagcacccgcaactaccctcaggtgaatgtgattaacttcactacctcctggtcagatggcctggccctgaatgcgctgatccactcccaccgcccagatctgttcgactggaattccgtggtgtgccagcaatcggctacccagcgcctggagcatgccttcaacatcgctagataccaactcggaatcgagaaacttctcgatccggaggacgtcgacaccacttacccggacaaaaagagcatcctgatgtacattacttcgctgtttcaggtgctcccccagcaggtgtcaattgaagcgatccaggaggtggagatgctgcctcgccctcctaaggttaccaaggaagaacatttccagttgcatcaccagatgcactactctcagcagatcaccgtctccctcgcacagggctacgagagaacttcaagccccaagcctcgcttcaaaagctacgcgtacacccaagcagcctacgtgacgacttcggacccaactagaagcccgtttccaagccagcatcttgaggctcccgaggacaagtccttcggatcctcactcatggaatccgaggttaatctggatcggtaccaaactgctcttgaagaggtgctctcatggttgctcagcgcggaggatactctccaggcccagggcgaaatctccaatgacgtcgaggtggtgaaagatcagttccatacccacgagggttacatgatggacctgactgctcatcaggggcgcgtgggaaacatccttcagctgggctcaaagctgatcggcactggtaagctctctgaggatgaggaaactgaagtgcaggagcaaatgaaccttttgaacagccgctgggaatgcttgagagtggcgtcgatggagaagcagagcaatcttcatagggaaatttcatacgtgccgtcgacctacctgactgaaatcacgcatgtgtcccaggccctcctggaggtcgagcagctccttaacgccccagatctgtgcgcaaaggactttgaggatctcttcaaacaggaagaatccttgaagaacattaaagatagcctccaacaatcgtccggaagaattgacatcatacactcaaagaaaactgccgccctgcaaagcgccaccccggtggaacgggtgaaactgcaagaggcccttagccaattggacttccaatgggagaaggtgaacaagatgtacaaagacagacaaggccggttcgatagatccgtggagaaatggcggcgcttccactacgatatcaaaatcttcaaccaatggctgacggaggccgagcaattcctgcgcaagacgcagatccccgagaattgggagcatgcaaagtacaagtggtatctcaaggaattgcaggacggaattggtcaacgccagaccgtggtccgcaccttgaacgccaccggcgaagagatcatccagcagtcctcgaaaaccgacgcctcaatcctccaagaaaagttgggatcgctgaacttgcggtggcaggaagtgtgcaagcaactctcggacaggaagaagcggctcgaggagactctcgaacgcctccaggaactccaggaagcgaccgacgagctggacctcaagctccggcaggcggaagtgatcaaaggatcgtggcagcccgtgggggacctgctgattgactccttgcaggaccatctggaaaaggtgaaggcactccggggggagatcgcaccactgaaggaaaatgtcagccacgtgaatgatctggctcggcagctcactactttgggcatccagctgtccccatataacctgtccactctcgaggatctgaatactcgctggaaattgctgcaggtcgcagtcgaggatagagtgagacagctgcacgaagcccatcgagactttggcccggcttcgcaacatttcctctcgacctccgtgcaaggaccgtgggaacgggctatctcgcccaacaaggtgccatactacatcaaccatgaaactcagaccacttgttgggatcaccccaaaatgaccgagctgtaccaatctctggctgacctgaacaacgttcgattctcggcatatcgtaccgccatgaagctgcgccgactgcagaaggccctgtgtttggatctgctctccctgtctgcagcgtgcgacgcgctggaccagcacaatctgaagcagaacgaccagccaatggatatcctgcaaatcataaactgcctgaccaccatctacgatagactggaacaagaacacaataatctggtgaacgtgccgctctgcgtcgacatgtgcctgaattggttgcttaatgtgtacgacaccggtcggaccgggcgcatccgagtgctgagcttcaaaactggtatcatcagcttgtgcaaagcgcacctggaggacaaataccgctatctcttcaagcaggtggcttcatcaactggattctgcgaccagagaagattgggcctgctcctgcacgactcaatccagatcccaagacagttgggagaagtcgcgtcattcgggggatccaacatcgaaccgtcggttcgctcgtgcttccagttcgccaacaataagccggagatcgaggcggcactcttcctggattggatgagacttgaaccccaatccatggtctggctgccggttctccatcgcgtggcggccgccgaaactgcaaagcaccaggccaagtgtaatatctgcaaggagtgtccgatcattggattccgctacagatccctgaagcacttcaattacgatatctgccagtcatgctttttctccggacgcgtggccaaaggacacaaaatgcattatcctatggtggagtattgcaccccgacgacttcgggagaggatgtgagagacttcgcgaaggtgctgaagaacaagtttcgaactaaacgctactttgctaagcaccccaggatggggtacctcccggtccaaaccgtgctggagggggacaacatggaaactgatacgatg

SEQ ID NO: 251394 - DNA, 3432 bp, Artificial Sequence
  Description of Artificial Sequence: Synthetic coding sequence
atgttgtggtgggaagaggtggaggattgttacgaacgggaggacgtgcagaaaaaaacctttaccaaatgggtgaacgcgcagttttccaagtttggaaagcagcacatcgaaaatctgtttagcgacctgcaagacggcagaaggctgctggacctgcttgaaggtttgacaggccaaaaactgccgaaggaaaaaggatctactcgcgttcatgctctgaataatgtgaacaaggctttaagagtgctgcagaacaacaacgtggatctggtcaacatcggatcaacagacatcgtagacgggaaccataaacttaccctcggactgatctggaacatcatccttcactggcaggttaaaaatgtgatgaaaaacattatggctggtctgcagcagaccaacagcgaaaagatcctgctcagctgggtgaggcagagtacccgcaactacccacaagtcaacgtcatcaactttacaacttcctggtctgatggcctggctttgaacgctctgattcacagccacaggccagacctttttgactggaatagcgttgtatgccagcaaagtgccacacagaggctagagcacgctttcaacatagcaaggtaccagcttggcatcgaaaaactgcttgatccagaggacgttgacacgacttaccctgacaagaaaagcattttgatgtatatcacctcgctctttcaggtgctcccccagcaagtgtctattgaagctatccaagaagtagagatgcttccaaggcctccgaaagtaactaaggaagaacacttccagttacatcaccagatgcactactctcagcaaattactgtgtctcttgcccaaggctacgaaaggacatcctcccccaaaccaaggtttaagtcttacgcctacacccaggcggcctacgtgactactagcgaccctaccagaagtccgttccccagccaacacctggaagcgcctgaagacaagtccttcgggtcctccctcatggaaagcgaagtaaacctggatcgctaccaaacggcacttgaggaagtcctgagctggcttttgtcagccgaggacactctccaggcccagggagaaatctcgaatgatgtcgaagtcgtgaaagatcaatttcacacccatgagggatacatgatggatctcacagctcatcagggccgagtgggcaacatcctccaacttggtagtaagctgattggaaccggaaaactgtctgaggacgaggaaaccgaggtccaggagcagatgaatctgcttaatagtaggtgggagtgcttgagagtggcttcaatggaaaaacagagcaacttgcaccgagagatatcttatgtgccctccacctacctgacagagatcacacacgtgagccaagcattgctggaagtggagcagctgcttaacgctcctgatttgtgcgcgaaggacttcgaggacctgtttaagcaggaagagtctctgaagaatatcaaggatagtctccaacagagtagtggacggattgatatcatccacagtaagaaaactgcagcccttcaatctgccaccccagtggaacgggtgaagctgcaggaggccctgagtcagctggactttcagtgggagaaagtcaacaaaatgtataaggacagacaaggccgcttcgataggagcgtagagaagtggcgcagatttcactatgatatcaagatcttcaaccaatggctgacagaggcggagcagttcttgaggaaaacccagatccctgagaactgggagcacgcaaaatacaaatggtacctgaaggagctgcaggacggaatcggacaacgccaaaccgtcgtgcgcaccctgaacgctacaggagaggaaattattcagcagtcttcaaagacagacgccagcatcctgcaagaaaagctgggaagcctaaatttgaggtggcaagaggtgtgtaaacagctttcagaccgcaaaaagcgtctggaagagacactggaaagacttcaggaactgcaggaggctaccgatgagttggacctgaagctcagacaagccgaggtgataaaagggagctggcagcccgtcggggacctcttaatcgatagtctccaagatcatttagaaaaggtgaaagctctgaggggggaaatcgccccactgaaagaaaatgtctctcatgtgaacgatctggctagacaattgacaaccctgggaatccagctgtccccatataatctaagcacacttgaggatctgaacaccaggtggaagctgctccaggtcgcagtcgaagacagagtcaggcagttgcacgaggcccatagggattttggcccagcatctcaacatttcttgtctacttccgtgcaaggcccttgggagcgtgcaatatcaccaaataaggttccttactacatcaatcatgagacacagactacatgctgggatcaccctaaaatgacagaactctatcaatcgttggccgaccttaataatgtcaggtttagcgcttaccgcactgctatgaagttaaggcgtttacagaaggctctgtgtctggacttactgtcattatccgcagcttgcgacgctctggatcagcacaacctgaagcagaacgaccagccaatggacattcttcaaattatcaactgccttaccacaatctatgatagattggagcaagaacataacaaccttgtgaacgtgcccctttgtgtggatatgtgtctgaactggctgctcaacgtgtacgacaccggtaggaccggtcggattagggtgctctctttcaaaacaggaattatctctctctgtaaagcccaccttgaggacaaatacaggtacttgtttaaacaggtcgctagctctaccggattctgcgatcagagaagactggggctgcttttgcatgactcaatccaaatccccagacaactgggagaggttgctagctttggaggatcgaacatagagccatccgtgcggagttgtttccagtttgctaacaacaagcccgagatcgaagctgccctctttctggactggatgcgccttgaacctcagtctatggtttggcttcccgtactgcaccgcgtggctgctgctgaaaccgctaaacaccaagctaaatgcaatatttgcaaagagtgtcctattattgggttcaggtacagatctttgaagcattttaactacgacatctgtcagagctgctttttttctgggcgcgtggcaaaagggcacaaaatgcattatccaatggtcgaatattgtacccctaccacttccggggaagacgtgagggactttgcaaaagtcctgaaaaacaagtttagaaccaagcgctatttcgcgaagcacccaagaatgggatacttgccagtgcagactgtgctggagggcgacaacatggagacggataccatg

SEQ ID NO: 251395 - DNA, 3432 bp, Artificial Sequence
  Description of Artificial Sequence: Synthetic coding sequence
atgctctggtgggaagaggtcgaagattgttacgaaagggaggatgtccagaagaaaaccttcaccaaatgggtgaatgcacagtttagcaagttcggaaagcagcacatagagaacttgttttcagatctgcaagacggacgacggctgctggatctcttggaaggtcttaccggacagaagctgcctaaagaaaagggttccactagagtccacgctctgaacaatgtcaataaggcactccgtgtgctgcaaaacaacaatgtggatcttgtgaacatcggatccactgacatcgtggatggaaaccacaagttgactcttggtctgatctggaacattatactccattggcaggtgaaaaacgtgatgaagaacattatggcagggcttcagcaaaccaactcagaaaagatccttctgtcgtgggttcgtcagagcacgcgtaactaccctcaagtcaatgtgataaacttcaccacctcgtggtccgatggactcgcactgaacgcactgatccacagccatcgccccgatttgttcgactggaactccgtggtgtgccagcaatccgctacccaaaggcttgagcatgcatttaacatagcacgctaccaacttggaatcgaaaaacttctcgatcccgaagatgttgacaccacttatccagataagaagtcgatattgatgtacataacttcgctctttcaagtcctgccgcaacaggtgtccattgaggctattcaagaagtggaaatgctcccaaggccacccaaggtgactaaagaagaacattttcaactgcatcatcagatgcattacagccaacaaatcactgtgtcattggcccagggctacgagcggacctcatcccctaaaccccgtttcaagtcgtacgcatacacccaagccgcatacgtgacgacttcagatcccactcggtcaccttttccatcgcaacatctcgaagctcccgaggacaagtcctttggttcatcactcatggagagcgaagtcaacctcgatcggtaccagaccgctctggaggaggtgctttcgtggcttctgtccgcagaagataccctccaagcacaaggggagatttcgaacgatgtggaagtggtgaaggaccaatttcatactcatgaaggctacatgatggatctcactgctcatcaaggtagggtcggaaacattcttcaacttgggagcaagctcattggaactggaaaactgtccgaggacgaggaaaccgaagtccaggaacagatgaatctgcttaactcgcgttgggaatgtcttagggttgcatcaatggagaaacagtcaaacctgcaccgcgaaatctcttacgttccctccacctacttgaccgaaattacccatgtcagccaggcacttcttgaggtcgaacagcttctcaacgcgcctgacctgtgtgcaaaggacttcgaagatctcttcaagcaagaggaaagcctcaaaaacataaaggattcgcttcaacagtcgtccggtagaatcgacatcattcactcgaagaaaaccgccgcactgcaatcagccacgccggtggaacgagtcaaacttcaagaagcactcagccaactggatttccaatgggaaaaggtgaacaaaatgtacaaggatagacagggcagatttgaccggtccgtggagaagtggcggcggttccattatgatatcaagatctttaaccaatggctgacggaggccgaacagttcttgagaaagactcaaattccagaaaactgggagcatgcaaagtacaagtggtaccttaaggaactgcaagatgggatcggccagagacaaactgtggtccgcactttgaatgccactggtgaagaaatcattcagcagtcgtcgaaaacggatgcttccatcttgcaagaaaaacttggtagcctgaacttgcggtggcaggaagtctgtaagcagctgagcgatagaaagaaacgacttgaagagactcttgaaaggctgcaggagctgcaagaagcgaccgacgaactggatctgaaactgagacaggcggaggtgataaagggatcgtggcaaccggtgggagatctcctgattgattccctccaagatcaccttgaaaaagtgaaggcacttcgtggtgaaatcgcacctcttaaagagaacgtgtcgcacgttaatgatcttgcgcgacagctcactactctcggaattcagctgtctccctacaatctgtcgactctggaggatcttaatactcgatggaaactgctgcaggtggccgtcgaagatcgtgtccgacaattgcatgaagctcatcgcgacttcgggcctgcatcccagcactttctttcgacctcggtgcaaggtccttgggaacgcgccatctcacctaacaaggttccatactacataaaccatgaaacccaaactacctgttgggaccatcctaagatgacggaactttaccaatcgctggcagatcttaacaacgtgaggtttagcgcataccgcactgctatgaaacttagacggctgcagaaagccctttgtctggatctgctttccctttcggctgcctgcgacgcgctggaccagcacaatctgaagcaaaacgatcagcctatggacattctgcaaatcattaactgcctgactaccatttacgacagacttgagcaagagcataacaatctggtcaacgtcccattgtgtgtggatatgtgcctcaactggctcctcaacgtctacgacaccggaagaaccggtaggatccgcgtcctgagcttcaagaccggaatcatttcactctgcaaggcccatctcgaagataagtaccgatacctcttcaaacaggtggccagctctaccgggttttgcgaccagaggaggcttggccttcttctgcacgattccattcagattcctcggcagctcggagaggtcgctagctttggcggatccaacatcgagccttcagtgcgctcatgctttcagtttgcaaataacaagcctgagatcgaggcagcactttttcttgattggatgcgactggagccacagtcgatggtctggcttccagtgctgcatagggttgccgcagccgagactgctaagcaccaggcaaagtgtaacatttgtaaagaatgcccaatcataggttttagatacaggtcactcaaacatttcaattacgatatttgccagtcgtgcttcttttcgggacgtgtcgcgaagggacataagatgcactaccctatggtggaatactgtacccctacgaccagcggtgaggatgtgcgcgattttgcaaaggtgctgaagaataagtttagaaccaagagatactttgcaaaacacccgagaatgggatacctgccggtgcaaacggtgctcgagggcgacaacatggagactgatactatg

SEQ ID NO: 251396 - DNA, 3432 bp, Artificial Sequence
  Description of Artificial Sequence: Synthetic coding sequence
atgctgtggtgggaggaagtggaagattgttacgaacgcgaggatgtgcaaaagaaaacctttactaagtgggtgaacgcacagttttcgaaatttggaaagcagcatatcgaaaaccttttctccgatctgcaagacggtcggcgccttctggaccttcttgagggactgacggggcagaagctcccaaaagagaagggttccactagagttcacgcactgaataacgtaaacaaagccctgcgggtgcttcagaacaacaacgtggatctcgtgaacataggctcgacggatatcgtggacggaaatcataagctgactctgggccttatatggaacataattctccattggcaggtgaaaaacgtcatgaaaaacatcatggcaggactgcagcaaaccaactcggaaaagattcttcttagctgggtccgacagtcaacccgaaactaccctcaggttaacgtcattaactttactactagctggtccgatggacttgcactcaatgcactgatacattcccaccgtccagatctgtttgattggaactccgtggtttgccaacagtcggcaacccagaggctcgagcatgcattcaacattgctcgataccagctgggcattgagaagttgcttgaccctgaagatgtggatactacttaccctgacaagaaatctatccttatgtatatcacctcgctctttcaagtgctgcctcaacaagtgtcgattgaggccatccaagaagtggaaatgctgcccagaccgcccaaggtgactaaagaagaacattttcaactccaccatcaaatgcactattcccaacaaatcactgtatcgctggcgcaggggtacgagcgcacctcatcgccaaagcctcgttttaagtcatacgcgtacactcaagctgcctacgtgaccacctcagatcccactcgcagcccttttccttcccagcatctggaagcgcctgaagataaatcttttggttcctcccttatggaaagcgaagtcaatcttgatcggtaccagacggcgcttgaagaagtccttagctggctgctctcggcagaagataccctgcaagcacagggagagatctcgaacgatgtggaggtggtgaaagatcaatttcatactcatgaagggtacatgatggacctcaccgcccaccaaggaagagtgggaaatatcctccagttgggctccaagctgataggaaccggtaagctgtctgaagatgaggaaaccgaagtccaggaacaaatgaatctgcttaattcgagatgggaatgtctgcgggtggcgagcatggagaaacagtccaatctgcaccgggagatttcatacgtgccttcaacctaccttactgagattactcacgtctcgcaagcacttttggaagttgaacaacttctgaacgcaccagacctttgtgccaaggattttgaagatctgtttaaacaagaagaatcactcaaaaacattaaggattccttgcagcagtcctcgggacggattgacataatccattcgaaaaagactgcggcactgcaaagcgcaacgcccgtcgagcgggtgaaacttcaggaggctctgtcccaactcgattttcaatgggaaaaggtgaataagatgtacaaggatagacaaggcagatttgatcgctccgtggaaaagtggaggagatttcactacgacatcaaaatctttaatcagtggcttacggaggcagagcagttcctcagaaaaacgcagattccagaaaattgggaacatgcaaaatacaagtggtaccttaaggaactgcaggacggtatcggacagaggcagactgtggtgcggaccctgaacgcaacgggggaagagatcatacaacagtcatccaagaccgatgcatcaatactgcaagagaaacttggcagcctcaatctgcgttggcaggaggtgtgtaagcagctgtccgatcggaaaaaacggctggaagaaaccctggaaagactccaggaactgcaagaagcaactgacgaactcgatctcaaactgaggcaggctgaggtgatcaagggatcgtggcaacctgtgggtgatcttctcatagatagcttgcaagatcacctggagaaagtgaaggcgctcaggggtgaaattgcacccctgaaggaaaacgtgtcacacgttaacgacttggctcgacagctgactacccttggcatccagctgagcccatacaacctgagcactctcgaggatctcaacactcgctggaagctcctgcaagtggccgtggaggacagagtgcgccagctccatgaagcacatagggattttggacccgcatcgcagcatttccttagcacctcagtccaaggcccatgggaacgcgcaatttcgccaaataaggtcccgtactatatcaaccacgaaacccaaaccacctgctgggaccaccctaagatgactgagctgtatcaatcccttgccgaccttaacaacgtccggttttcagcataccggaccgcaatgaagctcagacgcctccagaaagccctctgtctcgacctgctgtcccttagcgcggcctgtgatgcccttgatcaacataaccttaagcaaaacgatcagcctatggacatactgcagataatcaactgcctgaccactatctacgatcgtctggaacaagaacacaacaatctcgtgaacgtccccctttgtgtcgatatgtgtttgaactggctgctgaacgtgtacgataccggcagaaccggacgcatccgggtcctttcctttaagaccggtatcatttcactttgtaaggcacatctggaagataagtaccggtatttgttcaagcaagtggcatcaagcaccgggttttgtgatcaacggcgtctcgggctgctgcttcatgactccatccaaattcctcgtcaacttggtgaggtggcatctttcggcggatcgaacatcgagccctctgtgcgctcatgtttccaatttgccaataacaagccagaaattgaagcagcgctcttcctcgattggatgcgactggaaccccagtcgatggtctggcttccagtgttgcatcgtgtggcggccgctgaaaccgccaagcatcaggccaagtgtaatatctgtaaggaatgtccgataataggattcagataccgatcacttaagcactttaactacgacatctgtcaatcatgctttttcagcgggagagtcgcaaagggacataagatgcattacccaatggtggagtactgtactcccaccacttccggcgaagatgtcagggactttgcgaaggtgctcaagaataagtttagaaccaagcgttactttgctaaacatcccagaatgggatacctgccggtccagaccgtgctggaaggcgacaacatggaaactgataccatg

SEQ ID NO: 251397 - DNA, 3432 bp, Artificial Sequence
  Description of Artificial Sequence: Synthetic coding sequence
atgctctggtgggaggaggtggaggattgttacgagagggaagatgtgcagaaaaagaccttcacgaagtgggttaacgcacagttctcaaagtttggaaagcagcacattgagaatctgttttccgaccttcaggacggccggcgccttctggatctgctggaggggctgactggacaaaagctgcctaaggagaagggatcaacccgcgtgcacgctctcaataatgtgaacaaagcactgagggtgctgcagaataacaatgtcgaccttgtgaatattggttcgaccgacatcgtggatggaaaccacaaacttacgttgggcttgatctggaacattatcctgcattggcaagtgaaaaacgtcatgaagaacataatggcaggactgcagcaaacgaactccgaaaagattctgttgtcgtgggttcgccaatcgactagaaattaccctcaggtgaacgtcataaactttaccacctcgtggtcagatggactggcattgaacgccctcattcactcccatcggcccgacctttttgactggaactctgtggtttgtcagcagtcagcaactcagaggctggaacacgcatttaacattgcccggtaccaactgggaatcgagaagttgcttgatcccgaggacgtggacactacctacccagataagaagtccattctgatgtatatcacctccctgttccaggtgctgcctcagcaagtgagtattgaagctattcaagaagtggaaatgcttccccgaccaccaaaggttaccaaggaggagcattttcagctccaccatcagatgcactactcccagcagattaccgtgtccctggcacaaggatacgaaagaacttcctcgcctaagcccaggtttaagtcctatgcctatacccaggcagcttacgtgaccactagcgacccaactaggtcaccctttccatcccagcaccttgaagcccctgaagataagtcgttcggatccagcctgatggaatccgaagtcaacctggatagatatcaaaccgcactcgaggaagtgctgtcctggcttctgtcggcagaggacaccctgcaagcacaaggcgagatctcgaacgatgtggaagtggtgaaggatcaatttcatacccacgaaggctacatgatggacctgaccgcacatcagggccgcgtgggaaatatcctgcaactcggctcaaagctgattggtaccgggaaacttagcgaggacgaggaaactgaggttcaggaacaaatgaatttgttgaattcacgatgggaatgcttgcgcgttgcgtcaatggaaaaacagtcgaaccttcatagagaaatctcgtacgtcccttccacctaccttaccgaaattacccatgtgagccaggcgctccttgaggtggagcagctgctgaacgcacctgatctgtgtgcgaaggattttgaggatctcttcaaacaagaagagtccctcaagaacatcaaggactcgctgcagcaatcatccggtcgcattgatatcatacatagcaagaaaactgccgccctgcagtcggctacccctgtcgagcgggtcaaactgcaagaagcactcagccaactcgacttccagtgggaaaaagttaacaagatgtacaaagatcgccagggacggtttgataggagcgttgaaaagtggagaagattccattacgatatcaagatctttaaccaatggcttaccgaagcagaacaattccttcggaaaacccagatccctgaaaactgggagcatgcaaagtataagtggtacctgaaagaattgcaagatggtataggccaaagacagaccgtggtgagaacccttaatgcaactggcgaggagatcattcagcaatcgtcaaagaccgacgcgtcgatcctgcaggagaagctgggtagccttaaccttagatggcaagaagtgtgtaagcagctctccgacaggaaaaaacggctggaagaaaccttggagagactgcaagagcttcaggaagcaaccgatgagctggaccttaaactcagacaggctgaagtgattaaaggatcgtggcagcctgtcggagatcttctgatagactcgctgcaagaccaccttgagaaggtgaaagccctcagaggtgagattgccccgctgaaggaaaacgtgtcgcatgtcaatgatcttgcgaggcaactgaccactcttggaatacaactgtcgccatataacctgagcactctggaagatctgaacactagatggaaactgctgcaagtcgctgtggaagatcgtgtccggcaactgcacgaagcacaccgggattttggtcctgcaagccaacatttcctgtccactagtgttcaaggcccctgggaacgggcgatctctcctaacaaggttccgtactatatcaatcatgaaacgcagaccacttgttgggaccatcctaagatgactgaactttaccaaagcctggcagacctgaacaacgtccgcttcagcgcctaccggaccgccatgaagctccgacggcttcagaaggcactgtgtcttgatctcttgtccctgagcgcagcatgtgatgcacttgatcagcataatctgaaacaaaacgatcagcctatggacattcttcagattatcaattgtcttacgactatctacgatcgtctggaacaggagcataacaaccttgtgaacgtgccactttgtgtcgatatgtgccttaattggcttcttaatgtctacgacaccggacgaactgggcgtattagggtcctctcttttaagactggaattatcagcctctgcaaggcacatctggaagataagtaccgatacctgttcaagcaggtcgcaagctcgacggggttttgtgaccagcgccggctgggtcttttgcttcatgattccatccaaattccccgtcaactcggagaagtggcttcgttcggaggtagcaacattgaaccttcggtgcggtcctgctttcagtttgctaacaataagccagaaatcgaagctgcattgttccttgattggatgcggctggaacctcagtccatggtgtggcttccagtattgcatagagtggccgcagccgagactgcaaagcatcaggcaaagtgtaatatctgcaaagaatgtcctattatcgggtttaggtacagatcacttaagcactttaactacgatatttgtcaatcatgcttcttttccggtagagtggcgaagggacataagatgcactacccaatggtggaatactgcaccccgaccacttcgggtgaagatgtgagggatttcgcgaaggttttgaaaaacaagtttagaaccaaaagatacttcgccaagcatccacggatgggatacctgccagtgcagactgttcttgaaggagacaatatggaaaccgacactatg

SEQ ID NO: 251398 - DNA, 3432 bp, Artificial Sequence
  Description of Artificial Sequence: Synthetic coding sequence
atgttgtggtgggaagaggtagaagattgttatgaaagggaggatgtgcaaaagaagactttcaccaagtgggtgaatgcccagttttcaaaattcggcaaacaacatattgaaaatctatttagcgatctgcaggacggacgccgtctgctagacctcttagagggcttgacaggacagaaactgcccaaagagaaagggtccacaagggtacacgcgctgaataatgttaacaaagctttacgggtcttacaaaataataatgtagacctggttaatattggaagcaccgatatcgttgacggcaaccacaaactcaccctagggctgatatggaacattatcctgcattggcaggttaaaaacgtaatgaagaacattatggcaggactgcagcagaccaactcagagaagattctgctgtcatgggtgcgccagtcaacccggaattacccccaagtgaacgtcatcaattttacaacatcctggagcgatgggctcgctctgaatgccctgatacattctcaccggccggatctgtttgattggaactctgtggtctgccagcaatcagcaacacaacgtctagagcacgctttcaatatcgccagatatcagctgggcatcgagaagctgctcgatcctgaagatgtagataccacataccctgataagaaatccattctgatgtacatcacaagtttgtttcaggtactgcctcagcaggtttccatagaagccatccaagaagtggagatgctccctcgcccacctaaagtcacgaaggaggagcatttccagctccaccaccaaatgcactacagtcagcagatcaccgtgagcctggcccagggatatgagcgcacaagcagccctaagccgcgtttcaagagttacgcttacacacaagccgcctacgtgacaacctctgatcccaccaggtccccgtttccaagtcagcatctagaagcgcccgaggataagtcttttggctcctctttaatggagtctgaagttaacctagatcggtaccagacggcgctggaggaggtcctgtcatggctgctgtccgctgaggatactcttcaggcacagggcgaaatctcgaatgatgtcgaggtagtgaaagaccagttccatacacatgagggttatatgatggacctaaccgcgcaccagggacgggtgggcaatatcctccagttgggcagcaaactgatcggaacgggtaaactttccgaggatgaggaaacagaggtccaagaacagatgaatctcctgaatagtcgatgggagtgtctgagagtggcgagtatggaaaagcaaagcaacttacatagagaaatctcctacgtgccttctacctacctgaccgagatcacccatgtgtctcaggcactgttggaggtggagcaactgctgaacgcaccagatctgtgtgccaaagatttcgaggatctgtttaaacaggaagagtcgttgaagaatatcaaagattctctgcagcaatcctctggccgaattgacatcatccactccaaaaagacagcagctctccaaagtgccactcccgtagagagggtcaagctacaggaagcactctcacagctggactttcagtgggaaaaggtgaataagatgtacaaggatcgtcagggaagattcgaccggagcgtagagaaatggcggagattccactacgacattaagatatttaaccagtggttaacggaggcggaacagttcctgagaaaaacccagatccccgagaattgggaacacgccaaatataaatggtacctgaaggaactgcaggatggtatcgggcagaggcagactgtggtaaggaccttgaacgcaacaggggaggaaatcatccagcagagcagtaagaccgatgcttcgattctccaagaaaaactcggttcacttaatctgcgctggcaggaggtttgcaagcaattatccgaccgaaagaaacggctcgaggaaacgttggagagattgcaagagctccaggaggctactgatgagctggatttgaagcttagacaggctgaggtgatcaagggttcatggcaaccagtcggagatctgctgatcgattccctgcaggaccatctcgagaaagtgaaggctcttcgtggcgaaattgctccattaaaggaaaatgtgagtcacgtgaacgatctggcccgccagctgactacactgggcatccagctgtcgccttacaatctgagcactcttgaggatctgaataccaggtggaaactgctgcaggtcgcagtggaagacagggtgcgtcaactgcacgaggcccaccgtgattttggacccgccagccagcatttcctaagtacttctgtacagggcccctgggagagagccatcagccctaacaaggtaccatactacatcaaccacgagactcaaactacctgctgggaccaccccaagatgacggaactctatcagtccctggctgatctcaataacgtacggttctccgcctaccggacagcaatgaaattgcgacggctgcagaaggcactctgtctggaccttctgagtttgtctgccgcctgtgacgctctcgaccaacataacctgaaacagaacgatcagcctatggatatactgcagattattaattgtctcacgactatctacgaccggctcgagcaggaacataacaatctagtgaatgttccgctgtgcgtggacatgtgtctgaactggctgctgaacgtttatgacaccggccgcaccggtaggattcgggttttgtcctttaaaacagggattatctccctgtgtaaggcccatttggaggataagtatagatatctgttcaaacaggtcgcgtcgtcaacaggattctgcgaccagaggaggctgggactactgctgcatgattctatccaaatcccaagacagcttggcgaagtagcctcattcggtgggagtaacatcgagccatccgtacgatcctgctttcagttcgcaaataataaacccgaaatcgaggccgccctgttccttgattggatgaggctggaacctcagagtatggtttggctgcccgtgcttcatcgtgtggcggcggctgagaccgccaaacatcaagccaagtgcaacatctgtaaagagtgccctatcatcgggttcagataccgaagtctcaaacacttcaattatgatatctgccagagctgtttttttagtggacgagtcgctaaaggccacaagatgcactatccgatggtggaatactgtactcctaccacgagtggagaagatgtccgggactttgccaaggttctcaagaacaagtttagaactaagagatattttgccaagcacccgcggatgggctatctccccgtgcagacggtgctcgaaggtgacaacatggaaaccgatacaatg

SEQ ID NO: 251399 - DNA, 3432 bp, Artificial Sequence
  Description of Artificial Sequence: Synthetic coding sequence
atgctgtggtgggaggaagtggaggattgctacgaaagggaagacgttcaaaagaagaccttcacgaaatgggtgaatgctcagttttccaaatttggaaagcagcatatagaaaatctgtttagcgacctgcaagacggaaggaggctattagatctccttgaggggttaacaggacagaagttgccaaaagagaagggctctacaagagtgcatgccctgaacaatgtgaataaagctcttagagtcctgcagaataacaacgttgatttggtcaatattgggtctacggatatagtcgatggcaaccataaacttaccttaggcctgatctggaatattattctgcactggcaggtgaagaatgtgatgaagaatatcatggctggactccaacaaacgaacagtgaaaaaatactgctgagttgggtgaggcagagcaccaggaactacccccaggtcaacgtgattaatttcacaacttcatggtcagatggcttggctctgaacgccttgatccactcccatcgaccagacctgttcgattggaacagtgtagtctgccagcagtccgcaacacagcggctagagcacgcttttaacatagcccgctatcagctcggcatcgagaagctgctggatcccgaggatgtggatacaacgtatcccgacaaaaagagcatcctcatgtatataacctctttatttcaagttctgccccagcaggtctccatcgaggcgattcaagaggtggagatgctgccccgccctcccaaagtaacgaaggaggagcactttcagctccaccatcaaatgcactactctcaacagatcacagttagccttgcccagggttatgagagaacgtcttccccaaagccacgctttaagtcctacgcctatacccaggccgcctacgtgacgacaagtgacccaacacggagcccttttccgagccagcatttggaggctcctgaagacaaatcctttggttctagcctgatggagtccgaagtgaacctagacagataccagacagcgctggaagaagtgctgtcatggcttctgtcagcagaggacactttgcaagcccagggggagattagcaacgatgttgaagtagttaaggatcagtttcatacgcacgagggttatatgatggacctgaccgcgcaccaggggcgggttggcaacatcttacagcttggctccaaactgattgggaccggcaagctgtccgaggacgaagaaacagaggtgcaggaacagatgaatttgcttaattcgcgatgggaatgcctgcgggtggcctctatggagaagcagtccaatctccaccgcgagatatcatatgtcccctccacttatctcacggagataacccacgtctctcaagcgctgctcgaggtagaacagctgctcaacgccccagatctgtgtgccaaagattttgaggacctattcaaacaggaagaatcactgaaaaatatcaaggatagcctgcaacagagtagcggacgaattgatattatccattccaagaagactgcagccctccagtcagcgactcctgtagagcgcgttaagctgcaggaagcattaagccagttggacttccaatgggagaaagttaacaagatgtataaagacagacaggggcgctttgatcgttcggtagagaagtggcgaaggtttcattacgatatcaagattttcaatcagtggctgactgaggcggagcagtttctccgtaaaacccagattcctgaaaactgggagcacgcgaaatacaagtggtatctcaaggagctgcaagacggcatcggacagcgtcaaactgtagtcaggacactaaacgcgacaggagaagagatcattcagcagagttcgaaaactgatgcaagcatcctgcaggaaaaactagggtcattgaatctccggtggcaggaagtctgtaagcaactgtctgataggaaaaaacgactggaggaaaccctcgagaggttacaggagctacaggaggctactgacgagttggatctgaagctcagacaggctgaggtgattaaaggctcttggcagcctgtgggcgacctgctaatagacagcttgcaagaccatttggagaaggtaaaggctctcaggggcgaaatcgctccactgaaggaaaatgtcagccatgtgaacgatctcgcccgccaactcactacactgggcattcagctgtctccgtacaacttgtcgacactggaggatctgaacaccagatggaagctcctgcaggtggccgtggaagacagggtcagacagttgcacgaggcccaccgcgattttggccctgcttcccaacattttctttctactagtgtgcagggtccatgggagcgagcaatctcacctaacaaggtgccttattacattaatcacgagacccagacaacttgttgggatcacccgaagatgacagagctttatcaaagtttggccgatttaaacaatgtgcggtttagtgcgtatcgcacagcaatgaaactgaggagactgcagaaggctctatgtttggacctgctgtcactgtcagcggcctgtgacgccttagaccagcataatcttaaacagaacgaccaacctatggatatcctccagatcattaactgtctcactaccatatacgatcgccttgagcaagagcacaacaacctggttaacgtcccgctgtgcgtggacatgtgcctgaactggttgcttaatgtgtacgacacagggagaaccggcaggatccgggtgttaagtttcaagacaggtatcatttccctgtgtaaagctcatctcgaggacaaatatagatacctcttcaagcaggtggctagcagcaccggtttttgcgatcagagaagactgggactgcttcttcacgactctatccagattccaaggcagctgggggaggtggcttcatttggcgggtcaaatattgaaccaagcgttcggtcatgctttcaatttgcaaacaacaaaccagagatcgaggccgccttgtttctggattggatgagactggaaccccagagcatggtatggctgcccgtccttcaccgagtcgccgccgctgagactgcgaagcatcaggctaaatgtaatatatgcaaggagtgtcccataattggattcagatatcgttcgctcaaacacttcaattacgacatttgtcagagctgttttttctccggaagggtggctaagggccacaaaatgcattaccctatggtggaatattgtactcccaccacatccggggaggacgtacgtgactttgctaaggtgctaaagaacaaattcaggaccaaaaggtattttgccaagcacccgcggatgggttatctcccagttcagaccgttctggagggcgacaatatggagactgacaccatg

SEQ ID NO: 251400 - DNA, 3432 bp, Artificial Sequence
  Description of Artificial Sequence: Synthetic coding sequence
atgctttggtgggaagaagtcgaagattgttatgaaagagaagatgtgcagaagaaaacctttaccaagtgggtgaatgctcagttttccaagtttggaaagcagcacatcgaaaatcttttttccgatcttcaagatggccgcagacttctggacctcctggagggccttactgggcaaaaacttcctaaggagaagggtagcactcgtgtgcatgcactgaataatgtgaacaaggcactccgcgtgctgcagaacaacaatgttgacctggtgaacattggttccactgacatagtggacgggaaccataagctgacgctgggccttatctggaacattatcttgcattggcaagtgaaaaatgtgatgaaaaacataatggcaggccttcaacagactaactcggaaaagattctgctttcgtgggtgcggcagtccactagaaattaccctcaggtgaacgtcatcaacttcaccactagctggagcgacggactggcgctgaatgcactgatccattcccatcgacctgacctgtttgattggaactctgtggtgtgccagcaatccgcgacgcagcgcctcgagcacgcctttaacatcgcaagataccagctgggcatagaaaagctgcttgatcctgaggacgtggacaccacttaccccgataagaagtccatccttatgtacatcacctcgttgtttcaggtcctgccacagcaggtgtccatcgaagccatacaggaggtggaaatgctgcctaggccgcccaaggtgaccaaggaggagcactttcagctccatcaccagatgcattacagccagcaaattactgtctccttggcacaaggttacgaacgtactagctcccctaagcctcggttcaaatcgtacgcgtatacccaagcagcgtacgtgactacgagcgatccgaccaggagtccattcccttcacaacatcttgaagctccagaagataaatcatttggatcaagcctgatggagtccgaggtgaaccttgataggtaccagaccgcactggaagaggtgctgtcgtggctcctttcggcagaagatactctgcaggcacaaggtgaaatttctaacgatgttgaggtggtgaaggatcagttccacactcacgaggggtacatgatggacctcacggcacatcagggtagggtggggaacatcttgcagctgggatccaagttgattggtaccggaaagctgtcggaagatgaggaaactgaagtccaggaacagatgaatcttctcaatagcagatgggagtgtctgagagtcgcctcgatggagaagcaaagcaatctgcacagggaaatctcttacgtgccatcgacctacctcactgaaatcacccacgtttcccaggcgctgcttgaagtggaacaacttctcaacgcacccgatctctgcgcaaaagacttcgaggacctctttaagcaagaggaatcgctgaagaacatcaaagactccctccaacaatcctccgggcgaatagacattattcactcaaagaaaacggcagcactccaatccgcaaccccagtcgaacgagtcaaacttcaggaggcgctgtcccagcttgattttcaatgggaaaaggtgaacaaaatgtacaaggatagacagggacgatttgatagatcggtggagaaatggaggagattccattatgatatcaagatattcaatcaatggctgactgaagcagagcagttcttgcggaaaacccaaatacctgaaaactgggaacatgcaaaatacaaatggtacctgaaggaattgcaagatggcataggacaacgtcaaaccgttgttcgcaccctcaacgcgactggcgaagaaatcattcagcaatcttccaaaactgatgcctcaattctgcaggaaaagctggggtcccttaatctgcgatggcaagaagtgtgcaagcaactgagcgatagaaaaaagcggcttgaagaaactctcgaaagactccaagaattgcaggaggcgaccgatgaacttgacctcaaactgagacaagcagaagtcattaagggatcctggcaaccagtgggagatcttctcattgactcactccaagaccatcttgaaaaagtgaaggccttgagaggcgagatagcccctctcaaggagaacgtgtcccatgtgaacgatctggcacggcaattgaccaccctggggatccagctgagcccttacaacctctcgactctcgaggatcttaacacccgctggaagctgctccaagtggcagtggaggacagggtgagacagctgcatgaagctcatagagactttggaccagcctcccagcattttctctctactagcgtgcaaggtccgtgggaaagggccatctccccgaacaaggttccctactacattaaccatgagacgcagactacgtgttgggatcatccaaagatgaccgagctctaccaatcactcgccgacttgaacaatgtccgtttttctgcctacagaaccgcgatgaagctgcgcaggctgcagaaggccctgtgtctggatctccttagccttagcgcagcatgtgatgcacttgatcaacacaatcttaagcagaacgatcagccaatggatatccttcaaatcatcaattgtcttactaccatttatgaccgccttgaacaggaacataacaacctggtgaacgtgcccctttgtgtcgacatgtgccttaattggctccttaacgtgtacgatactggcagaaccgggcgcatccgggtgctgtcgtttaagaccggaatcatctcactttgtaaggcgcatttggaagataagtaccgatacctgttcaagcaagtggcctcctcaaccggattttgcgatcaaaggagactgggacttctgctgcacgattctattcaaattccccgccaattgggcgaggtcgcatcttttggcggctcgaatatcgagcctagcgtcaggtcgtgtttccaatttgcgaataacaagccggaaattgaagcagcactgtttttggactggatgcgtcttgagccccaaagcatggtgtggctccctgtgcttcaccgggtggccgcagcagagactgcgaaacaccaggccaaatgcaacatttgtaaggaatgtccaataatcggattccgttacagatccctcaaacatttcaattatgatatttgccaatcatgttttttctcgggacgggtggcgaagggacataagatgcactacccaatggtggagtattgtacccccactaccagcggggaagatgtgcgggactttgcaaaggtgctgaagaacaagttccggaccaagaggtacttcgcgaagcatcctagaatgggataccttccggtgcagaccgtgcttgagggtgataacatggaaactgacaccatg

SEQ ID NO: 251401 - DNA, 3432 bp, Artificial Sequence
  Description of Artificial Sequence: Synthetic coding sequence
atgttatggtgggaggaagtagaagactgctatgagcgcgaggatgtgcaaaagaaaacctttacaaagtgggtgaatgcacagttttcaaagttcggtaaacagcacatcgagaacctgttcagcgacttacaggatgggcgtagactgctggatctgcttgagggactcacaggacagaaactgcctaaagaaaaagggtcaaccagggtgcacgctctaaataacgttaacaaggcgttgagggtgctgcagaataacaacgtggacctagtcaatatcggctccacagacattgttgacggtaatcacaagctaacactgggcttgatttggaacattatcttgcactggcaggtgaagaacgttatgaaaaatatcatggccggccttcagcaaacaaattcggaaaagatattgctgagttgggtccggcagtccacccggaactacccacaggtgaacgttataaactttaccacctcatggagtgacggacttgcattgaacgccctgattcattcccacagacccgatctgtttgattggaatagtgttgtttgccagcagtcggctacgcagagattagaacacgcgtttaatatcgcacgataccagctgggtatagaaaagcttctggatcccgaggacgtggatacaacttacccagacaagaagagcatcctcatgtatataacctccctcttccaagtgctgccacagcaagtgagtatcgaggctatccaggaggtggaaatgctcccaagaccgccaaaggttaccaaggaggagcatttccagttgcaccatcaaatgcattatagccagcagattaccgtgtcattggcccaggggtacgagcgaacatctagccctaagccacgattcaaaagctatgcatatactcaggccgcttacgtcacaacttccgaccccacccgatcacctttcccatctcagcacttagaagcccctgaggacaaatctttcgggtcatcgctcatggaatccgaggtgaacctggaccggtaccaaacggccttggaggaagttctatcctggctcctatcagctgaggatactctccaggctcagggcgagatatctaatgatgtcgaagtcgtcaaagatcagttccacactcatgaagggtacatgatggatctgactgcacatcagggacgggtcggtaacatcctgcagctcggatccaaattgattggcactggaaagctctctgaagacgaagagactgaggttcaggagcagatgaatttgctgaatagtaggtgggagtgcctcagggtagctagtatggagaagcagtccaacctgcaccgtgagatctcctatgtgccttctacatacctcaccgagattacacatgtgagccaggcccttctagaggtggaacaattgctgaacgctcctgacctgtgtgcaaaagattttgaagacctctttaagcaggaggaatcccttaaaaacatcaaggatagcctccagcagtctagtggccgaattgatatcatccactccaaaaaaacagctgccctgcagagcgccacgccggtggagagagtgaagctccaggaggccctgtcacagctggattttcaatgggagaaggtgaacaagatgtacaaagatcgtcagggtcggttcgaccgctccgtcgagaagtggaggcggtttcattacgatatcaagatattcaatcagtggcttacagaggcagagcagtttctgagaaaaactcagatcccagagaactgggaacacgctaagtacaaatggtacttgaaagagttgcaggatggaattggccagagacagacagttgttcggaccctgaacgcaaccggggaagagattatccagcaatcctctaaaactgatgcttctatactgcaggagaaacttgggtcactgaacttgcggtggcaagaggtgtgcaagcagctgagcgatcggaagaaaaggttggaggaaactctggaaaggttgcaggaacttcaagaggccaccgatgagctcgatttgaagctaagacaggcagaggtaatcaagggctcttggcagcccgtgggagatctcctgatcgattcactgcaagaccatttagagaaggtgaaagccctcagaggcgagatcgcacccctaaaggagaatgtttcccatgtgaacgatctggctcggcagcttacgactctaggaatccaactatccccttataacctctctaccttggaggacctgaatacaaggtggaaactgctgcaggttgccgtggaagatcgcgtgaggcagttgcacgaggcgcaccgtgatttcggcccggcttcccagcactttctcagcaccagtgtgcaaggcccgtgggagagagcaatttccccaaataaggtaccctattacataaaccatgagacacagactacctgctgggaccatcctaagatgaccgagttgtaccaaagcctggcggacctcaacaatgtcaggttctctgcttaccggaccgcgatgaaactacgtagactgcagaaggcgttgtgtttagacctgttgagtcttagtgctgcctgcgatgctcttgaccaacacaacctgaagcagaatgaccagcccatggatatccttcagatcattaactgtctgaccaccatttacgatcggctggaacaggagcacaacaacttagtgaacgtaccgctgtgtgttgacatgtgtctaaattggctgctgaatgtttacgacaccgggcggaccggtcgcattcgtgttttatctttcaaaaccgggataataagcctgtgtaaggcccatctggaagacaaatatagatacctgtttaaacaggtggcgagctccaccggcttttgtgaccagagacgactggggttgctactgcatgactccatccagatcccgcgccagttgggcgaagtcgcatccttcgggggctccaatatcgagccaagcgtcaggtcttgtttccagttcgctaacaataaaccagaaatagaggctgccctgtttctagactggatgaggctcgagcctcaaagcatggtgtggcttcccgtgttgcatagggtcgcagccgcagaaaccgccaagcaccaggccaagtgtaatatctgtaaggaatgcccaattatcggcttcaggtaccgaagcttgaagcactttaattatgacatctgccagagctgttttttttccggtagggtagctaaaggccataagatgcactatccaatggtggagtactgcacgccaacgacttcaggagaagacgtgcgcgacttcgccaaagttctcaagaataaatttaggactaaaagatatttcgctaagcaccctcgtatgggctacctacctgtgcagactgtgctggaaggtgacaacatggaaaccgatactatg

SEQ ID NO: 251402 - DNA, 3432 bp, Artificial Sequence
  Description of Artificial Sequence: Synthetic coding sequence
atgctttggtgggaagaagtggaagattgttacgaacgcgaggatgtccaaaagaaaaccttcaccaagtgggtcaacgcccaattttccaaattcggaaagcagcatatcgagaatctgttttcggaccttcaagatggccgccgcctcctcgatctgctcgaaggactgactgggcagaaacttcctaaggagaaaggatcaactcgcgtgcatgcgctcaacaacgtgaacaaggcactccgcgtgttgcagaacaacaacgtggatctggtgaacattgggtccaccgatatagtggatggtaaccacaagctcactctgggccttatttggaacattattcttcactggcaggtgaaaaatgtgatgaagaacatcatggcgggccttcaacagacgaactccgagaagattttgctctcctgggtccggcagtcgactagaaactacccccaagtgaacgtgataaactttactacctcctggagcgacggtctggccctgaacgcactgatccattcgcacaggccagatctgttcgattggaatagcgtcgtctgtcagcaatccgcaacccaacgcctggaacatgcatttaacatcgcaagataccaacttggcatcgagaaacttcttgatcccgaagatgtcgacacgacttaccctgataagaagtcaattcttatgtacatcacctccctcttccaagtgctgccacagcaagtgtccatcgaggcgattcaggaagtggaaatgcttccacgacctcctaaggttactaaggaagaacattttcaactgcaccatcaaatgcactacagccagcaaataactgtctcgcttgcccaaggttacgaacgaacctcgtctcctaaacctcgctttaagtcgtacgcatacactcaagcagcctacgtcactacctcggatccaaccagatcgccgttcccgtcacaacaccttgaagcaccagaagataagagcttcggttcgtcactcatggagtccgaggtcaacttggatcgctatcagaccgccctggaagaagtgctctcctggctgctgtccgcagaggatacccttcaggcccaaggagaaatctcgaacgacgtggaagtggtgaaggatcagtttcatactcacgaggggtacatgatggaccttactgcccaccagggcagagtcggtaacatccttcagctggggagcaagctcatcggcacgggtaagctctcggaggacgaggaaaccgaggtccaggaacagatgaatcttcttaactcaaggtgggaatgtcttagagtcgcgtcgatggagaagcaatccaaccttcaccgcgaaatttcatacgtgccttcgacttacttgactgaaattacccacgtgtcccaggcactgctggaggtagaacaactccttaatgcaccagatctttgtgccaaggactttgaggatcttttcaagcaagaagagtcactgaagaacattaaggatagtctccagcagagctccggcaggattgacattattcattcgaagaaaactgcagcattgcagtcggccacgccagtggaacgtgtgaagctgcaagaggcccttagccagctggactttcaatgggaaaaggtcaacaaaatgtacaaggatcgccaggggcgctttgaccgatctgtggaaaagtggcggaggttccattacgacattaagatctttaaccagtggctcaccgaggcggagcaatttctcagaaagacgcaaattcccgagaactgggagcatgcaaagtacaagtggtaccttaaggaactgcaggatggaatcggtcaacgccaaacggtggtgagaactctgaacgccacgggagaagagattatccaacagtcatccaaaacggacgcaagcattctccaggagaaactgggatcactcaacctgagatggcaagaagtgtgcaagcaattgtccgacagaaagaagagactggaagaaactcttgaaagactgcaagagcttcaagaggcaaccgatgaattggatctgaaacttaggcaagcagaagtcatcaagggttcatggcaacctgtcggagatctcctgattgattccctgcaagaccaccttgaaaaggtgaaggccctcagaggagaaatagcgccacttaaagaaaacgtctcccacgtcaacgatcttgcccgacagctcactaccctgggtattcagctcagcccttacaacctctcgacccttgaagatctgaacacccgttggaagctgctccaagtggctgtggaggaccgcgtgagacaactgcatgaagcacatagggattttggcccagcgagccagcatttcctctccacctcggtccagggtccttgggaacgcgcaatttcccctaacaaagtgccttactacatcaatcacgagacgcagaccacctgttgggatcacccaaagatgaccgagctctaccagtccctggctgaccttaacaacgtgcgtttttccgcgtaccgaactgccatgaaactccgtagacttcagaaagccctctgccttgatctgctctcactgtcggcagcgtgtgacgcgctcgaccaacataatctgaagcaaaacgatcaacctatggacatactgcagattatcaactgccttaccaccatttacgatcgattggaacaggagcacaataaccttgtcaacgtgcctctgtgcgtcgatatgtgtcttaattggctgcttaatgtctatgacaccggaaggactggaagaattcgcgtcctctcgtttaagactggaataatctcgctttgcaaggcgcacctcgaagataagtaccgttaccttttcaaacaggtcgcctcctccactggtttttgtgatcagcggagacttgggcttctgcttcatgattcgatacaaattccccgccaacttggcgaagtcgcgagcttcggagggtcaaatatcgaaccttccgtgcgatcgtgctttcaattcgccaacaacaagcctgaaattgaagcagcactgtttctcgattggatgaggttggagccacagtcgatggtgtggcttcctgttctgcatagagtggccgcagctgagacggcaaagcatcaggctaagtgcaacatttgtaaagagtgtcctatcattggtttcagatacagatccctcaaacatttcaattacgatatctgtcagagctgcttcttttcgggaagggtggccaagggacataagatgcactaccccatggtggaatactgcaccccaactacttcaggtgaggatgtgcgggattttgcgaaagtgcttaagaacaagtttagaaccaagcggtactttgcgaagcatccgaggatgggatacttgcctgtgcagaccgtgctggaaggagacaacatggagactgacaccatg

SEQ ID NO: 251403 - DNA, 3432 bp, Artificial Sequence
  Description of Artificial Sequence: Synthetic coding sequence
atgctgtggtgggaggaggtggaggattgttatgaaagagaagatgttcagaaaaagaccttcacgaaatgggtgaatgcacagttttcgaaatttggaaagcagcacatagagaacctgttttcggatctccaggacggaagaagattgcttgatctgctggagggcctgactggtcagaaacttcctaaggaaaagggaagcactcgtgtgcacgccttgaacaacgtgaacaaggcacttcgagttcttcaaaacaataatgtcgacctcgtcaatatcggatccactgacatcgtcgatggtaaccacaagctcacccttggacttatatggaacattatccttcattggcaagtgaaaaatgtgatgaaaaacattatggccggcctccaacaaacgaactccgaaaagatactgctctcttgggtgcgacagtctactagaaactatccccaggtgaatgtgattaactttaccactagctggtcggacggattggcactgaacgcacttatccactcacatagaccagacctgttcgattggaactccgtcgtctgtcagcaatcggccactcaacgccttgagcatgcattcaacattgcaagataccagcttggaatagagaaacttctggatcctgaagatgtcgacactacgtaccctgataagaagtccatccttatgtacatcacctcgctttttcaggtgctgccccagcaagtgtcgatcgaggcgatacaagaagtggaaatgctgccacggcctcctaaagtcactaaggaggaacatttccaactgcaccatcagatgcactacagccagcaaatcactgtgtcgcttgctcaaggttatgaacgtacctcgagcccaaaacctagattcaagtcttacgcatacactcaagccgcctacgtgaccacttccgatcctacccgttccccattcccatcccaacatcttgaagcgcctgaggataagagcttcgggtcatctttgatggaaagcgaggtcaatcttgacagataccagacggcacttgaagaggtgttgtcgtggctcctttcggctgaagatacgcttcaagctcaaggagagattagcaacgacgtggaggtggtgaaggatcagtttcatacccacgaagggtacatgatggatcttactgcccatcaaggtagagtcggaaatatcctccagctgggctcaaagctgataggaaccggtaaactttcggaagatgaggaaaccgaagtgcaggaacaaatgaatctgttgaactcacggtgggaatgtctccgggtggcgtctatggagaagcaatccaatcttcatagagagatttcctatgtgccaagcacttatcttaccgagattacccacgtgtcgcaagcgttgcttgaagtggagcagcttcttaacgcacctgacttgtgcgccaaggattttgaggatctgtttaagcaagaagagtcgcttaagaacataaaggatagcctccagcaatcttctggcaggatcgacataattcattccaaaaagaccgccgccctgcagtccgctaccccagtcgaacgcgtgaagctccaggaagcactgagccaacttgattttcaatgggagaaggtgaacaagatgtacaaggaccggcagggaagatttgaccgttcggtggaaaaatggcgacggttccattacgacataaagattttcaaccagtggctcactgaggcagagcagtttctgcgcaagacgcagatacccgagaattgggaacacgcaaagtacaagtggtacctcaaagaactgcaagatggcatcgggcagcgtcaaaccgtcgttaggacgcttaacgcgaccggtgaagaaatcattcaacaaagctccaaaaccgatgcatccatcctccaggaaaagctgggctcactgaatctgagatggcaggaggtgtgcaagcagttgtccgatcgtaagaagaggcttgaagaaaccctcgaacgacttcaggagcttcaggaggcaaccgatgaacttgacctgaagctccggcaagcagaggtgattaagggttcgtggcaaccggtgggtgaccttcttatcgattcactccaggatcatctcgagaaggtgaaggcactgaggggtgagattgcacctcttaaggaaaacgtctcccatgtcaacgatctcgccaggcagcttacgactttgggcattcaactctcgccttacaacctgtcgacccttgaagatctcaacacccgctggaagctgctgcaagtggctgtggaagatcgggtccgtcaactgcatgaagcacatagggatttcggtcccgcatcgcaacatttcttgtccacttcggtccaaggaccgtgggaaagagctatctccccaaacaaggtgccttactacattaatcatgaaacccaaaccacctgttgggaccacccgaaaatgaccgaactctaccagtccctggctgacttgaataatgtgcgatttagcgcgtaccgaaccgcaatgaagttgaggagacttcagaaggcactctgtctcgatcttctgtccctgtcggccgcttgcgacgcactggaccaacacaatcttaagcagaacgaccagccaatggatatcctgcagatcataaactgcctcaccactatctacgaccgactggaacaagagcacaataaccttgtgaacgtgcctctctgtgtagacatgtgtcttaattggctcctgaacgtctacgatactggacggaccggacgcattcgcgtgctttcgtttaagacgggcatcatttcgctgtgcaaagcccatctcgaagataagtaccgctacttgttcaagcaggttgcctcctccactggattctgtgatcagcggcgcctcgggctcctgctgcatgatagcattcaaatcccaagacaactgggggaggtggcttcatttggagggtcaaatatcgaaccttccgtgaggtcttgctttcaatttgcgaacaataaacccgagattgaggctgccctctttcttgattggatgcgccttgaacctcaatccatggtgtggctgcctgtgctccaccgtgtcgcagcagcagagactgcaaagcaccaagcaaagtgtaacatctgtaaggagtgtcccattataggatttaggtaccgttcgctgaaacactttaactacgatatctgccaatcgtgctttttctcggggagagtcgccaaaggacataagatgcactacccgatggtggaatactgtaccccaacgaccagcggggaagatgtgagggattttgctaaggtgctcaagaacaagttccgcaccaaaagatactttgcaaaacatcctagaatggggtaccttcccgtgcaaacggtgctggaaggtgacaacatggaaactgataccatg

SEQ ID NO: 251404 - DNA, 3432 bp, Artificial Sequence
  Description of Artificial Sequence: Synthetic coding sequence
atgttgtggtgggaggaagtggaagactgttacgagagggaagatgtacaaaagaaaacatttacgaagtgggtgaatgcccaatttagcaagtttgggaagcagcatattgaaaatctattctcagatttgcaagatggtcgacgcctgctagatctgctcgaaggccttacgggccagaagttaccaaaggagaaagggtcaactcgcgtgcatgccctaaataatgtgaacaaggcattaagagttcttcagaacaacaacgtggacttggtgaatatcggtagcactgatatcgttgacggtaatcataagttgactttggggctcatctggaatatcatcctccactggcaggttaagaacgttatgaagaacattatggccggcttgcaacagactaacagtgaaaagattttgttgagttgggtacgccagagcaccaggaactaccctcaggtcaatgtcatcaattttaccaccagctggtcagatggactagcgctcaacgcactaattcactcacatcgccccgacctatttgattggaattccgtcgtgtgccagcagtcggccacacaacgcctagagcacgcattcaatattgcccgttaccagcttgggatcgaaaagttactggacccagaagacgtggacactacataccccgacaaaaagtcaattttgatgtatatcacctctctctttcaggtgcttcctcaacaggtgtcaatagaggctatacaggaggtagaaatgctgcccagaccccccaaggttactaaggaagaacacttccagctccatcaccagatgcattatagccaacaaataaccgttagcttagcccagggctatgagcggacatcttcacctaagccacgattcaaatcctatgcatatactcaagcagcgtacgttactacatcggatcccacgcgatctcccttccctagtcagcatttggaggctcccgaggacaagtctttcggatcctctttgatggagagtgaagtcaatttagaccggtaccagacggccctcgaggaggtactttcttggcttctatctgccgaagacactcttcaggctcaaggcgagatttccaatgatgtagaagtggtcaaggaccagtttcacacccacgagggttacatgatggatctcactgcccatcaggggcgtgttggcaacattttacagctgggatcaaaattgatcggcacaggcaaactttcagaggacgaagaaaccgaggtgcaggagcagatgaaccttctgaactctaggtgggagtgcttgcgagttgcttccatggagaaacaatcgaacttgcaccgtgagattagttatgtgcctagcacttatctcaccgaaattacccacgtgagtcaggcacttctcgaagtcgagcaactcttgaacgccccggacctttgtgctaaggatttcgaggatctcttcaaacaagaggagtcccttaagaacatcaaagattcgctgcagcaatcctctggtcggatcgatattatccactctaaaaagaccgctgccctccagagtgccacgcccgtggaacgtgttaaactgcaggaggctctatcacaactcgatttccagtgggaaaaggtcaacaaaatgtataaagaccgacaggggcggtttgacagatccgtggagaaatggcgccgctttcattatgacatcaagatattcaatcagtggttaactgaagctgaacagtttcttagaaaaacccaaattcctgagaattgggaacatgctaagtacaagtggtacctaaaagagttacaggacggtataggccaacggcaaaccgtggtccgcacactgaatgcaacgggcgaagaaataatccaacaatcatcaaagacggacgctagcatcttacaggagaaactcggctcccttaacctacggtggcaggaggtgtgcaaacagctttccgatcgcaagaagcgactcgaggagactttggagcggttgcaggaacttcaagaggccacagatgagctcgaccttaagctccggcaagctgaggtaattaagggatcatggcagccggtcggggatctcctcatagattccctccaggaccatttggaaaaggttaaagccctgaggggcgaaatagctcccctcaaagagaatgtcagccatgtgaatgacctcgctcggcagctaactactctcggcatccaactatccccctacaacctttctaccctggaagatcttaacacccgttggaaattgctgcaagtggccgttgaagatcgagtccgccagcttcatgaggcacatagagacttcggcccagcatcacaacatttcctgtctacttcggttcaggggccgtgggagcgggcgatctctcccaataaggtgccttactatattaaccacgaaacacaaactacatgttgggaccatcctaaaatgactgaactgtaccaaagcttggcagatctgaacaatgtccgtttttctgcctaccgcaccgccatgaaactacggaggttgcagaaggccctttgcttggatctcctgtcgctctcagccgcatgtgacgctcttgaccaacacaatctaaaacagaatgatcagccaatggacattctccaaatcataaattgccttactactatctacgatcggttggaacaggaacataacaacctagtaaacgtacccctgtgtgtcgatatgtgcttgaactggctcctaaatgtttatgatacaggcagaactgggcgcattcgtgtgctttccttcaagaccggcattatcagtttgtgtaaggcccatttagaggacaaatatcgatatctatttaagcaggtcgcctcctctacaggtttctgcgaccagaggcggcttggactcttgctgcatgattctattcaaatacctcgccagctaggagaggtagcctcgttcggcggttctaacatcgagccctccgtgcgttcctgtttccagttcgccaataacaaaccagagattgaggcagctctcttcctggattggatgcgcctcgaaccacagtcgatggtgtggctacccgtgctccatcgtgttgcggctgctgagacggccaaacaccaagccaagtgcaacatttgcaaggagtgtccgattataggtttccggtataggtctctgaaacactttaactacgacatctgccagtcttgttttttcagtggtagggtcgccaaaggccataagatgcattaccctatggtggagtattgtaccccaacgactagtggtgaagacgtgagggacttcgcaaaggtcttgaaaaataagtttcgcacgaagcgttatttcgccaagcatccccggatgggatacctcccggtccagaccgtcctcgagggtgataatatggagaccgatactatg

SEQ ID NO: 251405 - DNA, 3432 bp, Artificial Sequence
  Description of Artificial Sequence: Synthetic coding sequence
atgctctggtgggaggaggtggaagattgttacgaacgtgaggatgtccagaaaaaaacattcaccaagtgggtgaacgcacagtttagcaagttcggaaaacaacacattgagaatctcttctccgatctccaggatgggcggaggctgttggacctcctggaaggactgacaggacagaagttaccaaaagaaaaaggatcgaccagggtacacgcccttaataacgtgaacaaggccctccgcgtcctccaaaataacaatgtcgacttggtgaacataggatcaactgatatcgtggacgggaatcataagctaaccttgggccttatatggaatatcatcttgcattggcaggtaaaaaacgtgatgaagaatatcatggcaggcctccagcagactaactctgagaagatcttgctgagctgggtcagacagtcaaccaggaattatccccaagtcaacgttatcaacttcactaccagctggtctgatggattggccttaaatgcattgattcactcacataggccagatctgtttgattggaactccgtagtatgccaacagtctgccacccagagactagagcatgccttcaatatcgccagataccagctcggtattgagaaactgcttgacccggaagatgtagacaccacatatcccgacaagaaatctattctgatgtacataacatcgctgttccaggtgctgccccagcaggtatctattgaggccatccaagaggtagaaatgttgcccaggcctcctaaggtgactaaggaggagcattttcagttgcatcaccagatgcactacagccagcagatcaccgtgagtctggcccagggctatgagaggacatcatcacccaagccaagatttaagtcctacgcgtacacccaggcggcctacgtaaccaccagcgatcccactcggagtccttttccaagccagcatctagaggcccctgaggacaaaagcttcggcagttcactgatggaaagcgaagtcaatcttgatagatatcagactgcacttgaggaggtgttgagctggctactttctgctgaggacacgcttcaggcgcaaggagagatttctaacgatgtagaagtagtcaaagatcagttccatacccatgagggctatatgatggacttgaccgctcatcaagggcgggtgggtaacatacttcagctggggtctaagttgatcggaaccggaaagttgtcggaggacgaggaaaccgaagtgcaggagcagatgaatctcctgaacagcagatgggaatgtctgcgcgtggcatcgatggagaaacagagcaatctacaccgtgagattagctatgtgcccagcacctatctgacagagatcacacatgtgtcccaggccctgttggaggtggaacagctgctgaatgctcctgatttgtgtgctaaggatttcgaagacctgtttaagcaggaggagagcctcaaaaacatcaaggacagtcttcagcagagcagcggccgaatcgatatcatccactccaaaaagacagcagccttgcaaagcgctactccggttgagcgcgtgaaactgcaggaggccttgagccagttggacttccagtgggaaaaagtgaacaaaatgtataaagaccgacaaggacgatttgacaggagcgtcgaaaagtggaggcgatttcattatgatattaagatttttaatcaatggttgacagaggctgagcaattcctgcggaaaacacaaattcccgagaattgggagcacgctaagtacaagtggtatctgaaagagttacaggacggcataggacaacgccagacagttgttaggacgttgaacgctacaggggaggagatcatacagcagagctctaagactgatgcttccatcctgcaggagaagcttggaagtctcaatctgaggtggcaggaggtgtgcaaacagctttcagacagaaagaaacgactcgaggagacactggagagactgcaggaattacaggaggcaaccgatgaactggatctgaaacttaggcaggccgaggttattaagggaagctggcagccagtgggggacctcttgatcgattctctacaggatcacttagaaaaggtaaaagctctcaggggcgagattgccccattgaaagagaacgtgtcccatgtgaatgacttggccaggcagctgactactttaggcattcagctctcaccctataatctatctacactagaggacctgaacactcggtggaaactgctgcaggtcgcagttgaagacagagtgcgccagctgcatgaagcccacagagactttgggccagcttctcagcactttttgtcaacatcggtccagggaccctgggaaagggctattagcccaaataaagtcccgtattatatcaaccatgaaacccaaaccacgtgttgggatcatcccaaaatgacggagttgtaccaatccctggcagacttaaataatgtccggttcagtgcataccggacagccatgaaactgcgtcggctccagaaagcactgtgtctcgatctcctttcactgagtgcagcatgcgacgccctggaccaacacaatcttaagcagaacgaccagcccatggatatcctgcagataattaattgtttaaccaccatctacgatcggctcgaacaggaacacaacaatttggtgaacgtacccctgtgcgtggacatgtgtcttaactggttgcttaacgtttatgacactggcagaacaggcaggattcgcgtgttgagcttcaaaaccgggatcatctctttgtgcaaggcccatttggaagacaaatacagatacttgttcaaacaagtggcctccagcacgggtttttgtgatcagcgcagactgggcctactgctgcacgatagcattcagattcctagacagctaggcgaagttgcttccttcggaggaagcaatatagaaccaagcgttcgatcctgtttccagttcgctaataataagcctgagatcgaggctgccctatttctggactggatgcgacttgagccccaatcaatggtgtggctgccggtgctgcacagagtggctgccgctgagacggcaaaacaccaggcgaaatgcaacatctgcaaggagtgtcctattattggcttcaggtacaggtctttgaaacacttcaattatgatatctgtcaatcttgtttttttagtggaagggtggcaaaaggacacaaaatgcattacccaatggtagagtactgcaccccaacaaccagcggggaggacgtacgcgattttgccaaagtgctcaaaaataagtttcggaccaagcgttattttgccaagcatccacgcatgggctatctccctgtccagactgtcttagaaggcgataatatggaaacagatactatg

SEQ ID NO: 251406 - DNA, 3432 bp, Artificial Sequence
  Description of Artificial Sequence: Synthetic coding sequence
atgctatggtgggaggaagtcgaagattgttatgagagggaagacgtccagaagaagaccttcactaaatgggtaaatgcccagttcagtaaatttgggaagcagcacattgaaaatctgttttccgatctccaagacggacgtagactgctggatttgctggagggccttacggggcaaaaactcccgaaggagaaagggtccacacgcgtgcatgccctgaacaacgttaataaggcattaagggtgttgcagaataacaacgtcgaccttgtgaacataggtagcacggacattgtcgacgggaaccacaagctgacactcggtttaatctggaatattattttgcactggcaggtgaagaacgtgatgaaaaatatcatggccggccttcaacagaccaatagtgagaagatcctgttgagctgggtgcggcagtccacccgcaattatcctcaagtgaacgtgattaactttactacaagctggagcgacgggctggctcttaatgctctgatccacagtcacagacccgatctgttcgactggaactccgtagtatgccagcaaagtgctacgcagagactggaacacgcctttaatatcgcacgctatcagcttggtatcgagaagctgctggaccctgaggatgtggacacaacttacccagacaaaaagagcatcctgatgtacatcacaagcctgtttcaagtgctaccccagcaagtatccatcgaagctattcaagaagtggagatgttaccgagacctccaaaggtcacgaaggaggagcattttcagctccaccatcagatgcactactcgcagcaaattacggtgtcccttgcgcagggttacgagcgcacaagctcgccgaagccgcggttcaagtcttatgcctatacacaggcagcatacgttaccaccagtgacccgactcggtccccttttccaagccagcatttggaggcaccagaggataagagttttggaagttcgcttatggagtctgaagtgaacctcgaccgatatcagactgctctggaagaggttctaagctggctattatcggctgaggacaccctccaggcccagggtgaaatatcaaacgacgtggaagtcgtgaaggatcaattccacacccacgagggatacatgatggacctcacagcacaccagggcagggtaggcaatatactacagctcggttccaaactcatcggcaccgggaaactgagcgaagatgaggagactgaggtccaggagcagatgaaccttcttaattcgagatgggagtgccttagagtggcatctatggaaaaacaatctaacttgcaccgcgagatttcctacgtaccatccacttacctcacggaaatcacccatgtaagccaagcgcttctcgaggtggagcagttactgaacgcccctgacctctgtgccaaggacttcgaggacctgtttaaacaggaggagagtctcaagaatattaaggacagcctgcaacagagctccggccggattgacatcatacactcaaagaaaactgccgcattacagtccgcgacacctgttgaacgcgtcaaactccaggaggcgctgtcccagctggacttccagtgggagaaggtcaataaaatgtataaggacagacagggccggtttgaccggtcagtcgaaaaatggcgccgctttcactacgacattaaaatctttaatcaatggctgaccgaggcagagcagttcctccgcaaaacgcagatacctgaaaattgggagcatgccaaatacaagtggtaccttaaggagttgcaagatggcatcggccaacggcaaacagtcgtgcgaactctgaacgcaactggagaagaaattattcagcagagctccaagacagatgcgtccatccttcaggaaaagttgggaagcctgaatctgaggtggcaggaggtgtgcaaacagctttcagataggaaaaagcgtctagaagagacactggaacgcttgcaagaactgcaggaagctactgacgaactagatctaaagttgagacaagcggaagttattaagggaagctggcagccggtcggagatttactaatcgattctctgcaggaccacctggagaaggttaaagccctgagaggagaaatcgccccactgaaggaaaatgtgtcgcatgtgaacgacctggccaggcaactaacgacactgggcatccagctctccccttataacctttctaccctcgaggacctcaataccaggtggaagttgcttcaggtggctgtcgaggaccgcgtgcggcagctccatgaggcgcaccgggatttcgggcccgcttcgcaacactttctaagcaccagcgttcagggaccatgggagagggccatcagccctaataaggtgccctactatataaatcacgagactcaaaccacctgctgggaccaccccaaaatgacggagttgtatcaaagcctggctgacttgaataatgtccgcttcagcgcgtaccgcacagccatgaagctaagacgcctccagaaggccctttgcttggacctgttatccctgtcggccgcttgtgatgcactagatcagcacaatctaaaacagaacgatcaaccaatggatatactacagattatcaactgcctgacgactatctatgatagactagaacaggaacataacaatttggtcaatgtacccctgtgtgtcgatatgtgtctcaactggttgttgaatgtctatgataccgggaggacgggccgcatccgcgtgctgagctttaagactggtatcatttccctgtgcaaggcccatctggaggacaaatatcggtatctgtttaagcaggtcgcttccagtactggcttctgcgatcagcgcagattaggcctgctactgcacgacagcatccagatacccagacagctgggcgaagtcgcttccttcggagggtctaacattgagccatccgtgcgctcttgtttccagttcgcaaacaacaagcctgaaatcgaagctgccctcttcttagattggatgaggctcgaaccccaatcgatggtgtggctccctgtactgcacagggtcgccgctgctgagactgctaagcaccaggcaaaatgcaatatctgcaaggagtgtcctataatcggtttcaggtacagatccctgaagcactttaactatgacatttgccagagttgtttctttagcggtcgagttgccaagggacacaaaatgcattatcctatggtggagtactgtactcccaccacctctggagaagatgtgcgggattttgccaaagttttaaaaaacaagtttcgtacaaagagatactttgcaaagcaccctcgcatggggtacctaccggtccaaaccgtgttggagggcgacaatatggaaaccgacacaatg

SEQ ID NO: 251407 - DNA, 3432 bp, Artificial Sequence
  Description of Artificial Sequence: Synthetic coding sequence
atgctgtggtgggaagaggtggaggattgctacgagcgcgaggacgtgcaaaagaaaaccttcactaagtgggtgaacgcgcaattctcgaagttcggcaagcaacacatcgaaaacctgttctcagaccttcaagatggacggcggctcctggacctgttggagggcctcactggtcaaaagctcccaaaggaaaaaggatcgactcgagtgcacgctctgaacaacgtgaacaaggcgcttcgcgtgctccagaataacaatgtggatctggtgaacatcggatcgaccgatatcgtggacggcaaccataaactgaccctgggactcatttggaatatcatcctgcactggcaagtgaaaaacgtcatgaaaaacatcatggccgggctccaacaaaccaactccgagaagatcttgctgtcgtgggtgcggcagtcaactagaaactacccgcaggtcaacgtgatcaatttcaccacctcctggtccgacggactcgcgctgaatgcactgatccattcgcataggccggatctcttcgactggaactcggtggtgtgtcagcagagcgccactcagagactggaacatgcattcaacattgctcgctaccaactgggcatcgagaaattgctggacccggaggacgtggacactacctacccagacaagaaatcaatcctgatgtacattacttcactcttccaggtgctgccccaacaggtgtccatcgaggctatccaggaagttgagatgctcccgcggccaccaaaagtgaccaaggaagagcatttccagcttcaccaccaaatgcactacagccagcagatcactgtgtcactcgcccaaggctacgagcgtacttcatcgcctaaacccaggttcaagtcttacgcttacacccaagccgcgtacgtgaccacctccgacccgactaggagccccttcccatctcagcacctggaggccccggaggataagtcattcggctcgtccctcatggaaagcgaagtcaacttggaccgctaccagactgcgttggaggaagtgctgagctggctgctgtccgcagaggacaccctgcaagcccagggggagatatccaacgacgtggaagtggtgaaggatcagttccacactcacgagggatacatgatggacctgaccgcgcaccaaggcagggtgggaaacatcttgcagctgggctcgaagctgatcgggactggaaagttgtcagaagatgaggaaaccgaagtgcaagagcaaatgaacctcctgaacagccggtgggaatgtctgcgcgtggccagcatggagaagcagtcgaacctgcaccgcgaaatctcatacgtcccttcgacctacctgaccgaaatcacccatgtgtcgcaggcactcttggaggtggaacaactgctgaatgcaccagatctgtgtgccaaggatttcgaggacttgttcaagcaggaggaaagcctgaagaatatcaaggattcgctgcagcaatcgtcgggaaggatcgacatcattcacagcaaaaagaccgccgccctgcagagtgccaccccagtcgaaagagtaaagctgcaggaagccttgagccagctcgatttccaatgggagaaggtcaacaagatgtacaaggaccggcagggacgcttcgatagatcggttgagaagtggagaagattccactacgatatcaagatattcaaccagtggctgaccgaagcggaacagttcctgcgcaagacccagattccggaaaactgggaacatgcgaagtacaagtggtaccttaaagaacttcaggacggaatcgggcagcggcagactgtcgtgcggactctcaacgcgacgggggaagagatcattcagcagtccagcaagactgacgcgtccatcctccaggaaaaactgggatcgctgaacctgaggtggcaagaggtgtgcaaacaactttcagacagaaaaaagcgcctcgaagaaaccctggaacgcctgcaggaactgcaggaggccacggatgagctcgacctgaagctgcggcaggccgaagtgatcaaagggtcctggcagccggtcggggaccttctgatcgactccctgcaggaccacctggaaaaggtgaaggccctgagaggagagattgcccctctgaaggaaaacgtgagccacgtcaatgacctggctcgccaactgaccactctgggtattcagctgagcccgtacaacctctccaccctggaagatctgaacaccagatggaagctgctgcaagtggcggtcgaagatcgcgtgcgccaactgcacgaggcccaccgggacttcggacccgcctcccaacacttcctgtcaacttcggtgcagggaccttgggagcgcgcaatctcaccgaacaaggtgccgtactacatcaaccacgaaactcaaaccacttgctgggaccacccaaagatgaccgagctgtaccagtcgcttgccgatctgaacaatgtgagattctcggcctatcggactgctatgaaactgcgcagactgcaaaaggccctgtgcctggaccttctgtcactgagcgcggcatgtgacgcgcttgatcaacacaacttgaagcaaaacgaccaaccaatggacatcttgcagatcatcaattgcctgactacgatctacgaccgcctggaacaggaacacaacaacctggtcaatgttcctctgtgtgtggacatgtgccttaattggctcctgaatgtctacgacactgggagaactggtcgcatccgcgtgctgtcgtttaagaccggcatcatcagcctgtgcaaagcacacctggaggacaagtacagatacctctttaagcaagtcgcctcgtcaactggtttctgcgaccagcggcggctgggcctgctgctgcacgatagcattcagatcccgcgccagctgggcgaggtggcgtctttcggcggatccaacatcgaaccgtccgtgcggtcctgttttcaattcgcaaataacaagcccgaaatcgaagccgcgctcttcctcgactggatgaggctggagcctcaatccatggtgtggctccctgtcctgcatagagtggctgccgccgaaaccgcgaagcaccaggccaaatgcaatatctgtaaagaatgcccaatcatcggattccggtaccgcagccttaagcatttcaactatgacatctgccagagctgcttcttctccggccgggtggccaaaggacataagatgcactacccgatggtcgagtactgcactccgaccacttccggggaggacgtccgcgactttgctaaggtgctcaagaataagttcagaaccaagaggtacttcgcgaagcatcctcgcatgggatacctgcccgtgcagaccgtgcttgaaggagataacatggagactgataccatg

SEQ ID NO: 251408 - DNA, 3432 bp, Artificial Sequence
  Description of Artificial Sequence: Synthetic coding sequence
atgctgtggtgggaagaggtggaggactgttatgagagagaggatgttcagaaaaaaacatttacgaagtgggttaacgcgcaatttagcaagtttggcaagcaacacattgagaacctgttcagcgatttgcaggacggcaggaggttgctggacctcctggaaggtttgacgggtcagaagcttcctaaagagaagggctcaaccagggttcacgcgctcaataacgtaaacaaggctctgagggtattgcagaacaataatgtggacctggtgaatatcggcagtacagacattgtcgatggtaatcacaagctgaccctgggtttgatctggaacatcattctccactggcaggtcaaaaacgtgatgaaaaacattatggccggtctccaacaaaccaactccgaaaagattcttttgtcttgggttcgccagagcaccagaaactatccgcaggtgaatgtcatcaattttacgacctcatggagtgatggcctggccttgaatgcgcttatccatagccacaggcccgacctgttcgattggaacagtgtagtctgccaacagagcgctacccagagactcgagcacgcattcaatatcgcccgctatcagctgggtatcgaaaagctgcttgatccagaggatgtagacactacataccctgacaagaagagcatattgatgtatattactagtctctttcaggtactcccacagcaagtgtctatcgaggccatccaagaggtggagatgctcccaagaccaccaaaggtcacaaaggaggaacactttcaactgcaccaccagatgcactatagccagcaaatcacggtgtctttggcccagggctacgaaaggacctccagcccgaagcctcgcttcaaaagctacgcgtatacacaggctgcttatgtgaccacatctgacccgactcgctccccctttcccagccaacacttggaagctcccgaggataagagcttcggctctagcctcatggagtccgaggtcaatctggataggtaccaaacagcactggaggaagtcctctcctggctcctgtccgcagaggatacactgcaggcccagggagagattagcaatgatgtcgaggtggtgaaagaccagttccatacacatgagggatatatgatggatctgacagcacatcaaggtcgcgtgggaaacattttgcagcttggatctaagctgattggcacgggcaagctgagcgaagatgaggagaccgaagtgcaggagcaaatgaatcttctgaatagtcgctgggaatgcctgagggtcgcctcaatggagaaacagtccaacctgcatagagagatctcctatgttccctctacatatctgactgagataactcatgtttcacaagccttgcttgaggtcgagcagctgctcaatgcgccagacctctgtgcgaaagatttcgaagaccttttcaagcaggaagagtcactgaaaaatatcaaggattcactccagcagtccagtggtaggattgacatcatccactctaagaagaccgccgcgctccaatccgccacccctgttgagcgcgtaaagttgcaggaggctctttctcaactggactttcaatgggaaaaagtcaataaaatgtataaggacagacaaggtaggtttgacaggtcagttgagaagtggagaagatttcactatgacattaagatcttcaatcaatggctgacggaggccgagcaattcctgcgcaagactcagataccagagaactgggagcacgctaaatataaatggtacctcaaagagttgcaagacggcatcggacagaggcagacagtggtgaggactttgaatgcaactggagaagaaatcatccagcagagctccaaaactgatgccagtatccttcaagaaaagctgggaagcctcaacctgcgctggcaggaagtttgtaaacaattgagcgataggaagaagaggctggaggagacgctggaaaggttgcaggaactgcaggaagctaccgacgagctggacctgaagcttagacaggccgaggtcatcaagggttcttggcaaccggtgggcgatctgctgattgattccttgcaggatcacctggagaaggtaaaggccttgagaggcgagatcgccccattgaaggaaaacgtgagtcacgtgaacgacctcgccagacaactcaccacactgggtatccagctgtcaccttataacctgtcaaccctggaggatttgaacactaggtggaaactcctccaggtagcagttgaggatagggtgaggcagctgcatgaagcacacagggatttcggtccggcgagccagcattttcttagcacatcagtacagggaccgtgggaacgcgctatctccccaaacaaggtcccatactacattaaccatgagacccaaactacatgctgggaccacccaaaaatgaccgagttgtaccaatctctggctgatcttaacaacgtgaggttctccgcctacagaaccgccatgaaattgaggaggctccaaaaggctctgtgtctggatctcctgagtcttagcgcggcttgtgacgccctggaccaacataatctgaagcagaacgatcagcctatggacatactgcagattatcaattgcctcactactatctatgaccgcctggagcaagagcacaacaatctggtcaatgtccccctgtgtgtcgatatgtgcttgaactggctgctcaatgtgtacgatacaggcagaactggtaggattcgcgtgctctcctttaagaccggcatcatatctctctgtaaggctcacctggaagacaagtacagatacctctttaagcaagtggcctctagcacaggtttttgcgaccagaggaggctcggtctgctcctccatgactctatccagatccccagacaactgggcgaggtggcaagtttcggtggatcaaacattgagcctagcgtgaggtcctgctttcagttcgctaacaacaagcctgagatagaggctgcactgttcctggattggatgcgcctcgagccccaatccatggtgtggctccctgttctgcacagggtggccgctgctgaaaccgctaagcaccaggccaaatgtaacatttgtaaggagtgcccaataattggctttagatataggtctctgaagcacttcaactacgacatctgccagagctgtttcttttctggtagagtagccaagggccataagatgcattaccccatggtagagtactgtacccctacaacttcaggtgaagacgttagggatttcgccaaagttctgaagaataagttcaggaccaaacgctacttcgccaagcatcctcgcatgggttacctccccgttcagacagttctggagggagataacatggagactgacactatg

SEQ ID NO: 251409 - DNA, 3432 bp, Artificial Sequence
  Description of Artificial Sequence: Synthetic coding sequence
atgttatggtgggaagaggtcgaagactgctatgagcgtgaggacgtccaaaagaaaacttttaccaagtgggtcaatgctcagttctcgaaattcggcaaacagcatatcgagaatctgttctccgacttgcaggatggtcggcgcctgcttgacttattggagggccttaccggccaaaaattgccgaaagagaaaggtagcacccgcgtgcacgcgttaaataacgtaaacaaggcgctgcgggtccttcaaaacaataatgtggatctggttaacatcggctctaccgacatcgtagatggtaatcataagctgacgctgggtttgatttggaacattatcctgcactggcaagtgaagaacgtaatgaagaatatcatggcgggtctgcagcaaacaaatagcgaaaaaattctgctgagctgggttcgccagtcaacccggaattatccgcaggtcaatgtgattaattttacaacatcctggtccgacggactggccctcaatgcactgatccactcccacaggccagacttattcgactggaattccgttgtttgtcaacagtcagctacccaacgtctggaacatgcttttaacatcgcccgctaccagctgggtatcgagaagctgctcgaccctgaggatgtggacactacttaccctgacaagaagtcaattctgatgtatattacttcgctcttccaagttttgccacagcaagtttccatcgaggccatccaggaggtggagatgctccctcgccctcctaaagtgactaaggaagaacacttccagctacaccatcagatgcattatagtcaacagataacggtctccctggcgcaaggttatgagcgtacatccagccctaagccgcgttttaaatcttacgcatacacccaggctgcgtacgtcacgacttccgatcctacgcgctcaccattcccaagccaacatctagaggcgccggaggacaagtctttcgggagctccctgatggagagcgaggtcaacctggatcgttatcaaaccgcccttgaagaagttctgagctggttgctgtcagccgaggacacgcttcaagcacagggggagatatccaacgatgttgaggtcgtgaaagatcaattccacacacatgaaggctatatgatggacctgaccgcacatcagggacgtgtaggtaacatcctgcagctgggttcaaagttgatcggtaccggcaaattgtctgaagacgaggaaactgaagtgcaggaacagatgaacctgctgaatagcaggtgggagtgcctacgcgtggcgagtatggagaaacagagcaatttgcaccgcgaaatttcctacgtgcctagcacctatctcactgagattactcacgtgtctcaagcgctgcttgaggtggagcaactgttgaatgcgccggatctgtgtgcaaaggattttgaggatctcttcaagcaagaggagagccttaagaatattaaggacagcctgcaacagagcagcggtcgcatcgatatcatccactcaaaaaaaaccgccgctcttcagtctgcgaccccagtcgagcgcgtgaagctgcaggaagcgctgtcccagctcgacttccagtgggagaaggtgaataaaatgtacaaagatcgccaggggcgttttgatcgcagcgtcgagaagtggcgcagattccactatgatattaagatttttaaccaatggctcacagaagccgagcagttcttgcgcaaaactcagatcccggagaactgggaacatgcgaaatacaagtggtatctcaaagagttgcaggatggtataggccagcgccagactgttgttcgaaccctgaacgcgacgggggaggagattattcaacaatcaagcaagactgatgccagcatcttgcaggagaaactgggtagtttgaacctgcgttggcaggaggtttgcaaacaattaagcgacaggaaaaaaagactcgaggagactctcgaacgattgcaggagctgcaggaggcaacagacgagttggatttgaagctgcggcaggccgaagtgattaaaggtagctggcaaccggtgggtgatctgttgatcgattcccttcaagatcacttggaaaaggtcaaggcgctccgtggcgaaatcgcaccgctaaaagagaatgtcagccacgtgaatgacctggctcgccagttaactaccttgggtatccagctgagcccctataatctcagcacgcttgaagatctgaatactcgctggaagctcttgcaggtggccgttgaagaccgcgtcaggcagttacacgaggcgcatcgcgattttggcccagccagccaacattttctgagcactagtgtgcagggcccatgggagagggcgatcagcccgaataaggttccatattatatcaatcacgagacccagaccacctgttgggatcaccctaagatgacagaactttatcagtctctcgctgatttgaacaatgtacggttcagcgcctaccgcacggcaatgaagctgcgccgcctgcaaaaagctttgtgcctcgatctgttgagcctgagcgcagcgtgcgacgcactggaccaacacaacttgaaacagaatgatcaaccaatggatatcctgcagattataaattgcctgactacaatctacgaccgcctcgagcaggaacacaataacctcgtcaacgtgccgctgtgtgtggatatgtgcctgaattggctacttaacgtttacgacacggggagaactggccgcatccgtgtgctatcatttaaaactggcatcatctccctgtgtaaagcgcacttggaagataaataccgctatctgttcaagcaggtcgcttctagcactggtttctgtgaccaacggcgcctagggcttctgctgcacgattctattcagatcccacgccaactgggcgaagtggcgtctttcggcggttctaatatagaaccttctgtgcgatcctgtttccaattcgccaacaacaaacctgagattgaagctgcattgttcctggattggatgcgcctggagccacagtccatggtttggctgcctgtgttgcaccgtgtggccgccgctgaaacagctaaacatcaggcgaaatgcaatatttgcaaagaatgcccgatcatcggattccgctatcgctctttgaaacacttcaactacgacatatgccagtcctgctttttttcgggacgcgtggctaagggacataaaatgcactaccctatggtggaatactgcacacctacgacctctggtgaagacgtccgcgacttcgccaaagtgttaaagaataaattcaggaccaagcgctactttgcaaagcatccgaggatgggttatctcccggttcaaactgtgctggaaggtgacaatatggagaccgacaccatg

SEQ ID NO: 251410 - DNA, 3432 bp, Artificial Sequence
  Description of Artificial Sequence: Synthetic coding sequence
atgttgtggtgggaagaggtggaggattgttacgagagggaagatgtccagaaaaagacctttactaaatgggtcaacgcacaattttccaagtttggcaagcaacacatcgagaaccttttttcggatctgcaagatggacggaggctcttggatctcctcgagggtctgaccggacaaaagctgccaaaggaaaagggatccactagggtgcacgctctgaacaacgtgaataaagcgctgagagtacttcagaacaacaacgtggatctcgtcaacattgggagtaccgacattgtggatggaaaccataagctcaccctcggcctgatttggaacattatcttgcattggcaggtcaaaaacgtgatgaagaacatcatggccggcctccaacaaactaattccgaaaagatacttctttcctgggtgcgacagagcacccgcaactacccgcaagtgaatgtgatcaatttcacgacctcttggtcagacggacttgcactgaacgctctgatccattcccaccggcctgacctttttgattggaattctgtagtgtgccagcagtccgccactcagcgacttgaacacgcatttaacatcgcaagataccaacttggaattgagaaacttctggatcctgaggatgtggacactacctaccccgacaagaaatcgattctgatgtacattacctccctcttccaagttctcccacagcaagtctctatagaggcaattcaggaagtggaaatgctgcctcgacctccaaaggttactaaggaagaacattttcaactccatcatcagatgcattactctcagcagattaccgtatcgttggcacaaggttacgaaagaacgagctcaccgaagccccggtttaagtcgtacgcctacacccaggcagcctacgtgactacttccgatccaacgcggtcaccatttccatcacaacacctggaagcgccggaggacaagagctttgggtcatccctgatggaatccgaagtgaatttggatagataccaaactgcacttgaggaagtgctgagctggcttctctccgcagaggacacccttcaggcacaaggagaaatatcaaacgatgtggaagtggtgaaggatcagtttcatactcatgaaggttatatgatggaccttactgcgcaccaaggtcgcgtggggaatattctgcaactgggctcgaagctgattgggaccggtaaactttccgaagatgaggaaactgaagttcaagaacaaatgaacctgctgaattccagatgggagtgtctgcgtgttgcatcgatggaaaagcaatccaatcttcatcgcgaaataagctacgtgcctagcacctaccttactgagatcacgcacgtgtcccaagcacttctggaagtggagcagctcctgaacgcgccagatctttgtgcaaaggacttcgaagatcttttcaagcaggaggagtccctcaagaatatcaaggattcgctccaacagagctcgggacgaattgatatcatccattctaagaaaaccgccgccctccagtcagccacccctgtcgagagagtgaagctccaggaagcactgagccagctcgactttcagtgggagaaggtgaacaagatgtacaaagatagacaggggcgatttgatagatcggtcgaaaaatggcggaggtttcattatgacataaagatcttcaaccagtggttgaccgaagcagagcaatttcttaggaaaactcaaattcccgaaaattgggaacatgcgaagtacaagtggtaccttaaagaattgcaggacggaataggacaaagacagactgtggtccgaaccctgaacgcaacgggcgaagagattatccaacagtcaagtaagactgatgcatcgattcttcaagaaaaactgggatccttgaaccttcgttggcaggaagtctgtaagcaactgtcagaccggaagaagcgcctcgaagaaactctcgagagactccaagagcttcaagaagcaactgatgaacttgatttgaaactccgccaggccgaagtgattaaggggtcatggcaaccagtcggagatcttcttatagattcgttgcaagatcacctcgaaaaggtgaaggcactgagaggtgagattgccccacttaaagagaatgtgtcacatgtcaacgatcttgctagacagcttaccaccctgggtattcaactttcgccctacaatctttcgacccttgaggatctcaatactcgctggaagctgcttcaagtggcggtggaagatagggtacgtcagctgcacgaagcccaccgggacttcggtcctgcatcgcagcatttcttgagcacctcggtgcagggtccatgggaaagagccatttcacctaacaaagtgccgtactacattaaccatgaaacccaaacgacttgctgggatcaccctaagatgaccgaactgtaccaatcgctcgcagatctgaacaatgtcagattttcggcatatagaaccgccatgaagctccggagacttcagaaagcactctgcctggatctgctgtcactctcagcagcctgtgacgccctcgaccaacataatctgaaacaaaacgatcaaccgatggacatcctgcagattatcaactgccttactaccatatacgatcgccttgaacaggagcacaataaccttgtcaatgtgccattgtgtgttgatatgtgtctgaactggctcttgaacgtttacgacactggacggacgggaagaatcagagtcctctcgttcaaaaccggtatcatttccctgtgcaaagcacatctggaggacaaatacaggtaccttttcaagcaagtagcttcgagcaccgggttttgcgaccaacggaggctggggttgctgcttcacgactccatccagatcccccgtcagctcggagaggtggctagcttcggcggcagcaatattgaaccaagcgtgcgttcctgttttcaattcgcgaacaataagcctgaaatcgaagcggcactttttcttgactggatgagactggaacctcaatccatggtttggttgccggtgctgcatcgggtggcggcggcagaaaccgcgaagcatcaagcaaaatgcaacatttgcaaggagtgtcctatcattggatttcgctaccggtccctgaaacatttcaactacgacatttgtcaaagctgtttcttttcgggtagggtggccaagggccacaagatgcattaccccatggtcgaatattgtacgcctactacctctggtgaggacgtgcgcgattttgcaaaagtgctcaagaataagttccgtactaagcgctacttcgctaaacatcctcgcatgggatacctccccgtccagaccgttctggaaggagacaacatggaaacggacactatg

SEQ ID NO: 251411 - DNA, 3432 bp, Artificial Sequence
  Description of Artificial Sequence: Synthetic coding sequence
atgctgtggtgggaggaagtggaagattgctacgagcgagaggatgtccaaaagaaaacgtttactaagtgggtgaatgctcaattctcaaagttcggaaagcagcatatcgagaatctctttagcgacctgcaggacggacgccggctcctcgatctgctggaaggactgaccgggcagaagctgccgaaagagaagggatcaactagagtgcacgccctcaacaacgtgaataaggcacttcgggtgctgcaaaacaacaatgtagatctcgtcaacattggatcgactgacatcgtcgacgggaatcacaagttgaccctgggacttatctggaatatcatccttcactggcaggtgaagaacgtgatgaagaatatcatggccggtctgcaacagaccaactccgagaaaattctcctgtcttgggtgagacagtcgactcgcaattacccacaggtcaacgtgatcaacttcacgacctcgtggagcgatgggctggcccttaacgcccttatccactcccaccgcccggatttgttcgactggaatagcgtggtgtgccagcagtccgctacgcagagacttgagcatgcatttaacatcgcacgctaccaactggggattgaaaaactgttggatcctgaagatgtggacaccacctaccctgacaaaaagagcatcctgatgtatatcacgtccttgttccaagtcctgccgcaacaggtgtcaattgaggccatccaggaggtcgagatgctgccacgccctccaaaggttaccaaagaagaacacttccagctgcaccaccagatgcactattctcagcaaatcaccgtgtctctcgctcaggggtacgagcgcacctccagcccgaagccaagatttaagagctacgcatacactcaagcggcctatgtgaccacctccgacccgactcgcagcccgttcccttcgcagcacttggaggcgcctgaagataaaagtttcggctcatccctgatggagtctgaggtcaatctcgaccgctatcagactgcgcttgaagaagtgctgtcctggctgttgtctgccgaggacaccctccaagcgcaaggcgagatctcgaatgatgtggaggttgtgaaagaccagttccatactcacgaaggatacatgatggatctgactgctcatcagggacgcgtgggaaacattctgcagttgggaagcaagctgattggcaccgggaagctgagcgaggacgaagaaaccgaggtgcaggagcagatgaacctgctgaactcgcgctgggaatgtcttagagtggcctccatggaaaagcagtctaatctccatcgggaaatctcatacgtgccgtccacttacctcactgaaatcacccatgtttctcaggcacttctggaggtggaacagctcctgaatgctccggacctgtgcgctaaggacttcgaggatctgttcaagcaggaggaatcgcttaagaacatcaaggactcactgcagcaatcaagcggccggatcgatatcatccatagcaaaaagactgccgcgttgcaaagcgcaactcctgtggagcgggtgaagctccaagaagcactgtcccagctggatttccagtgggaaaaagtcaacaagatgtacaaggatcggcaggggagattcgacaggagtgtcgaaaagtggaggcgtttccactacgacatcaaaatctttaaccaatggctcactgaggctgagcaattcctgcgcaaaacccagatcccggagaactgggaacatgccaagtacaagtggtaccttaaagaattgcaagatggcatcggtcaacggcaaacggttgtccggaccctcaacgcgactggagaagaaatcattcagcaatcgtctaagaccgacgcaagtattctccaggaaaaactggggtcgctcaacctcagatggcaggaggtctgcaaacagctgtctgacaggaagaagagactggaagaaaccctcgaacgtttgcaggaactccaggaagcaaccgacgagctcgaccttaaactgcggcaggccgaagtgatcaagggatcctggcaaccggtgggggacctcctgatcgactcgctgcaggaccacctggaaaaggtgaaggcgttgcggggagaaattgcacccctgaaggagaacgtgtcccacgtgaatgatctggcccggcaactgaccactcttggaatacagttgagcccgtacaatctttccaccctggaggacctgaacactaggtggaagctcctccaagtcgctgttgaggaccgagtccgccagctgcacgaagcccatcgcgatttcggtcctgcgtcgcaacactttctgtccacctccgttcaagggccttgggaacgcgcaatcagcccaaacaaagtgccatactacatcaaccatgaaactcaaaccacttgttgggaccacccgaagatgactgaactctaccaatcactggcggatctgaacaatgttcgcttttccgcttaccgcaccgcaatgaagttgcgaaggctgcagaaggcgctctgcctggatttgctctcgctgagcgctgcctgtgatgcactggaccagcataatcttaagcagaacgaccaacccatggacattctccagatcataaactgtctgaccactatctacgatagactggaacaggagcacaacaacctggtcaacgttccgctctgcgtggacatgtgcctgaattggctcctcaatgtgtacgataccggaaggaccggacggatcagagtgctgtcctttaagacggggataatctccctgtgtaaagcgcatcttgaagataagtataggtacctgttcaaacaggtggcatcgtccaccggtttttgcgaccaacgccgcctcggactcctgctccacgattcaatccagatcccccggcaactgggcgaagtcgcttcctttggaggatcaaatatcgaaccatccgtgcgctcctgttttcagttcgccaataacaagcccgaaatcgaggccgcgctcttcttggattggatgcggctggagccgcagtccatggtgtggctgcccgtactccatcgggtggccgcggccgagacggccaagcaccaagccaagtgcaatatctgcaaggaatgcccgatcatcgggttccgctaccggtcgctgaagcacttcaactacgacatctgccagagctgcttcttcagcggcagggtggctaaaggccacaaaatgcattacccgatggtcgagtactgcaccccgactactagcggcgaggacgtgagagacttcgcgaaggttttgaagaacaaattcaggactaagagatacttcgctaaacatccaagaatgggatacttgcctgtgcaaactgtgctggaaggcgacaacatggaaaccgatactatg

SEQ ID NO: 251412 - DNA, 3432 bp, Artificial Sequence
  Description of Artificial Sequence: Synthetic coding sequence
atgttgtggtgggaggaggtagaggactgctatgaaagggaggatgtgcagaagaagacatttacaaaatgggttaatgcccagttttccaagttcggtaaacagcacattgagaacctgttctcagacctgcaggatggtcgccgcctccttgaccttctggaaggtcttaccggtcagaaactgcctaaggagaagggctctactcgcgtgcacgccctgaacaacgtaaacaaggcccttagagtgcttcagaacaacaacgttgaccttgttaacatcggctctactgatatagttgacggcaaccacaagcttaccctgggactgatttggaatatcatcctgcattggcaagtgaagaacgtcatgaagaatatcatggctggccttcagcagacaaactccgagaaaatcctgctttcttgggtcagacaaagcacacgtaattaccctcaggttaatgttatcaatttcaccacaagctggagtgacggtctggctctcaacgcactcatacattcccatcgtccagacttgttcgactggaactccgtagtatgtcagcaaagcgcaactcagcgccttgaacatgctttcaacatcgcccgctaccaactgggaattgagaagctcctggatccagaggatgtggacaccacatatccagataagaagtccatccttatgtatatcacatctctgttccaggtcctgccacagcaggttagcatcgaggcaattcaagaagtcgagatgttgccacgtccacctaaggtgaccaaagaagagcatttccagttgcatcatcaaatgcactactcacagcagataacagtctctctcgctcagggttacgaaaggacctcctctcccaaacctcgtttcaaatcttatgcttacacacaagctgcctatgtaaccacatccgaccctactagatccccttttccatcacagcacttggaggctcccgaagacaagtccttcggatcttccttgatggaatccgaggtgaaccttgatcgctaccagaccgccctggaagaggttctgtcctggctgctttcagcagaggatactttgcaggctcagggagagatttcaaacgacgtggaggtggttaaagaccaatttcacacccacgaaggttacatgatggaccttactgctcaccagggacgcgtgggtaatattctgcagttgggcagcaaacttatcggaaccggaaaactgtccgaagacgaggaaaccgaggttcaggagcagatgaacctgctcaattcaaggtgggaatgtctgcgtgtggcttccatggagaagcagtctaacttgcatcgtgagatttcctacgtgccctctacttacctcaccgagataacccatgtgtcacaggcattgttggaagtcgaacagctgctcaatgcacctgacttgtgtgctaaagacttcgaggatctttttaagcaggaggaaagtctcaagaacattaaggactccttgcagcagtcttcaggccgtatcgatattatccacagcaagaaaaccgctgcccttcagtctgctactcctgttgagagggtaaagctgcaggaagccttgagtcagcttgacttccaatgggaaaaggtgaataagatgtataaagatcgtcaaggaaggttcgataggtcagtcgagaaatggcgcaggtttcactatgacatcaaaatcttcaaccagtggcttaccgaggctgaacaattcctccgtaagacacagattccagagaattgggaacatgcaaagtacaaatggtacctgaaagagctgcaggacggtattggtcagaggcagactgtggtgagaaccctgaatgcaaccggtgaggagataatccaacagtcctccaagaccgatgcatccatccttcaggagaagttgggcagtttgaatttgagatggcaggaggtctgtaagcagttgtccgataggaaaaagcgcttggaggaaaccttggagaggttgcaagagctgcaggaggcaacagacgaactggatctcaaattgaggcaggccgaggttataaaaggctcctggcagcctgtcggcgacttgttgattgactccctccaggaccacctcgagaaggtaaaggccctgcgcggcgagattgccccccttaaggagaatgtttctcatgttaatgatcttgcccgtcagctcactaccttgggcatacaactctcaccttacaatctctcaactttggaggacctgaatacacgctggaagctgctgcaggttgcagtggaagatagggtccgccagctgcacgaggctcaccgcgacttcggaccagcctcacagcacttcttgtccacctctgtgcagggcccttgggagcgcgctatatcccctaacaaagtgccttactatataaatcatgaaactcagacaacttgttgggaccaccctaagatgacagagctgtaccagagtctggctgatctgaataatgtccgcttttctgcctataggacagcaatgaagcttcgcaggctgcaaaaggcactgtgcctcgacttgctgagcctgtccgctgcctgtgacgctctggatcagcacaatcttaagcagaacgaccagcctatggacattctccagataatcaattgccttaccaccatctacgaccgtctggaacaggagcacaataatctcgtgaacgtgcccctgtgcgtggacatgtgtcttaattggctgctgaatgtgtacgatactggtagaacaggacgcattagagtcctgtctttcaaaacaggaattatcagcctctgcaaagcccacttggaggacaagtaccgttacctcttcaagcaagttgccagcagcaccggattctgtgatcagcgtagactgggcttgcttctccacgactcaatccagatccctaggcagcttggagaagtggcctccttcggaggctccaatattgagcccagcgttcgttcctgctttcagtttgctaacaataagcccgagattgaagcagccttgttcttggactggatgagacttgagccccaaagcatggtttggctgcccgtgcttcaccgtgttgctgccgcagaaaccgccaaacatcaggccaagtgcaacatatgcaaggagtgtccaataatcggcttcagatacaggtccctgaaacacttcaattacgatatctgtcagagttgtttcttctctggaagagtggctaagggacacaagatgcactaccccatggtcgagtactgtactcctaccacatccggagaggatgtgagagacttcgctaaggtgcttaagaataagttcaggactaagcgctactttgctaagcatccccgtatgggctatctgccagtgcagacagtgctggagggagacaacatggagacagacacaatg

SEQ ID NO: 251413 - DNA, 3432 bp, Artificial Sequence
  Description of Artificial Sequence: Synthetic coding sequence
atgttgtggtgggaagaggtggaggattgctatgagcgggaggacgtacagaaaaagacgtttactaagtgggtgaacgcgcagttctccaagttcggaaagcagcacatcgaaaacttgttcagcgacttgcaagacggccgccgactcctggatctgctggagggcctgaccggacagaaactgcccaaagaaaagggatcgacccgtgtccatgctctgaacaatgtcaataaagcgctgcgcgttctccaaaacaacaacgtggacctcgtgaatatcggatccactgatatcgtggacggcaatcacaagctcaccttgggtcttatctggaatatcatcctccactggcaggtgaagaacgtaatgaagaatatcatggcgggactgcaacagaccaactcagaaaagatcctcctgtcgtgggtcaggcaatccactcgcaactacccgcaagtcaacgtgatcaacttcacgacttcgtggtcggatggcctggcactgaacgcgctgatccactctcacagaccggatctcttcgattggaactcagtggtgtgccagcaatccgcgacccagcgcctggagcatgcattcaacatcgcccgctaccagttgggcatcgaaaagctcctcgacccagaggatgtggacaccacctaccccgacaagaaatcgattctcatgtacatcacttccctgtttcaagtgcttccgcaacaagtctcaatcgaagcaatccaagaggtcgaaatgcttccacgtccaccaaaagtgacgaaggaggagcacttccagctgcatcaccagatgcactactcacaacagattacggtgtctctcgcgcaaggttacgaacgcacgtcaagccctaagccgcgctttaagagctacgcttacactcaggcggcctacgtgaccacctccgaccctacgagatcaccgtttccgagccaacacttggaagcacctgaagataaatccttcggatcgtcgctcatggaaagcgaggtcaatctcgaccggtaccagactgcccttgaagaggtgctgtcatggctgctctcagcagaggatactctccaggcccagggggagatcagcaatgacgtggaggtcgtgaaggaccaattccacactcatgaagggtacatgatggacctgactgcccatcagggacgggtgggcaacatcctccagcttggatcaaagctgattggcactggcaagctgagcgaggatgaggaaactgaggtccaagagcagatgaacctgctgaactccagatgggagtgtctgcgcgtggcctcgatggaaaagcagtcaaatctgcaccgggaaatctcgtacgtgcctagcacttacttgacggagatcactcatgtgagccaggccctgctggaggtggaacagttgctgaacgcaccggacctgtgcgccaaggatttcgaagatcttttcaagcaggaggaatcactgaagaacattaaggactccctgcagcaatcgtccggccgcatcgacatcattcatagcaaaaagaccgccgctctccaatcggcaactcctgtggagcgggtgaagctgcaggaagcactctcacagctggatttccagtgggagaaggtgaacaagatgtacaaagatcgccagggaaggttcgaccgcagcgtcgaaaaatggcggagatttcattatgacataaagatattcaaccaatggcttaccgaggccgagcagttcctgcgcaagactcagatcccagagaactgggaacacgccaagtacaagtggtacctcaaggaactgcaagatgggatcgggcaacgacagaccgtggtgagaactctcaacgccaccggagaagagattattcagcaatcatcaaaaacggacgcttcaatcctccaagaaaaactgggaagcctgaacctgagatggcaagaagtgtgcaagcagctctcggaccgcaaaaagaggctggaggagactctggaacgactccaagaactgcaggaagcgactgacgaactcgatctcaagctgaggcaagccgaagtgatcaagggatcgtggcagcccgtcggcgacctgctcattgatagcctccaggaccacctggaaaaagtcaaggctctgaggggtgaaattgcgcccctgaaggagaatgtttcgcacgtgaatgacctggcacgccagctgactactctggggatccagctgtctccgtacaatctctcaacgctcgaagatctgaacacccgctggaaactgctgcaggtggctgtcgaagatagagtcagacaactccacgaagcacacagggatttcggaccggcatctcagcattttctctcaacttcagttcagggaccttgggagcgagctatctccccgaacaaggtgccgtactacatcaaccacgagactcagactacgtgctgggaccacccaaaaatgaccgaactgtaccagtccctggcagacctgaataatgttagatttagcgcctaccggacggcaatgaagctgcgcagattgcagaaagcgctctgtctggatctcttgtccctctctgccgcctgcgacgcacttgatcaacacaatctgaaacagaacgaccagccaatggacatcctccagatcatcaattgtcttaccactatctatgatcgcctggagcaggaacacaataacctcgtcaacgtcccgctgtgcgttgacatgtgtctgaactggctgctgaatgtctacgacactgggagaactggacgcattcgcgtgctgtcgttcaaaacggggattatcagcctgtgtaaggcccatctggaggataagtatcgatacctgtttaagcaagtcgcctccagcactggcttctgcgatcagcgccgcctcggactgcttcttcatgactcaatccagatccctagacaactgggtgaagtggcatcgttcggcggatctaatatcgagccgagtgtgcggtcatgcttccagttcgccaacaataaaccagagatcgaggctgcactgtttttggactggatgcgccttgagccgcagagcatggtctggctgccggtgctccacagggtggccgccgcggagacggccaagcatcaagctaagtgcaacatttgcaaggaatgcccgatcattggattccggtaccgctccctgaagcatttcaactacgacatctgccagagctgtttcttcagcggaagggtggccaaaggccacaaaatgcattacccaatggtggaatactgcacccctacgacctcgggtgaagatgtgcgcgacttcgccaaggtgctgaagaacaaattccggaccaagcgctacttcgcgaagcacccacgcatggggtacctgccggtccagactgttctggagggtgataacatggagacggatactatg

SEQ ID NO: 251414 - DNA, 3432 bp, Artificial Sequence
  Description of Artificial Sequence: Synthetic coding sequence
atgctgtggtgggaagaagtggaagattgctacgagcgcgaagatgtgcaaaagaaaacgttcactaaatgggtgaacgctcagtttagcaaatttggaaagcaacacatcgagaatctgttctcagatctccaagatggccgaaggcttcttgacctgctcgagggactcaccggtcaaaagttgcctaaggaaaagggatccaccagagttcacgcactgaataatgtgaacaaggcactgcgggtgttgcaaaacaacaatgtggacttggtgaacattggatcgaccgacattgttgatggcaatcacaaattgactctcggactgatatggaatatcattctccactggcaagtgaagaacgtcatgaagaacattatggcaggactgcaacaaacgaactccgagaagattctgctgtcatgggtgcgtcagtcgactcgcaactaccctcaagtgaacgtgattaactttaccacttcctggtctgatggccttgcactgaatgccctcattcatagccatcgtcccgatctgtttgattggaacagtgtggtgtgtcagcaaagcgcaactcaacgcctcgagcacgcatttaacatcgcacggtaccaacttgggatagagaagctccttgatcccgaggatgtggatactacgtaccccgacaaaaagtcgatcctgatgtatatcacttccctgtttcaagtcctgccacagcaggtgtccattgaagccattcaagaagtcgaaatgctcccaagaccaccaaaggtgactaaagaagaacactttcaactgcatcatcaaatgcattactcccaacagatcacggtgtcactggcacaaggatatgaaaggacctcgtctccgaagccccgttttaagagctacgcatatacccaggcggcctatgtgactaccagcgaccctacccgtagcccttttcctagccagcatcttgaggcaccggaagataagtcctttggtagctcattgatggagtccgaggtgaaccttgatagataccagactgcactggaagaggtgcttagctggctcctgtcggcggaggacacgctgcaagcccagggtgaaattagcaacgatgtggaagtggtgaaagaccaattccatacccatgagggctacatgatggatctcactgcccatcaaggtagggtgggaaacatcctccaactcggatccaaactgatcggcactggaaaactttcagaagatgaagaaacggaagtccaagaacagatgaatctgctgaactcgcgctgggagtgtctgcgcgttgccagcatggaaaaacaaagcaatctgcatcgtgaaatctcctacgtgccttcaacctacctgaccgaaatcacccacgtgtctcaggcattgcttgaggtggaacaactgctcaacgcaccggatctctgtgcaaaagatttcgaggacctgttcaagcaagaagagtcgctgaagaacataaaagatagcctccaacagtccagcggcagaatagacatcatccactccaaaaagactgctgcgcttcaatcagcgacccctgtggagcgagtcaagctgcaagaagcgcttagccagctggattttcaatgggaaaaggtaaacaagatgtacaaggaccgccaaggaagatttgatagaagcgtggaaaagtggcggagattccactatgatatcaagatattcaatcaatggcttactgaggccgagcagttccttcgcaaaacgcagattcccgaaaattgggagcatgcaaagtacaagtggtaccttaaggagctgcaagacggaatcggccaacggcagaccgtcgtgcgcactcttaatgcaaccggagaggaaatcattcaacaatcgagcaaaactgatgcgtccattcttcaagagaagttgggcagcttgaacctgagatggcaggaagtgtgtaagcagctctcggatcgtaagaaacggctggaagaaactctcgagcggcttcaagagttgcaggaggcaacggatgaactggatcttaagctcagacaggcagaagtcatcaagggatcgtggcagcctgtcggtgatctgctcattgactcgttgcaggaccatctggagaaggtcaaggcgctgcgtggagaaattgccccgcttaaagaaaacgtgtcccacgtgaacgacctggccagacaacttaccaccttgggaatccagctgtccccgtataacctttcgaccctggaagatttgaacacgaggtggaaacttctccaagtcgcagttgaggaccgagtccgacagcttcacgaagcgcacagagactttggccccgcctcgcagcatttcctcagcacctcagtacaagggccttgggaaagagcgatcagcccgaataaagttccatactacatcaatcatgaaacccagactacgtgttgggaccatcctaagatgaccgagctttaccagtccctcgcagatttgaataatgttagattttccgcttacaggacggcgatgaaacttcgcagactccagaaggccctgtgccttgatctgctttcactgtcggcagcttgtgatgcactggatcaacataacctgaaacaaaacgatcaaccaatggacattcttcagatcataaactgcctgaccactatttacgatcgccttgaacaggaacacaacaaccttgtgaatgtgcctctgtgtgtcgatatgtgtcttaactggcttctcaatgtgtacgacacgggacggaccggtagaattcgggtgttgtccttcaagaccgggattatctcgctttgcaaggctcacctggaggacaagtacagatacctgtttaagcaagttgcctctagcaccggattttgtgatcaacgtaggcttggcctgctgctgcatgattccatacaaataccacggcaacttggtgaagtggcgtccttcggcgggtccaacatcgaaccttcggtccgcagctgctttcagttcgcaaataacaagcccgagattgaggcagcattgtttcttgactggatgagactcgagccccagtcaatggtctggcttccagtgttgcatagggtggctgcagcggaaaccgccaagcatcaggcaaaatgcaacatttgcaaagagtgtcctataatcggattccgctacagatccctgaagcatttcaattacgacatatgtcaaagctgttttttctcgggtagagtcgcaaaggggcacaaaatgcattacccaatggtggaatactgcacccctaccacgtcaggcgaggatgtccgagatttcgccaaagtcctcaagaataagtttagaaccaagcgttactttgcaaagcacccacggatgggataccttccggtgcagaccgtcctggagggagataacatggagactgacacgatg

SEQ ID NO: 251415 - DNA, 3432 bp, Artificial Sequence
  Description of Artificial Sequence: Synthetic coding sequence
atgctgtggtgggaagaagtcgaggattgctacgaaagggaggacgtgcagaagaaaactttcaccaaatgggtgaacgcccaattctcgaagttcggtaagcagcacatagaaaacctgttttcagatcttcaggacggacggagactccttgacctcctggagggtctgactggtcaaaaactgcctaaggaaaaaggttcaacgcgagtgcatgcgctcaataatgtcaataaggcacttcgcgtgctgcagaataacaacgtcgacttggtgaatatcggctctactgatattgtggatggtaaccacaaacttacgctgggactgatttggaacattattctccattggcaagtgaagaatgtgatgaagaacataatggccggactgcaacagacgaatagcgaaaagatactgctttcgtgggtgcgacaatccactaggaattatccacaggtgaacgtgataaacttcactacgtcctggagcgacggtcttgcccttaacgcacttatccatagccatcggccagatctttttgactggaacagcgtcgtttgccaacagtccgcaacccaacgcctggagcacgctttcaacattgcacgctaccaacttggcatcgaaaagctgcttgatccagaagatgtcgacaccacctacccggacaagaagtccattctgatgtacattacttcgctttttcaagtcctcccccagcaagtgtcgatcgaagctatccaagaagtggaaatgctgccaaggccacctaaggtgactaaggaagagcattttcagctgcaccatcaaatgcattacagccaacaaataactgtgtcgctggcccaaggatatgagcggacgagcagcccaaaacctagattcaagtcgtacgcatacactcaagccgcatatgtgactacctcggatcccaccaggtcaccattcccatcgcagcatcttgaggcccccgaagataagtcattcggatcgtcgcttatggagagtgaggtcaatctggatcgttaccagactgccctggaagaagtgctgtcgtggctccttagcgccgaagatacccttcaggctcaaggtgaaatttcgaacgatgtagaagtcgtgaaggaccaattccatactcatgaggggtacatgatggacctgactgcgcaccagggacgagtgggaaacatcctccagcttggatcaaagctgatcggcaccggtaaactcagcgaagatgaggagactgaagtgcaggaacagatgaacctgctcaattcacgttgggaatgtcttagagtcgcctcaatggagaaacagtcgaacctgcatagggagatatcctacgtgcctagcacgtacctgactgaaattactcatgtctcgcaagccctgcttgaagtggaacaactgcttaacgcgccagatctctgcgctaaggatttcgaggacctctttaagcaagaggaatcactcaaaaacattaaggactcgctgcagcagtcctcaggccgtatcgatatcatccattcaaagaaaaccgcggcactgcaatctgcaacccctgtcgaaagagtgaaacttcaagaggctctttcccaattggacttccaatgggaaaaagtcaataagatgtacaaagatcggcaaggccgtttcgatcgctcggtggaaaagtggaggcgcttccattacgatatcaaaatctttaaccagtggctgaccgaagcagaacaatttctgcgcaaaactcagatccctgaaaactgggaacatgcaaagtacaaatggtaccttaaggaactgcaggatggtattggccaaagacaaaccgtcgtgagaactcttaacgcaacgggtgaggaaatcattcagcaatcttccaagaccgatgcatcgatccttcaggaaaaactgggaagcctgaacctgaggtggcaggaagtgtgtaagcagctctcggatcgcaagaagcgcctggaagagactcttgaaaggctccaggagctgcaagaggccactgatgaattggatctgaagctgcgtcaggccgaggtgatcaagggttcctggcagcctgtgggtgatctgcttattgatagccttcaggaccacttggagaaggtgaaagcactgcgcggcgagattgccccacttaaggagaatgtgtcgcacgttaacgatcttgcacgccaactgaccaccctcggcattcaactttcgccctacaacttgtcgactcttgaagatcttaacacccgctggaagctgttgcaggtcgcagtcgaagatagggtccgccaacttcacgaagcacatcgtgattttggaccagcttcacaacattttctctcgacgtccgtgcagggcccatgggaaagagcaatctcaccgaacaaagtgccgtactatatcaatcatgaaactcagacgacctgttgggatcaccccaagatgacggagctgtaccaatcgcttgcagacttgaataacgtcaggttttcggcatacagaactgcaatgaagctcaggagactccagaaagccctctgcctcgacctgcttagcctgtccgcagcctgtgacgcgttggatcagcacaatctgaagcaaaacgaccaacctatggatattctgcaaatcattaactgcctgactaccatctacgatcggctggaacaggagcataacaacctggtgaatgtccctctctgcgtggatatgtgtcttaactggcttctgaatgtgtacgataccggacgcaccggccgcattcgggtgctctcgtttaagaccggcatcatttcactgtgcaaggcccatctggaggataagtatagatacctcttcaagcaagttgcatcttccaccgggttttgtgatcagagacgcctgggactgctgttgcatgactcgatacaaatcccccgacagctgggtgaagtggccagctttgggggatcaaacatcgaacctagcgtgcgtagctgctttcagtttgcaaacaacaaacctgaaattgaagccgctctgtttcttgattggatgcgacttgaacctcaatcgatggtttggctcccggtgctgcatagagtcgcggcagcagaaacggctaagcatcaagctaagtgcaacatctgtaaggaatgtccgattattggttttaggtacagatcgctcaagcatttcaattacgatatttgccaaagctgttttttctcgggaagagtggcgaagggccacaaaatgcattaccctatggtggagtactgtacccctaccactagcggcgaagatgtgcgggactttgccaaggtccttaagaacaagtttcgtaccaagcgatactttgcaaaacatcctcggatggggtacctcccagtgcagaccgtcctcgaaggtgataacatggaaaccgacactatg

SEQ ID NO: 251416 - DNA, 3432 bp, Artificial Sequence
  Description of Artificial Sequence: Synthetic coding sequence
atgttgtggtgggaagaagtggaggattgctatgagagggaggacgtgcagaagaagacctttacaaagtgggttaacgcccaattctctaaattcggcaaacaacacatcgagaatctgtttagcgatcttcaggacggacgacgactgttggacctgttggagggcctcactggtcagaagttacctaaggagaagggttccacaagagtgcatgccctcaataacgtgaacaaggcgcttagggtgttgcagaacaataacgtggatctcgttaacataggcagtactgacattgtggatggaaatcacaaactcaccttaggactgatctggaatataatccttcactggcaggtgaagaacgtgatgaagaatatcatggcgggactgcagcagaccaacagcgagaagatcctactatcctgggtgcgtcagagcactaggaattacccgcaagtgaacgtgataaacttcactacgagctggtccgacggactggcactcaatgctctcattcactcacataggccggacctgtttgattggaatagtgttgtgtgccagcagagtgccactcaacgactagaacacgcattcaacattgcaaggtatcaacttggcattgagaaactgctcgacccggaagacgtggacactacataccccgataaaaagtctatcctgatgtacattacttcactttttcaagtgttgcctcagcaggtgagcatagaagcaatacaggaagtcgagatgctgccacgtccacccaaagttaccaaggaggagcacttccagttgcatcatcagatgcattacagccaacagattacagtgtcattggctcagggatacgaacgtacctcatctcccaaacccagatttaagagttacgcgtacacacaggccgcgtacgtcaccacctcggatcccaccagaagccctttcccctcccagcatctcgaggctcccgaggacaagtccttcggcagttctctcatggagtccgaagtaaatctggatagataccagacagccctcgaagaagtgctctcatggctcctctcagctgaagacacgttgcaggcacagggcgaaatatctaacgacgtcgaggtggttaaggatcagttccatacccatgaaggctatatgatggatctgacagcccaccaaggccgcgtcggtaatatcctgcagctgggttccaagttaattggcacaggcaagctgtcagaggacgaggagacagaagtacaagagcagatgaacctgctcaatagcagatgggaatgtcttagggtggcttcaatggagaagcaatctaatttgcatagggagatctcgtatgtgccctccacctaccttaccgaaattacccacgtgtcccaggcactactggaggtggaacaactcctaaatgcccctgacctctgtgctaaagatttcgaagacttgtttaagcaagaggagagcctcaaaaacataaaggatagtcttcagcaatcttcaggcaggatcgatattatccattccaagaaaacagcagcacttcagtcagctacacccgtagaaagagtcaaattgcaagaagctctgagccagctggactttcaatgggagaaggtgaacaagatgtacaaggacaggcagggacgttttgatcgttccgtggagaagtggaggagatttcactacgacataaaaatatttaatcagtggctcaccgaggcagagcagttcctacgcaagacccagatccctgaaaattgggagcacgccaaatacaagtggtacttgaaagagctgcaagacggaataggccagcgtcagactgtagtccgtacactcaacgctaccggggaggagatcattcagcagagctccaaaaccgatgcttccattctgcaggaaaaactagggtcactgaatttaaggtggcaggaagtgtgtaagcagctcagcgatcgaaagaaaaggctcgaggagaccctggaaagacttcaggaactccaggaggccaccgacgaactggacctgaaacttagacaagctgaagtgattaaggggtcgtggcagccggtcggcgacctgctgattgattctctgcaggatcacctcgagaaggtcaaagccctgaggggggagattgcccccctgaaggagaacgtgtcccacgttaatgacctggctaggcagctgaccacactcgggattcagctcagtccttacaacctgtctaccctagaagacctgaacacacggtggaaattactgcaggtagccgtggaagacagggtaagacagctccacgaggcccaccgagacttcggcccagcctctcagcacttcctctctacttcagtgcaaggaccttgggagagggccatctcaccgaacaaagtgccttattatattaatcatgaaacccagaccacctgctgggatcatcctaaaatgaccgaactgtatcagagcctcgcagaccttaataacgtccggttttctgcctatcgtacagccatgaagctgaggaggctgcaaaaagcactctgtctcgacctcctgtcgctgagcgccgcttgcgacgcactcgaccagcacaacctcaagcagaacgatcagcccatggacatacttcaaattattaattgcctgactactatatatgatcgactcgaacaggaacataataacctagtgaacgttcccctgtgcgtggatatgtgtcttaactggctgctgaatgtgtacgacaccgggaggacaggaaggatccgagtgcttagcttcaagacaggtatcatttctctctgcaaggcacatctggaggacaagtatcgctatctattcaaacaggttgcaagctccacagggttttgtgatcaaaggaggcttggcctgttactccatgactctattcagatccctcgacagttaggcgaggtggccagcttcggggggtcaaacatcgaaccctcggtaaggtcctgcttccagtttgccaataataaacctgagattgaagctgcactgttcttggattggatgagactggaaccccagtcaatggtatggctcccggtgcttcatagagtggccgccgcggagacggcaaagcatcaagccaagtgcaatatctgcaaagaatgtcctatcattggatttagatatcgatccctaaagcattttaattacgacatctgtcagtcctgtttttttagtggcagggtggccaagggccataagatgcattaccctatggtggagtactgtacacctacaacttctggtgaagatgtaagggactttgctaaagtcctcaagaacaaattccgcactaagaggtacttcgccaagcacccaagaatggggtatctgcccgttcagactgtgctggagggtgataacatggaaactgacacgatg

SEQ ID NO: 251417 - DNA, 3432 bp, Artificial Sequence
  Description of Artificial Sequence: Synthetic coding sequence
atgttatggtgggaagaggttgaagattgttatgaaagagaagatgttcaaaaaaagacttttacaaagtgggttaatgctcaattttctaagtttggaaaacaacatattgaaaatttattttcagatttacaagatggaagaagattgttagacttattagaaggattaacaggtcaaaaactcccaaaagagaagggaagtacacgtgtacatgcacttaataatgttaataaagctttgagagttttacaaaataataatgttgatcttgtcaatattggtagtactgatattgtagatggtaatcataagcttacattaggtcttatttggaatattattttgcattggcaagttaagaatgtaatgaaaaacatcatggcaggattacaacaaactaacagtgaaaaaatccttctctcatgggttagacaatctacccgtaattatccacaagttaatgttattaatttcacaactagttggtctgacggattagcactcaatgctttaatccattcacataggccagatttatttgactggaattcagttgtatgtcaacaaagtgctactcaaagattggaacatgcttttaatatagcaagataccaacttggaattgaaaaactattagatccagaagatgttgatacaacttatcctgataaaaaatctatacttatgtatattacgagcttatttcaagttcttccacaacaggtttctattgaagctatacaagaagttgaaatgttacctagaccacctaaagttacaaaagaagagcattttcaattacatcatcaaatgcattattcacaacaaattacagtatctttagctcaaggatatgaaagaacaagttctccaaagccaagatttaaatcatatgcatatacccaagctgcttatgttacaacatctgatccaactagatctccatttccatcacaacatttagaggctccagaagataaaagttttggaagtagtttaatggaaagtgaagttaaccttgatagatatcaaacagctttggaagaagttttatcatggttattatcagctgaagatactcttcaagcacaaggtgaaatttctaatgacgttgaagttgtaaaagatcaatttcatacacatgaaggatatatgatggatttaacagcccatcaaggaagagttggtaacattcttcaattaggatcaaaacttattgggactggaaaactttcagaagatgaagaaacagaggtgcaagagcaaatgaacttacttaactcaagatgggaatgtcttagagtagcttcaatggaaaagcaaagtaatttacatagagaaataagttatgtgccatcaacgtatttaacagaaatcacacatgttagtcaagcattattagaagttgaacaacttcttaatgctccagatttatgcgctaaagatttcgaagatttattcaaacaagaggaatctcttaaaaatataaaagattctcttcagcaatcaagtggtagaatcgatattattcattcaaaaaaaaccgctgcactacaatcagcaaccccagtggaaagagtgaaattacaagaagctttaagtcaattagattttcaatgggaaaaagttaataagatgtataaggatagacaagggagatttgacagaagcgttgaaaaatggagaagatttcattacgatattaaaattttcaatcaatggttaactgaagctgaacaatttcttagaaaaacacaaataccagagaattgggaacatgctaaatataaatggtatttaaaagaacttcaagatggaattggtcaaagacaaactgttgttagaactcttaatgctacaggagaagaaattatccaacaatcttcaaaaactgatgcatcaattcttcaagagaaattaggttcattaaatttaagatggcaagaagtatgcaaacaactaagtgatagaaaaaaaagattagaagaaacattagaaagattacaagaacttcaagaggcaacagatgagttagatttaaagttgcgacaagctgaagttattaaagggtcttggcaacctgttggagatttattaatagatagtttacaagatcatcttgagaaagtaaaagctcttagaggagagattgctccattaaaggagaatgtttctcatgtaaatgatcttgcaagacaacttacaactttaggaattcaattaagtccatacaatttaagtactcttgaagaccttaatactagatggaaactattacaagttgctgtagaagatagagttcgtcaattacatgaagctcatcgagattttggtcctgcatcacaacatttcttaagtacttctgttcaaggtccatgggaaagagcaatatctcctaataaagtaccatactatattaatcatgaaacacaaactacttgttgggatcatccaaaaatgactgaattatatcaatctttagcagatttaaataatgtaagattttcagcatatagaactgctatgaaattaagacgtttacaaaaagctctttgtttagatcttttatcactttcagctgcttgtgatgctttagatcaacacaatttaaaacaaaatgatcaaccaatggacatattacaaatcattaattgtcttactaccatttatgatagattagaacaagaacataacaatttagttaatgtaccattatgtgtcgatatgtgtcttaattggttattaaatgtctatgatacaggtagaactggacgaattagagttttatcttttaagactggaattattagtttatgtaaggctcatttagaagataaatatagatatcttttcaaacaagtagcaagttcaactggtttttgtgatcaacgaagattaggactccttcttcatgactcaatccaaataccaagacagttgggagaagtagctagtttcggtggatcaaatattgaaccatcagtacgaagttgttttcaatttgcaaataacaaacctgaaatagaagctgcattattccttgattggatgagattagaaccacaatctatggtatggttaccagttttacatagagttgctgcagcagaaacagcaaaacatcaagctaagtgtaatatttgtaaagaatgcccaataattgggttcagatatcgttcattaaaacattttaattatgatatttgccaaagttgttttttttcagggagagttgcaaagggacataaaatgcattatccaatggttgaatattgtacaccaactacttctggagaagatgtaagagacttcgcaaaagttttaaaaaataaatttagaacaaaacgttattttgcaaaacatccaagaatgggatatcttccagttcaaactgttttagaaggtgataatatggaaacagatacaatg

SEQ ID NO: 251418 - DNA, 3432 bp, Artificial Sequence
  Description of Artificial Sequence: Synthetic coding sequence
atgctgtggtgggaagaggtcgaggactgctacgaacgcgaagatgtccaaaagaaaaccttcaccaagtgggtcaacgcccaattttcgaaatttggaaagcaacatatcgagaatctcttcagcgaccttcaagacggacgacgccttctggacctgctcgaaggtcttaccggacagaagctccctaaggagaagggatccaccagagtccatgcccttaacaatgtgaataaagccctgagggtcctgcagaataacaacgtcgacctggtgaacatcggttccaccgatattgtcgatggtaaccacaaacttacgctgggtcttatttggaacatcattcttcactggcaggtgaagaacgtgatgaagaacattatggcaggcctgcaacagaccaactcagagaaaattcttcttagctgggtgcggcagtccacccgcaactacccgcaagtcaatgtgattaactttactacctcgtggtccgacggactggccttgaatgcactcatacactcccaccgccctgatctctttgattggaattcagtggtctgtcagcaaagcgctacgcaaaggctggagcatgcattcaatatagcgagataccagcttggaattgaaaagttgcttgatcctgaagatgtggacaccacttaccctgataagaagtcaatcctgatgtacattacttccctgttccaggtgctgcctcagcaagtgagcatcgaagcaattcaagaagtggagatgttgcctaggcctccaaaggtgacgaaggaagaacattttcaactgcatcatcaaatgcattactcccaacaaattaccgtctcattggcacaagggtatgagaggacctcgtcgcccaaacctcgttttaagagctacgcgtatacccaggcagcctacgtgactacttcagacccaactaggagcccttttccctctcaacatctcgaggcacctgaagataagtcgttcggtagctcactcatggaatcggaagtgaatttggaccgctaccaaactgcacttgaagaggtgctgtcctggcttctgtcagcagaagatactcttcaagcacagggggaaataagcaacgacgtcgaagtcgtgaaagaccagtttcatacccatgaaggttacatgatggatctgactgcccatcaaggacgggtgggtaatatcctgcagctgggatcgaaacttatcgggaccggcaaactttcagaagatgaagaaaccgaagtccaagagcagatgaatctgctgaactcacggtgggaatgtctgcgtgtggcctcgatggagaaacaatctaaccttcatagagagatatcatacgtgccttcgacttacttgactgagatcactcatgtgtcgcaagcacttttggaggttgagcaacttctgaatgcacctgatctttgtgcgaaggattttgaagatctgttcaagcaggaagaatcgctgaaaaacattaaagactccctgcagcaaagctcgggtagaattgacattatccactcaaaaaagaccgcagcactccagtcggcaaccccagtggaaagagtcaagctccaagaggcgcttagccaactggactttcagtgggaaaaggtgaataagatgtacaaggaccggcagggaagatttgatcgcagcgtggagaaatggcgacggtttcattacgacataaagattttcaaccagtggctcactgaagccgaacagtttctgcgaaagacgcagattcctgagaattgggagcacgctaagtacaagtggtatttgaaggaactgcaggacggtatcggacagcgtcaaactgtggtgcgtactttgaacgcaactggcgaagaaatcatacaacaatccagtaagaccgatgcatccattctccaagaaaagctggggtccctgaatctgcgctggcaagaagtgtgtaaacagctcagcgaccgaaagaaaagactcgaagagacgttggagcggctccaagaactgcaagaggcaaccgatgagcttgatctgaaattgagacaagccgaggtgatcaaaggttcctggcagcccgtgggcgaccttctcattgactcccttcaagaccacttggagaaagtgaaggcacttaggggcgagatcgcacctcttaaagaaaacgtgtcccatgtcaatgacctggctcgccagctcacgactctgggaatccaacttagcccttacaacctgtcgactcttgaggacctcaataccagatggaagttgcttcaagtggcagtggaagatcgcgtccgacagcttcacgaagcacacagagattttggacctgcctcgcagcactttctctcgacttccgtgcagggtccatgggagagggcaatttcccccaacaaggtgccatattacatcaaccatgaaacccaaactacgtgctgggaccatcctaagatgacggagctgtaccaaagcctggctgacctcaacaatgtgaggttcagcgcctacagaacggcaatgaagctgcgccggctccagaaggctctctgtcttgatctcctgtcactgtccgccgcatgtgacgcacttgaccagcacaatctgaaacagaacgaccagccgatggacattcttcagattatcaattgcctcaccaccatctatgacagattggaacaggagcataacaacctggttaatgtgcccttgtgtgtggatatgtgccttaattggcttcttaatgtctacgatacggggagaactggacgtatcagggtgcttagctttaagacgggaattatctctctttgtaaggcccatcttgaggacaagtatcggtacctctttaaacaggtggcatcctcgactggattttgtgatcagcgtagacttggacttctgctccacgattccattcagattcctagacagctgggggaggtggcctccttcggcggtagcaacatcgaaccatccgtcagaagctgttttcaattcgcgaacaataagcccgaaattgaagccgcgctttttcttgattggatgcgacttgaacctcaatcgatggtctggctgccagttctgcatcgagtggcggcagcagagacggccaaacatcaagcaaaatgtaacatctgcaaggaatgtcccattatcggttttagataccggagcctcaagcactttaactatgatatttgtcaaagctgtttcttttccggtcgagttgcaaaaggacataagatgcattacccgatggtggaatactgcacccctaccactagcggtgaggatgtcagagatttcgcaaaggtgctgaagaataagttccgcactaaaagatactttgcgaaacatccccggatgggataccttcctgtgcagactgtgctggagggcgacaatatggagactgatactatg

SEQ ID NO: 251419 - protein, 4 aa, Homo sapiens
  MOD_RES (2)..(3): Any amino acid
RXXR

SEQ ID NO: 251420 - protein, 4 aa, Homo sapiens
  MOD_RES (2)..(2): Any amino acid
  MOD_RES (3)..(3): Lys or Arg
RXXR

SEQ ID NO: 251421 - protein, 6 aa, Homo sapiens
  MOD_RES (1)..(1): Lys or Arg
  MOD_RES (2)..(5): Any amino acid
  MOD_RES (6)..(6): Lys or Arg
XXXXXX

SEQ ID NO: 251422 - protein, 8 aa, Homo sapiens
  MOD_RES (1)..(1): Lys or Arg
  MOD_RES (2)..(7): Any amino acid
  MOD_RES (8)..(8): Lys or Arg
XXXXXXXX

SEQ ID NO: 251423 - protein, 6 aa, Homo sapiens
LVPRGS

SEQ ID NO: 251424 - protein, 4 aa, Homo sapiens
LVPR

SEQ ID NO: 251425 - protein, 4 aa, Homo sapiens
  MOD_RES (1)..(1): Ala, Phe, Gly, Ile, Leu, Thr, Val or Met
  MOD_RES (2)..(2): Ala, Phe, Gly, Ile, Leu, Thr, Val or Trp
XXPR

SEQ ID NO: 251426 - protein, 4 aa, Homo sapiens
IEGR

SEQ ID NO: 251427 - protein, 4 aa, Homo sapiens
IDGR

SEQ ID NO: 251428 - protein, 4 aa, Homo sapiens
AEGR

SEQ ID NO: 251429 - protein, 4 aa, Homo sapiens
  MOD_RES (1)..(1): Ala, Phe, Gly, Ile, Leu, Thr, Val or Met
  MOD_RES (2)..(2): Asp or Glu
XXGR

SEQ ID NO: 251430 - DNA, 615 bp, Homo sapiens
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 251431 - DNA, 800 bp, Artificial Sequence
  Description of Artificial Sequence: Synthetic transcript sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 251432 - DNA, 800 bp, Artificial Sequence
  Description of Artificial Sequence: Synthetic transcript sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 251433 - RNA, 758 nt, Artificial Sequence
  Description of Artificial Sequence: Synthetic transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 251434 - RNA, 854 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 251435 - DNA, 896 bp, Artificial Sequence
  Description of Artificial Sequence: Synthetic transcript sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataagctgccttctgcggggcttgccttctggccatgcccttcttctctcccttgcacctgtacctcttggtctttgaataaagcctgagtaggaaggcggccgctcgagcatgcatctaga

SEQ ID NO: 251436 - RNA, 725 nt, Artificial Sequence
  Description of Artificial Sequence: Synthetic transcript sequence
gggaaauaagagagaaaagaagaguaagaagaaauauaagagccaccaugggagugcacgagugucccgcgugguugugguugcugcugucgcucuugagccucccacugggacugccugugcugggggcaccacccagauugaucugcgacucacggguacuugagagguaccuucuugaagccaaagaagccgaaaacaucacaaccggaugcgccgagcacugcucccucaaugagaacauuacuguaccggauacaaaggucaauuucuaugcauggaagagaauggaaguaggacagcaggccgucgaaguguggcaggggcucgcgcuuuugucggaggcgguguugcggggucaggcccuccucgucaacucaucacagccgugggagccccuccaacuucaugucgauaaagcggugucggggcuccgcagcuugacgacguugcuucgggcucugggcgcacaaaaggaggcuauuucgccgccugacgcggccuccgcggcaccccuccgaacgaucaccgcggacacguuuaggaagcuuuuuagaguguacagcaauuuccuccgcggaaagcugaaauuguauacuggugaagcguguaggacaggggaucgcugauaagcugccuucugcggggcuugccuucuggccaugcccuucuucucucccuugcaccuguaccucuuggucuuugaauaaagccugaguaggaag

SEQ ID NO: 251437 - RNA, 1536 nt, Artificial Sequence
  Description of Artificial Sequence: Synthetic transcript sequence
gggaaauaagagagaaaagaagaguaagaagaaauauaagagccaccaaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugaucagccagcgcugccuucugcggggcuugccuucuggccaugcccuucuucucucccuugcaccuguaccucuuggucuuugaauaaagccugaguaggaag

SEQ ID NO: 251438 - DNA, 767 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgctcgagcatgcatctaga

SEQ ID NO: 251439 - DNA, 750 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgc

SEQ ID NO: 251440 - DNA, 1578 bp, Artificial Sequence
  Description of Artificial Sequence: Synthetic transcript sequence
taatacgactcactatagggaaataagagagaaaagaagagtaagaagaaatataagagccaccaatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgatcagccagcgctgccttctgcggggcttgccttctggccatgcccttcttctctcccttgcacctgtacctcttggtctttgaataaagcctgagtaggaaggcggccgctcgagcatgcatctaga

SEQ ID NO: 251441 - RNA, 851 nt, Artificial Sequence
  Description of Artificial Sequence: Synthetic transcript sequence
gggaaauaagagagaaaagaagaguaagaagaaauauaagagccaccauggugagcaagggcgaggaggauaacauggccaucaucaaggaguucaugcgcuucaaggugcacauggagggcuccgugaacggccacgaguucgagaucgagggcgagggcgagggccgccccuacgagggcacccagaccgccaagcugaaggugaccaaggguggcccccugcccuucgccugggacauccuguccccucaguucauguacggcuccaaggccuacgugaagcaccccgccgacauccccgacuacuugaagcuguccuuccccgagggcuucaagugggagcgcgugaugaacuucgaggacggcggcguggugaccgugacccaggacuccucccugcaggacggcgaguucaucuacaaggugaagcugcgcggcaccaacuuccccuccgacggccccguaaugcagaagaagaccaugggcugggaggccuccuccgagcggauguaccccgaggacggcgcccugaagggcgagaucaagcagaggcugaagcugaaggacggcggccacuacgacgcugaggucaagaccaccuacaaggccaagaagcccgugcagcugcccggcgccuacaacgucaacaucaaguuggacaucaccucccacaacgaggacuacaccaucguggaacaguacgaacgcgccgagggccgccacuccaccggcggcauggacgagcuguacaagugagcugccuucugcggggcuugccuucuggccaugcccuucuucucucccuugcaccuguaccucuuggucuuugaauaaagccugaguaggaag

SEQ ID NO: 251442 - DNA, 1838 bp, Artificial Sequence
  Description of Artificial Sequence: Synthetic transcript sequence
taatacgactcactatagggaaataagagagaaaagaagagtaagaagaaatataagagccaccatggaagatgcgaagaacatcaagaagggacctgccccgttttaccctttggaggacggtacagcaggagaacagctccacaaggcgatgaaacgctacgccctggtccccggaacgattgcgtttaccgatgcacatattgaggtagacatcacatacgcagaatacttcgaaatgtcggtgaggctggcggaagcgatgaagagatatggtcttaacactaatcaccgcatcgtggtgtgttcggagaactcattgcagtttttcatgccggtccttggagcacttttcatcggggtcgcagtcgcgccagcgaacgacatctacaatgagcgggaactcttgaatagcatgggaatctcccagccgacggtcgtgtttgtctccaaaaaggggctgcagaaaatcctcaacgtgcagaagaagctccccattattcaaaagatcatcattatggatagcaagacagattaccaagggttccagtcgatgtatacctttgtgacatcgcatttgccgccagggtttaacgagtatgacttcgtccccgagtcatttgacagagataaaaccatcgcgctgattatgaattcctcgggtagcaccggtttgccaaagggggtggcgttgccccaccgcactgcttgtgtgcggttctcgcacgctagggatcctatctttggtaatcagatcattcccgacacagcaatcctgtccgtggtaccttttcatcacggttttggcatgttcacgactctcggctatttgatttgcggtttcagggtcgtacttatgtatcggttcgaggaagaactgtttttgagatccttgcaagattacaagatccagtcggccctccttgtgccaacgcttttctcattctttgcgaaatcgacacttattgataagtatgacctttccaatctgcatgagattgcctcagggggagcgccgcttagcaaggaagtcggggaggcagtggccaagcgcttccaccttcccggaattcggcagggatacgggctcacggagacaacatccgcgatccttatcacgcccgagggtgacgataagccgggagccgtcggaaaagtggtccccttctttgaagccaaggtcgtagacctcgacacgggaaaaaccctcggagtgaaccagaggggcgagctctgcgtgagagggccgatgatcatgtcaggttacgtgaataaccctgaagcgacgaatgcgctgatcgacaaggatgggtggttgcattcgggagacattgcctattgggatgaggatgagcacttctttatcgtagatcgacttaagagcttgatcaaatacaaaggctatcaggtagcgcctgccgagctcgagtcaatcctgctccagcaccccaacattttcgacgccggagtggccgggttgcccgatgacgacgcgggtgagctgccagcggccgtggtagtcctcgaacatgggaaaacaatgaccgaaaaggagatcgtggactacgtagcatcacaagtgacgactgcgaagaaactgaggggaggggtagtctttgtggacgaggtcccgaaaggcttgactgggaagcttgacgctcgcaaaatccgggaaatcctgattaaggcaaagaaaggcgggaaaatcgctgtctgataagctgccttctgcggggcttgccttctggccatgcccttcttctctcccttgcacctgtacctcttggtctttgaataaagcctgagtaggaaggcggccgctcgagcatgcatctaga

SEQ ID NO: 251443 - RNA, 1796 nt, Artificial Sequence
  Description of Artificial Sequence: Synthetic transcript sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 251444 - DNA, 905 bp, Artificial Sequence
  Description of Artificial Sequence: Synthetic transcript sequence
taatacgactcactatagggaaataagagagaaaagaagagtaagaagaaatataagagccaccatggtgtccaagggtgaggaattgtttaccggggtggtgcctattctcgtcgaacttgacggggatgtgaatggacacaagttttcggtatccggagaaggagagggtgacgccacatacggaaagcttacactcaaattcatctgtacgacggggaaactgcccgtaccctggcctacgctcgtaaccacgctgacttatggagtgcagtgctttagcagataccccgaccatatgaagcagcacgacttcttcaagtcggcgatgcccgaggggtacgtgcaagagaggaccattttcttcaaagacgatggcaattacaaaacacgcgcagaagtcaagtttgagggcgatactctggtcaatcggatcgaattgaagggaatcgatttcaaagaagatggaaacatccttggccataagctcgagtacaactataactcgcataatgtctatatcatggctgacaagcagaaaaacggtatcaaagtcaactttaagatccgacacaatattgaggacggttcggtgcagcttgcggaccactatcaacagaatacgccgattggggatggtccggtccttttgccggataaccattatctctcaacccagtcagccctgagcaaagatccaaacgagaagagggaccacatggtcttgctcgaattcgtgacagcggcagggatcactctgggaatggacgagttgtacaagtgataagctgccttctgcggggcttgccttctggccatgcccttcttctctcccttgcacctgtacctcttggtctttgaataaagcctgagtaggaaggcggccgctcgagcatgcatctaga

SEQ ID NO: 251445 - RNA, 863 nt, Artificial Sequence
  Description of Artificial Sequence: Synthetic transcript sequence
gggaaauaagagagaaaagaagaguaagaagaaauauaagagccaccaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaagcugccuucugcggggcuugccuucuggccaugcccuucuucucucccuugcaccuguaccucuuggucuuugaauaaagccugaguaggaag

SEQ ID NO: 251446 - RNA, 716 nt, Artificial Sequence
  Description of Artificial Sequence: Synthetic transcript sequence
gggaaauaagagagaaaagaagaguaagaagaaauauaagagccaccaugaacuuucucuugucaugggugcacuggagccuugcgcugcugcuguaucuucaucacgcuaaguggagccaggccgcacccauggcggaggguggcggacagaaucaccacgaaguagucaaauucauggacguguaccagaggucguauugccauccgauugaaacucuuguggauaucuuucaagaauaccccgaugaaaucgaguacauuuucaaaccgucgugugucccucucaugaggugcgggggaugcugcaaugaugaaggguuggaguguguccccacggaggagucgaauaucacaaugcaaaucaugcgcaucaaaccacaucagggucagcauauuggagagauguccuuucuccagcacaacaaaugugaguguagaccgaagaaggaccgagcccgacaggaaaacccaugcggaccgugcuccgagcggcgcaaacacuuguucguacaagacccccagacaugcaagugcucauguaagaauaccgauucgcgguguaaggcgagacagcuggaauugaacgagcgcacguguaggugcgacaagccuagacggugagcugccuucugcggggcuugccuucuggccaugcccuucuucucucccuugcaccuguaccucuuggucuuugaauaaagccugaguaggaag

SEQ ID NO: 251447 - RNA, 1316 nt, Artificial Sequence
  Description of Artificial Sequence: Synthetic transcript sequence
gggaaauaagagagaaaagaagaguaagaagaaauauaagagccaccaugcccccaucgggauugagauuguugccccuucugcuuccgcugcuuugguugcucguccugaccccuggcaggcccgcagcgggguugucgacguguaagacgauugacauggagcucgugaaacgcaagagaauugaagcaaucaggggucaaauucugagcaaacucagacucgcauccccaccgucccagggugaggucccaccgggaccucugcccgaggcgguccuggccuuguacaacucgacacgcgaccgagucgcaggggagucagcggaacccgagcccgaacccgaggccgacuacuacgccaaagaggucacucgggucuugaugguggaaacucacaacgaaaucuacgacaaguuuaagcagucgacccauucgaucuacauguucuucaauaccagcgagcuuagagaagcgguccccgagccgguacuuuuguccagagcggagcugcgguugcucaggcucaagcugaaaguggaacagcacguagagcuuuaucagaaguacagcaacaauucauggcgguaucucucgaaccggcuguuggcgccgucggauucacccgaauggcucagcuuugaugucacggggguggugcgccagugguuguccaggggcggagagaucgaaggauuucggcucucagcccacuguucgugugauagcagggacaacacgcuccaaguagauaucaacggauucacuacuggucgcagaggggaucuugcgacaauccacgguaugaaucgcccuuuucuccugcugauggccacaccccuugaacgggcgcaacaucuucagucaucccgccauaggagagcacuggacacgaacuacuguuuuucgucgacagagaagaauugcugcgugcggcagcuuuacaucgacuuccgaaaagaucucggguggaaauggauucaugaaccgaagggguaucacgccaacuucugccuggguccguguccuuauaucuggucguuggauacacaguauucaaagguguuggcucuuuacaaucagcacaacccgggagccucggcugcgccuuguugcguaccccaggcauuggagccauugccgauuguguauuaugugggaagaaagccgaaaguggagcaguugucgaauaugaucguacggagcugcaaaugcuccugauaagcugccuucugcggggcuugccuucuggccaugcccuucuucucucccuugcaccuguaccucuuggucuuugaauaaagccugaguaggaag

SEQ ID NO: 251448 - RNA, 806 nt, Artificial Sequence
  Description of Artificial Sequence: Synthetic transcript sequence
gggaaauaagagagaaaagaagaguaagaagaaauauaagagccaccauggguguaaggcacccgcccugcucccacagacuccuggcggugugugccuugguaucgcuugcgaccgccgcacugcuugucaauccggggguagucgugcgcaucagccagaagggacuggauuacgccucgcagcaggguaccgcggcacuucagaaagagcuuaagcggaucaagauuccagacuauucagauagcuuuaagaucaagcauuugggaaaaggucacuauucguuuuacucgauggacauuagagaauuccagcucccuucgucccaaauuuccauggucccgaauguggggcugaaauucagcauuucgaacgcgaacaucaagaucucagggaaauggaaggcacagaagcgauuucucaaaaugucaggaaacuuugaucucuccaucgaggggaugucaaucucggcggacuugaaacucggcuccaauccuacaucgggaaagcccacuauuacggccucgucguguucgagccauaucaacucggugcacguccauaucucaaaguccaaaguaggauggcuuauccagcucuuccacaaaaagauugagucggcuuugcgcaacaagaugaauagccaagugugcgagaaagucacaaauuccgugucaucagaauugcagcccuacuuccaaacgcuguaaugagcugccuucugcggggcuugccuucuggccaugcccuucuucucucccuugcaccuguaccucuuggucuuugaauaaagccugaguaggaag

SEQ ID NO: 251449 - RNA, 1573 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaggaagcggagcuacuaacuucagccugcugaagcaggcuggagacguggaggagaacccuggaccuaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaauggucuuugaauaaagccugaguaggaag

SEQ ID NO: 251450 - RNA, 1568 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggugauaauaggcugccuucugcggggcuugccuucuggccaugcccuucuucucucccuugcaccuguaccucuuggucuuugaauaaagccugaguaggaag

SEQ ID NO: 251451 - RNA, 863 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugauaauaggcugccuucugcggggcuugccuucuggccaugcccuucuucucucccuugcaccuguaccucuuggucuuugaauaaagccugaguaggaag
